United States Patent 10,870,889 (IMMUNOGLOBULIN EXPRESSION LEVELS AS BIOMARKER FOR PROTEASOME INHIBITOR RESPONSE) - sequence listing, part 6

SEQ ID NO: 545 - DNA, 38996 bp, Homo sapiens
attctcctggcagcccccgcccgccccgccagggggagcgtctgcgcccgacgtaggctgcggggcctgggctggcggcgcagggcggtgactcggctcggtggctgccctcccgcgtccccaccccctccccgcccgcccccggcgcggccctgcccgccccctccgccccctcccgcagcgccatgcgcagactcagttcctggagaaagatggcgacagccgagaagcagaaacacgacgggcgggtgaagatcggccactacattctgggtgacacgctgggggtcggcaccttcggcaaagtgaagggtgagaaccccgcgggactaggcttggccccagctgaggagccgcacgacttccgctttccgcacctcttcatcctcccccgcccgctgcgtcccttctttccagggctgggcagcccctgtcccggatcctgcgggagctctccccagccgccgcggggctgcggcgcggccagcacaggccgggtgggggtgggggtggggtaggggccagtcgccatggcgacggcgccgcggcctgaggggctggtaggtacgaggggctgggatgcgaaggtgcaaactttcccaggtggggcaggcgggcggcgcggcgcgctctgggtgctgggagggggcgccgggcgcgatccccggggaggcggcatcttgtgcgcccgggttgtgctcccttggctcagggccagcccatcgcttccttggcggtccttggcgttgtcggtatttccgtcctctgtaggaggctgtcgatttaccggcccctgctgtttcccgagtgcgaaatgtgtttccgcagaagtaaggtttctttgtgggtagccgacatcattttttttaaagaccatgtcgtcggaaaggatcactggtttccttcggagcagttaatgagtataaactggttcagtatttgcgatgcatggtttacgttctgaatgagactgtgcctttagtgtttccgaattaacaggagtttctccgtgcgaaacttcgttgttagttcagatgttgcctccagatagtatttattactttattagtacagttcatttccacttattttcaaaggttatttgtattctaataaactctttaagtgcacatcattcgaacttttgttttaagaaaggtgtattgggtgcattgtacagcattcgggtgacgggtacactaaaagcccagacttcaccactatgcagttcatctatgtaaccaaaagccacttgtacccctaaagctattgaaattaaaagaaaagtgtggactctttcaaaacactattctggaaataaacttgctctacagtccaccaattctggcaaaaaaacgtttaattgcaagttttgtaaggcatgattttttttttctttaacatatttgactttgttataagggatgcagagaaaggaagtttggaactgataaaaataattcatgcattggctttggataaataatagactgacttgcatatactaagttcttggtaaatatttgacttgaaagaaaaaaagtttgccaaagtctgtacggtaactcaactgagccttactcttccagagctaaataaacagtttctgattttatttagggttagaagagaagaacgcttccttctcttgccattttctgagtcatagaattggaaaattgttgtatatcccacagggaagcaactgcctgaaccttcttatgaaaatctgcaaggcggacaatgtcaggaggaagtaagaagcaaatgccagaattgggtaataacagctattaggacaggtccatataaggccagtaagatgtttctgtgccatggaagttttaactttatctttggctatgatatttcttgttagcaattacaaactgctttttagtttacaagtgtttgtaaaaaaaaaaatgttcatttttgcccccatcccttcccagagttctgcctggattagggtgttcatcattcccctaatatagacttgaatgcttgaataaagtcaggtctatttttttttcttttttcttttttcttttcccgagatggggtcttgctctgttgcccaggctggagtgccgtgtggtgtgatcttggctcattgcaacctccgcttcctgggttcaagcagttctcctgcctcagcctcctgagtagctggaattacaggcgcccaccaccacacccggctaatttcatatttttagtagagatggggtttcaccatgttggcccggctggtctcgaactcctgacctcaggtgatctacccacctcagcctcccaaagtgctgggattacaggcgtgagccactgtgcccggccaggtctgttttcgtatttgctaagtggtttttggcatggcaggtagtaaagcaggaagagatttttcatcttctggatttgatctgtgatatggctgtgacacgaatgtctccagtgactttgctgtttcttaaccttcacttccccacccacactaacttctcttggagtaccatattctgttaaagtcaacaaactctccaaatgtacaaaggccaatattagtccaaggatcataggtttcatagatatggttaaatttgttcatgatcacatttgttgatgttgatcagaatctttaacctgttcattttttaagttaacagttgggatgctttttgccacaagtaatagaaaatctagctttgcctagtaaagaacttatctgtggttctctttccacagataagtccttccagcagggaaggccagcatatctcttatgagtctcattggctcatccagtccctctggctaggaatgccatgtgccagttggcttatgcttgtattcctaagcaggcattagcaagggggatggcattgcccttggaggagtatgacccaccctttgatgtgtgtgtgcaacagaggtgggtgggtgggagacatcttttttttaaaatttgttttattttttaaatttttctttaagttattggggtacagatggtatttggttgcatgagtaaattctttagtggtgatttgtgagattttggtgcacccatcacctgagcagtatacattgcatcatatttgtagtcttttatccctcacccctctcccactcttccccctcaagtccccatagtccactgtatcattcttatgcctttgcgtcctcatagcttagctcccacatatcagtgattagaacatactgtgttggttttccattcctgagttacttcacttagaataatagtctccactcttatccaagtcactgcaaatgctgttaattcattcctttttatggctgtgtagtattccattttgtgtgtgtgtgtgtgtgtgtgtgtgtatatatatgtatacaccacagtttctttatccatacattgagtgatgggcatttggattggttccacgattttgcaattgtgaattgtgctgctataaacatgcatgtgcaagtatctttttcgaataatgacttcttttcagaagagattgctggatcaaatggtagttctacttttagttctttaaggaatatctacactgttttccatagcagctgtgctagtttacattcccaccagcagtgtagaagtgttccctgttcacccttttcaacaaattgtgctgggataattggccagccacatgtaggagaatgaaactggattctcatctctcaaccttatataaaaatcaactcaagatggattaaggacttaaacctaagacctgaaactataaaaattctagaagataacattggaaaaacccttctagacattggcttaggcaaggatttaatgactaagaacccaaaagcaaatgcaataaaaacaaagataaatagatgggacctaattaaattgaagagcttttgcacaggaaaaggaacagcagagtaaacagacaacccacacagtgggagaaaatcttcctaatcaatacatctgaaaaagtactaatatccagaatccacaatgaactcaaacaaataagtaagaaaaaacaaatagtcccatcaaaaagtgggctaaggatatgaatagacagttctcaaaagaagatatacaaatggccagcaaacatgaaaaaatgctcagcatccctaatgatcagggaaatgcaaatcagaaccacaatgtgataccacctcactcctgcaagaatggccatcatcaaaaaatcaaaaagcagtagatagattttagtgtgcatgtggtgaacagggaacacttttttttttttttggagacagttttgctcttgtcacccaggctggagtgcattggcgcaatctcagctcattgcaacctctgcctcccaggttcaagtgattcttctgcctcaacttccctagtagctgggattacagacgtgtgccaccacgtcctgctaatttttgtatttttagtagagatggggtttcatcatgttggccaggctggtcttgaactcctgacctcaggtgatcccacccgcctcggcctcccaaagtgctgggattacaggcctgaaccaccgtgctgggctgggagacatcttctaagtacttggatagtgtggggggacagggtagacacctacacataaatggatgttgttaggagagagaaagggggacatggatactcagtgaacacacagaaatggccactattgtggtgatgttggtaattaaacaccaacagccttaattatgcaagaattcttgcaaataatagggttaaccatatgtttagacaatttggagtaaagaaagctttaaaaattacttatacatattggtaaatttaacatgaagagggatctaataaaatatatgatattgatatgcagaaaaagtctaagtatgatattccatgcttataggaaatttaattttgcggggagagtaggctggaagttcggagtgattgtttcctgttacaggccaaaaaatttgtttggttacttagtggtagcattttgagaggaaagtttacagaaaactagggttattttgtgattatgcttgaattgtctttattgtttccaaggcatcttttttttttccttctagttatcaagatgttaggttctgtgcccttgtgggccttccctctgcccaaaaaaagcatggatgagcagagtaatatcattaaaatggcagtctttgttagtttttctagagaagatggtctctttggtaggctgggtgtatcttcggcaaatgagttatttatacatataaactattaagttggcaagtatttcttttttttctttttctttttttttttttgagatggagttccactcttgtcgcccaggctggagtgcaatggtgcgatctcagctcactgcaacttccacctcccgggttcaagcgattctccagcctcagcctcccaagtggctgggattataggcgcccaccactacgcccagctattttttttttgtatttttagtagagatggggtttcaccacgtcggccaggttagtctcgaactcctgacctcaggtgatccacccacctcagcctcccacagtgctgggattacaggcatgagccaccatgcttggcctaagttcgtaagtatttctgtgtaaaactgcaatttcagctacataggtactttgtgaatgaatcatagtagaagttatttaaaaattcctttaagtaaaaattataaacatgaactagagctatatatatcagtgtgaatgaatcttaaaaatataaggttagacctcgaaagcaagttgtataagaatatgtatagtttgctgttatttatataaattttagaaacctacagaaccactcatacaatgctggtagagtataaattggtatcctacctctacatgagagagtgacagcatttattaaaattaacctaacaattcaacttctaggaattattttatagatgtactcgtgtatgaaataatgggttattcgctgccatattgttgtaaatattaatacaaaactttcgaagtaacctttctaatagtaatagttatggtttatccatatagtgaaataccttgcaaacattaaggaagaaaaagggaggaactttgtatattttagagaacaatttccaaggtgtatttttaagaggaaaaagtagaacagtgtgttcaatatgcctaccacttatgtataaaaggcaggggcaaatctgtatcttaaatgtgactgcttttatatatagagtatgtctctttaaagatacacacaagactggttacgttagttgctcagtataggggactaggtaaaggaggacattgtgttgcaccatagatgcttttgtacttttgaactgtgtgtatagtgcaggtattgtgttatcaaaatatatgcaatgacatttgtaaaaataaatatgaaaaataatgttactatattttttatggattcctacccatgtaaaaatatttaaacgtgggaaacacaaacaccaaattcaggatagtggttacttctgaggacagatgaaggataagggaatctgggaggagtcatgcagggcttgagttgtatttgtaatgttttattgcttaagctgatggtggctcatgggtatttggaatgcccttggtgtgcttgaaatgtttgtttgctttcttaaattacgatctatagcttttaaagcccacccttccccaggattaagctatttccttaacacgtttttattctttcaattttaaagtgggaatgaaatggttaggtgtctagaatatctttagtagatatttctatctttgctgcttctctgtcctattaaaatcctctgtttcaaagtatgatcttgtttcccttcaggattatatatctaattagaagagcatttgttacaatgttatgcagttagacaaagttccctttagatagcaatagcatggttgttagctaatatttagttgactaatctgctattcttgtgagggggacattgtgaatgctggtaatatttgctctgagtaatgtgcaagtcttccgtggccaaaatatctgtcttccgtttcatttaaaagcaaaaccttagcactattctaaaaactgacagtctgaagaataaagtttgaattttgaaaaaggggggaatcccttagtagtgcatatgcctgacagagtccatttactacattcattgattgactatggaacagcatttagtttggctacaactgagtttactcactggggagaatatttagcctggttttgagaaaacagtttagtttctgataccatgccaagccctttgtccctctcactgcacagtgatggtggggagagtggataggtcaaaagacttgggagtcggaagacctgtcccaacttgatcacaatagctttacttccacaacttacagaatctcttagagcctcagtttctttatctgtaaaagacaatacctccatcataggtttatgctcaaatgtgataatgtgagtgtctcctaagctattagatgccatattttaaaaagtattatgctactgaaggccgggtgtggtggctcacgcctgtaatcccagcacttttgggaggctaaggcgggcagatcacgagctcaagatattgagaccatcctggccaacatggtgaaaccccatctctactaaaaatacaaaaatcagctgggtgtggtggcatgcgcctgttgtcccagctactcgggaggctgaggcaggagaattgcttgaaccccggaggcagaggttgcagtgagccgagattgtgccactgcactccagcctggcgacagagcgaggctccatctcaacaacaacaacaacaacaaaaaaaaaaaaaaagaaagagttgactcctgatagactatgaaggctgggatacaaattcaaaaagcggaaaaccacacgagctggaacactataggctgggagcaaaaagccctatcctgctaaataactcccactgctgtcactgtgtgagggtataaggagcagttgatactcataagttaacatttgtttggttcccagtcttcatgtacatgtgttccatttaagaagtcatgatcatgtgtagtacaattagaaaacctgttttcaaaaaatattacttctgttaacttgttaattttaatggtgaatatcatagtttagaaaatccaccctccttttcttgtcagggactgagtgtgtggtcctgctcctgttatgtatggaggcaaagggaaagggctccggccccctcaaaatcatgtctttggtgccagccggttctgttctcagtcacctggatactgaactttcctgagcagggcagaactgagatccagtgggcttctccccaggatgcttacgctttttcatttgatttcaggtctcctctttcgcttcctattgcaaccaatgaaggccattcctaccataagtaaataaaaaagaaaatctatctttaataaataacaattgtatatatttatggggcacaatgtgatgttttgatacatgtatacattctgcactgatcaaatcaggccaagtagtatatccatctcctcaaatatttatcatttctttgtggtgagaacatttaaagttcccttttttaactcttttgaaaaattaatatatttactgtaatcatgatgctatgcaatacaacaccaggatcctgttcctcctgactgtaattttatgtagccattgaccaatatcttccttttcccctccagccccacttaccccagctactggtaatcaccattctactctctacttctgtgagtttgacttttttagattccaaatataagtgagtctcagacacctctgacatactgatttcaattcctttggatatatactcagtaatgggattgctggatcatatagtaattctatttttagttttgtgaggaacctctacactgttttacaaaatggctgtatttatagtttcaccagcagtgtataagtgttccatttctctgtgaccttgctaacacttatctttcacctttttgataatagccagtctaacaggtgtgaggtgataccttattgtggctttaatttgcatttctcttatgattagagatgttcagcattctttcatctatctgttggccatttgtttgtctttttttttatttttatttttgagacagtgtctcactctgttgcccaggctggagtgcagtggcatgatcatggctcactgcagccttgacctcctgggctcaagcgatcctcccacctctgcctcccaagtagctgggactacaggcatacaccaccacgcctggctaatttatgtatgttttatagagacaaggtctcactgtgttgcttagactggtcttgtattcttgggctcaagtgatccacccgcgtcggcctcccaaagtgctgagattacaggcatgagccaccatgcctggccggatattagctatatatctgatgcatgatttgtaaatacgttttctcagtctttgggttgtctcttcactctatttgtttttgcttgtttgtttgtttttttgagatgcagtctccctctgtcacccaggctggagtgcaatggcgtgatcttggctcactgcagcgtccgcctcccgggttcaagcgattcttttgcctcagcctcatgagtagctgggactacaggtgtgcaccactacgctcagctaattttgtatttttagtagagatagggcttcaccatgttggtcaggctggtctcgaactcctgaccttgtgatccgcctgcctcggcctgccaaagtgttgggattacgcgtctggcctgtttgtttgttttttgctgttcagaagctttttagtttgatgtcatcccatttgtttattattgcttttgttgcctgtgcattaggggatcatatacaagaaatgattgcccaaacctgtgtcatggagcttctcgcctaagttttcttctagtagatttgtaatttcaggtcctaaatttaatccattttaagttgatacttgttaaggggtgagataagggtccatttccattcttctgtatgtggctatccagttttccaaatgacattattgaagagactgtcctttccacattgtgtagtcttggcacctttgtcaaaaatccattgattatagatatatgcatttattctgggctatccatcctattccattggtggacatgtctgtttttatgtcagtgccgtgctgttttaattactataggtttgtaatatattttcaaacatggtagtgtgatgcctccagctttgttctctttggacctaaagtctattttgtctgaaataaatatagctatctctgttctctttttgtttgcatttgtatggaatatctttttcagtcccttcattttcagtctatgagtgtcctttatggtgaagtgagtctctttataggcagcgcagagttggatcttgttttttatccatttagccactctatgcctgttgtttggagaatttaatctgtttacattggaagtaattattgataggtaaggacttagtagtgccattttgttaattgttttctagtgtttctgtagaacctttgtccctttctctattactttccccctttgtggctcgattgctttctgtagtggtccactttggattttttctttttatcttttgcaaaagcaaaggcttttgctttgtagttaccctgtggcttacacaaaacatcttataactggtatataagctgataacaagttaactttgatcacatacacacattctacatttttactccccctcttccatgttttatgttcatgatgtcacgatatacatttaaaaaataatttgtatctttaacaaattattgtagctttattattattattattattattattattttgagatggagtttcactcttgttgccgggactggagtgcagtggcgtgatcttggctcaccccaacctccacctcctgggttcaagctattctcctgcctcagcctcgtgagtagctgggattacaggcatgcgccaccacgcccggctaattttgtatttttagtagagacggggtttctccatgttggtcaggctggtctcaaactcccaacctcaggtgatatgcccgcttcggcctcccaaagtgctaggattacaggtgtgagccaccgcgcctggctagctttaactatttttaatagttttatcttttaacctttatactagatatataattcatttacttaccaccattacagtattagtgtgttttggggttgacagtatacttactttttccagtgagttttatacttttcatgttttcctgtcactcattagtgtcttctttattcagcttgaagaagtttctttaccatttctttttctgtttctttttgtttgtttgagacaaagtctcactttgttgcctaggccagagtgcagtggtgagatcttggctcactgcaacctctgcctgctctgttcaagtgatccttccactcagcctcccaagtagctaggattacaggcgtgcaccaccactggcagcttttttttttttttttttttttttttgtatttttagtagagacagggtttcaccatgttggccaggccagttttgaactcctaacctcaagtgctctgcctgcctcggcctcccaaggtgctgggattacaggcgtgagccaccatgcctgaccactgtttttcattctttatccttttttcttcttcagattgtatgatttccagtggcctgtcttctaattactaatcttttcttctgcttgatgtagcctgtggttgaacccctttattgaatttttcagttcagttatactattcctcagctctatgattactgtttggtacttctttagaaaatccacttttcaactgataaactaactatatccatttctagggctgccgtaacaatgccacagactcaatgacttacagcaacagaaaattattctttgccagtactggaggtgagaaatttgaaatcaaagggccatcagggccatgtttcttctgaaggctctagtggagaatctgttccttgcctcttccagctgctgctgcttttttttttttttttgagacggagtctcactctgtcacccagaatagagtgcagtggcatgatctcagctcactgcaacctccgcctcctgggttcaagtgattctcctgcctcagtctctcaagtagctgggactataggtgtgttccaccactcctggctaatttttctatttttagtagagatggagtttcgccatgttggccaggctggtctcgaactcctgacctcaggtgatctccccgcctcggcctcccaaagtgctgggattacaggcgtgagccaccgtgcccagccctctttcaccttcttgtggctcctgatgttccttggtttgtgatagcataactccagtctctgcctctgtcttcaaatggctgcgctcgcttgctctctctctctctctctctctctctctctctctctctctgtgtgtgtgtgtgtgtgctctcctcttcttgtaaggataccaggcattagatatagggctcaccctaaatccagtaagatttcatcttcaaatccttcactagtcacgtctgaaaagatcctatttccaaataagataacaatcagagattctgggttgacatagattttgtggggacgttattcacttcactacacttgtttttatattttgtatacttttagttttatgctttctttcttagtttttgagtaacttttaaattggtttgatagaatgtattagtaaaatgtctgtgggctgggcgtggttggttaatgcctgtaatcccagcactttgggaggccgagggggggcggatcacctgcggtcaggagttcaagaccagcctgaccaacatggtgaaaccccatctctactaaacatacaaaaattagccgggcgaggtggtaggtgcctgtaatcccagctacttgggaggctgaggtaggagaatcgcttgaacccaggaggcggaggttgcagtgagctgagatcatgccattgcactccagcctgggcaacaagagcaaaactccgtctcaaaaataaaaaataaataaaataaaataaaatgtctgtggaatcctaagacattgaaattgatatgaggcaggttttcagtacactggattcatgttctgatacaggaaggaggtcatagtagcagtgcctggcacatagtaggtgctggtactcaaatatttcttgaatgaatgaatttgtatgattgaatgcatttctggataattcttattactacaaggaattcagtctattcttttcaaaactgtatatacattaagaatttctctgatatgtttaacttccatttatgttttattaaaaggatgtgtatttttacatgtcttctgaggattatctttttaaaaaaatcaaatttcacttaaccatgttcggaaaaagcataactttaagagtctgacctgggttgaagttttggcttttccactcattagctgtgtaactttgggcaagttatttcatctttctgtgcctcagtttcctgtaaaatgttgctaataatgccaagtcttccaggttggtgagagtgtgtcagtatgtttgggtacaaagtgagtatgctgcaaatattaactagtaagttgtatactttaattatgtattgtaaaggaactagatttatgttgtaaaaaattgtttttgttaaaaaaagagcccttgtttattaaaactcacatcaaattaagctgcttttttcctctgtgttcttctgtgaccaaacaagtgttcctgtagtaggtgaaatcactgtcaaggattggtgttatgtgtatatatgtctgatagtaatctgttgaacattaaccaaagtcaggaaatgagttgaactttggaaggtagaaatctgaggattggtggtagtggtggtggggtaggagtggtggagcgggttggagggattgaagtatatgggaatgggagctagatacattaaaatgacagctattatttatttagcacttatgtacctggataaaggaatgctattgcatctacatggataggtatcaccaatcagagctgagataaaactggctattcagagattaaaacaaataattcagggctgattagatacagatgggggaacaggtctgggagcagtggaaaataaataaccctaaataataaaggctaccatttatttatcaatcacttgctatatgccaggcattgtggaaagtgctttacaaacactattccatgtatctgttatagtcacccttatggagtatgtggtattcttattttaaagatgagtaaatagaaggttgtagtttctttaacttgcccaagtcaaacatctagtaagtaccttcaaacaggaataaaaccgaggtctgtgcgactataaaatctatgctttgtatacatactgctttcacatgtgcaattggaattaggggttcaaccctattcaactctacttccaaaaaaggtgaatctgctaatactacttccaattgtttttttcccctttggaaatttttttttttgagatggagtctcgctctgttgcccaggctggagtgcagtggcatgatctccgctcactgtaacctccgcctctcgggttcaagcgattctcctgcctcagcctcctaagtagctgggattacaggtgcgtgccaacacgcctggttaattttttttgtatttttagtagagatggggtttcagcatgttggccaaactggtctcgaactcctgaccttgtgatccacccacctcgtcctccaaagtgctgggattacaggcttgagccaccgcactcggccttggaaattttttttctaactgataagaatacaaagcagcaagtaaaattcaaaaaggatcacagtggaataacttttcattttagcatattaacatttttatatgatttttttgtgtagctaaaaaatgtaaaatgcatatataatttttttttatgtttgtaagaacattttctatagttttcctatgagagtctgttaggttggaataacaatgtattaaactgttctctgaaattggtcagccttttgttcttacataatacactgtaatgaacatatttatgcacatttttttcatcaacttttaaatcaaattcttagaaggaaaactacagattaaaaaagaaaagatcctgatcatgtaatttgtgtgtgtgtttatgaatttgaatgatctcttggcatggctgtcagggcactgcctctattcctgccactgtgatacgatcatacttttgtgatttcttctattacttcaaaagggaagaagttataccaccatactttaaaacaattaatttataatttgatgaaatgctcaagtattagaaaaaagttttatggtatatcttgattggttatggattttgttctgcttattatgccttcttttgggtggttggggggcttctgttatttacaggtggattaatattctgctccgtattactcatgagttaaattatactcaattccctattccgtagttaccaccttccctcctatttttgctaatttcctcctcattttttgttgtgtgttctataaaatttcccatcacattattattgctactacctactgttttctaaatgattttaattgtattgtaaaattcttcttgctctgctctaatttcatacctcctatattttcttatcactctgaaaatagttaataaattttgctaatacaatcatgcatttcatggatgagtttaatgtctattcatttttttgttttattcttttgtattataagactttttgctttttctcactttactgttatttttgtcatcattacaggccgggaaggtcccatagcccaggttgcttttggtcaatactgttttccccagcagcattaactggcatgtaggagatgctcagtacataatgccaaaataatgaatttgagagaatgctttgaattcctattccagttccttattaaatgacaggatatatgtccagagttttggataagctccagtcatttcttaaagttaattggggttgaagttcagttgagcagggtatcataggagtttggttggtttgtgatggtttgggagttcaggcccaaattggattctgtcttagtattctttccaggtcttgagtccaccagtattatccagtattgtggctatttcccagtcctgtttcagctgagcagctgtcaagagaaagtctgtgccaagccagagcttggagattcttggaggatgtgtttagcaccatgcttaggtttcaacatacttgttctaagaaaaaagatacttcctgaagcaagctttaacagtcaagttggctgctcttaatcacatctaattagtactggagattggagaaagccttattagaaattagaatgtgcttcatttccacagttgatttcagctgtgattatagggttgccttccttctttctcttatacatttcatactacacccccatcctcctaatatagttatatcgtacttttaataaaacctatatttggttttttcataattgtggctgtgtaaatactatttgctaagtcagtatctatgactatgttttatttcttacagaactttaattttactggcattcatgaattatctcatttttttcatttgtttaatttttttacctaaagcttaatttcttacatcttccagtgcctttgtaaaatccctcagaaataactatcttggattctctgtcacattcctgtctggatttgttgccttctaggccttctccatatgttactgtgactttgcttcaccattttgagattctcttagtttttctcctatattggatcccttctttgctggattccatgccatctttcttgggtttcttcctgattttgatggaatatatattctccagtaggttcctgagaaagggtgcacaaaggttaaatttttggagacttagcctcatgactgtctaaattctactggtgatcatatccccaaaagaccaaatccctaatgccataatcccaaatgttgaaatactgaaagatcaaaatctctaaaaatcagaatccctaaattctaaaaatctcacacatctgaaatcctgaaaatcagaatcatgaaagattaaaatcccaaatgttgaaatgctgaaagccaacacctggggtagaaattagtgcacattcggttgtatgaaagatagttgcatcattttacttgcatcatattaggtggaaccgattgcctttttattgtatttatttggaaattaagtatggtttaaggagatggtttatgggtgccaaattgacgaggggtggattcatggatttaattttaggtgtcaacttgactggattaagaaatacctagaaacttgttaaagcattattttgggtttgtctgtgaggagattagtatgtgagtctgagtggactaggtggggaagatctgccctcaatagcggtggccaccattaaatctgctgggggcccagagaaaacaaattgttgcctttctgagagctggaacggacttttcttctgctgaattgaacatcagaactccaggcttgttggcatttggactctaggacatacaccagcagccccctgggtcctgggctttcagcctcagactgagacctggtttggcttggttctgaggtctttggactgagccaagctaccagcatgccagggtctccagcttgaaaatgacctgtcctggaacttatcagccactataatcgcatgagccaattcccctaataaatcgtctctcatatatctatgtatatatatatcttattggttatgtctctcaagaatgctgtctgtcgagaattatgtctgtcgagaatgctgactaatacggatttggtattgagaaagccaaatatcattccttcttactgtattccttacagcacagtggaagagacctgtgaaattgttcccttgcaaaaaggctgtgataaattaagtataccaggctacttaatgctgaaagagaaaagtttaaaagctaattattattggtgttgtgaagacagaaaatcacttaattgcaatggccaagcaataaccagatttctaaatggtcagcatatacttacaaaatatttagaccacaaccgctctagtctaaacacaagtgaatgttttgaagatcatagaagtgaatatgcaggtgaaaaatataagaaagctcccctgccaaattattcaatcaggtatgacttctgccctttcacacatagtgccaatttgctatgctatgtattttatctttgcatcatttctaatactgcaggtataaattctgtaaaggcttttagagaattctaattcattttatgcactttttttttgcatatttgactccatgaaagtgcattatcacaatgtgacgtaatgtgtaagcattgtgcatgtacataaaaatgttgaaacttgctcagtaaatgaagagatgtccgttttgttcatctgtatttgtgaaagataaaatttctcaagatcttggctctttgggtgactctattgcagtttttgtgcaaacggtagtgacccattgcagtttttgatcgatcttgtcagaagattcaggttgtctggtatttcagatgaccgcagttatgaatctgggtgcacctgattaccaaccatagtgatacgtgtttatccattttgctttttaatctatttcttcatgaatacattttctctgttcctattatacccatgcaatggttgttagtatacctgagtatttatgcttgcaaaaatatgttattagtgcctattttattgtgtaaaggggcctatgaactgttccgttgtgtttttatgtttctcaaataaatcttttaaaaatggaaataagtgtcttttagagaactttttacaaattatttttccagaattcaattttttggattttgttcttttgggattgtgatttttggaattttagattttagggattttgatcttttgggatttcaacatttgggattatggcatttgggattgtgtcttttgggattatgtcctaaacccaaattctgtcaccaccgactgtctagtgataacatttaaaatggaaagataaaatgacttgattttttttttccctttatttttaactgcatttaaaaaaatagaggctgggcatggtggctcacacctataatcctagcactttgggaagttgaggctggtggattgcttgaactgaggagtttgagaccatcctggtcaatatggtaaaacatcatttctacagaaaaatacaaaaaaattatctgggtgtggtggggcctgcctgtagtcccagctacttgggaggctgagatgggaggatcacctgatcacctgagcctggggaggttaacgctgcagtgagctctgattgtgacacggcactccaccctgggtgatagagtgacaccctgtctcaaaaaaaaaaaaaaaaaaaaaaaaattaaaaaacaggaaaaaaaatttaaaacacagagaaaccaaaaaaactagaaaccacatgcacatgaaccagaatttcaaaggtataagaggttatggatggggaaatgtatctatgacatgagagagtcttttgggatgatggaactgttctgtatctgactatataatgctggttacaccaatttctatatgttttaatatccatataaatgatactaaaagaaaaattttagtctgtgtgtatgataggttaaaaggtgaaaaattaaaagaatttaaaaatacgaaaaggtatacagcaaaaaagtctccttcccctcttcctttagtcttctagctttctcttctggaagaaaccactgttaccaatttcttatgtattctcctatgtaatcactcttaaacatctgaacatttgggatgaatctggcaaaagagaaaataacttatatttgcttagctattttctgaggatgctagatgactactcttataatatgtctaaatatattattatttttattttgttgaggcagagtctcaatcatcaccccagactggagtgcagtggtgcaatctgggctcactgcaacctctgcctcccaggttcaagtgattctcctgcttcacctcccaagtagctgggattacaggcatgtgccaccactgcacccagctaatttttgtatttgtttgtttgtttgagacagagttttgctcttgttgcccaagctggagtgcagtggtgtgatctcggctcactgcaacctccgcctcctgggttcaagcgattctcctgcctcagcctcccgagtagctgggattacagctgtgtaccagcacgcctcgccaattttttgtatttttagtagaaacggggtttcaccatgttagccgggctggtctcgaactcctgatctcaggtgatctgcccgcctcggcctcccaaagtgctgggattacaggcatgagccaccgctcccggccattaatttttgtattttttagtagagatggggttttgccatgttggccagattggtttcgaactcctgacctcaagtgatctactcgcctcggcctcccaaagtgctgggattacaggcatgagccactgcaccgggccagaatatgtgtaaatatattattaatcatacttagtactaatttattaaattacttcttttacagttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaagctctgtttatattaaatatagtccagtcatcttttcatcttttttgttaacctacttaatgtgacaagtgagaaaaatgactgacacttctttttgtttcctaagggttttgaaaagtttcttcctaggctgtgtgcggtggctcacacctgtaattccagtactttgggaggctgaggcaggcggatcacctgaggtcaggagttcgagaccagcctggccaacatggtgaaaccctgtctccagtaaaaatacaaaaattagctgggcatggtggtgggcgcctgtaataccagctactcgggaggctaaggcaggagaatggcttgaacctgggaggcggaggttgcagtgagctgagatcgtgccattgcactccagcttgggcaacaaaagcgaaactctgtcccaaaaaaaaataaaagtttcttcccattcatgtatttttctaaccccattgatggtcatttaagcctgtgttcatgttttgcccttgtgcttatcagctgttatcttctcattctttcctgtctcctggaaagatgctcttctggtaatgtttggtgccccattgctgtaaaaccaacagtgatctgctagtaaaaactcttgacctccaaatgcccacatgatgtcagttagcctcactagtgagaatgcggtagtagaaagggtttttccccatcctgcttatacctgaacatatagataacaaaatttcaggaatccaaggtttcaaaagggcagtaatcttactgttgttttacagttgccagttatagagtctacaaataactatttcctgctcagcttctgctttgttatgcaggcaataacttaaagatgcttaggtttttctcctgaactggctgactcaaacttgtttcactcttacctcttctcatttgttgagtgctaggttttaaataccatccatatgctgaccacccctaaatgtacatctcttgctttaagatctcttcttacaccagacttatttgctcactgctgactttacatttccatttggatgttcgcaagacatttaaaactcaacccggcccaaaatgaactctttattactctcccaaacctgctcttcccacagttttcaccatcttggctaacagccaatgacccagggctaaaacttaggaaccatttttaacttccctgtttctttcactttctaccatgcatttcatttcttccttcacaatcaagctaggatttgattgcttctcagttcctttattgctgtcaacctggtctcagccaccatctgtctcatgaaatcctgaagtaacctcctgtggctacctttactgttgacagttaattcttcacattgctgccatagttttacttttaatatgccagatcacatgactgcttaaaacgtacgatagcttttcatcttccttggagtaaaagccaaagccttatcatggcttgtaaaattctgtgtcttctggcctgcagttaacacctttgactctacatcctatttctctctaatattcctcgaacatgccaagcaggcttctacttggggacctttgcagttgctattccctctcccagtttcgctttcctcctagataattacataatttgttcccattcttcttttaggctcagctcaaatgttactttattagaggctttcctttagcactctgtatacaaagattccccttcatttgctttatttttcttcatagcatgttccaccacctgagatattgcttatttatttagtgtctgtttcctggttcctggaacatgaactccatgagagcagagaatttttgtttcctgcagtttttctagctcctagcctagtacctggtatactataggtgcttagtaaatatttattgaatgaatgaatatatgtgttttaatatttgtagacaatgttttctctcaccaggtaccaggtcatcagtacaccatctgatattttcatggtgatggaatatgtctcaggaggagagctatttgattatatctgtaagaatggaagggtaagctgttctgctttaattctgtatgtattttgtaactcccctttatcctttactagcatcaaaatgtcagcaaccaattttaagaggtctatttaataaccagttcccttagtcatatatttgtttagaatcataaactatgtagaactagaaaggatcttaaagattatctccttagcctgtttatacagatgtggatactgagcctcgcggcttatatgattgctcacagtaacgtgatttattaatgacggaattggcttgagcccccagaactcataatcctcagacttatgcttccagggtatacaaatactttgaatatgtatcttaatgtaattaatcgttacaaaatatattattattacttaaagatctaggccttgctagtcaattctagccacatttaaattgcattcattttttggtttcagaaatctgatgtacctggagtagtaaaaacaggctccacgaaggaggtaggaattagatataaagaatttacagctggaaggaactttgtaggacattttgaacactaccttaagttacagatacaaaaactcaacactgccctctgcccatactttttctcatacccaggttatgtggtatgcaaaagcccctttgtgggagagctgtagctagccctgaaaagagagcttttctctcaattttaagttatttacattactcattcatttgttctatatagcatgtctatttacttttatcaaaatcaaacttattaaccaagttaattttgattttactatttcttaacatgattcatttctatttcaggtactcccctttactcctgcttctccttaccaaaaaaaaaaaaaaaaaaaaaattctgcctggagaaatgggaaacaggcacaattgatatatatttttcttatcttttctgttgttgtttatttcttggttttaccttgtgggtatttcttcagttttaccagttgaatattaaaatttcagcacccgtattttctatttcaaaagtttcttattttctgaaattttcatttttttagtctgctgttatttgcctcacagatataataacctagtctgaggatggcattttaaaaaaagtcttcctctgttccgtcttgttctgtaccttctgtgctctctgcattcattttattcatttttgtctttgatgcatggcccttcttcagatatttggtgattcttggctgtccactaaatatttaagaatagggtattaaatgccaggctcatgtgggtaggacttactgattgctgggttttctcatagcttgaataggtagggacttgtctgttttattactgtataccaaatgctaataataacaaatatgttttcttggatcagatatttgctccagaagaaaccttcccatttccttaaaggccttagcttagctgccagtgctccaggagctgagtggagaaaagagatgcaagtctcactagttagtatgttgactttgtcttagcccccatgttttccttaggatgccttatccctgccttggtgtccttgagagcagagctggttcagccttactagagtaaattataggtcttattccccaatatgggtgagtttaaaagcttcttacttcaagcacttgtcctgttttcagctcatctctcacttctaccttgagcagttccctgtgtttccaatttctaaggcttcccaggctttgtatgcagatgtttattttttactggtttctacccctataggcttaggttttagctttctcttgtaggcttagtctttattactgtttatctattgtcatccttggtgactcctcttgattactgctgtctcttttgttctttttgtctttatatgcctgttttattgctgatgtcattttagtgatgtttcaagagttggagacaaaagatttaatctgttacatttaattggaaatgtattttgacttttctaaccttcctttatagacatccctttctccatcctttgtaattgtacttgttactaatacagtataattttcatttttgtagcctgtctattttactttttatattttgtttaatcaagttttctcctattttttcatatttgaacagatactcttttttttccccatgaacctacaaatctagaaataaaagtattagaatgctaaaggattagtatttttctagaggaatggtatcttataatagtttcttgtttcaaaataaattactgatttgtattttctcccatattatccatgccctttaaggtgtaagtctggttttagaatgctaatttgtgacctgtgttagagaattgcatattggagtccttcgcctagaggattaatagcttatttattaaatatgacttcttgggagcaggcatgtccaagtaatggctgtcacttatgttgaaaaaagtggtaataatatatggatacatagagaagtttaaaaaaaatacttcaggctgcatgcagtggcacatgtctgtaatctcagcactttgggatgctgaagcggtagattgcctgagctcaggagttcgagaccagcctgggcaacatggcaaagtcctgtctctatcagaaatacaaaaattagtgggcgtggtggcatgtgcctgtggtcccaactacttaggaggctggggtgggaggattgcgggaccccagggaagccgaggctgcagtgagccgtgatggcatcactgcactccagcctggatgacagaacgagactggatctcaaaatatagataaatttaaaaccccgcccccccaaaaaaacacaaaaaacaaaaatgaaaaggtagttgctatgtaagattttttttttagcaagcatattaaagataaaatgctatgatattttattaaatgaattaaggtgtttgttgttaaaatgtcttctattttaggacatatagcaacatagttgcttgctggtttatgaatagtgcttaaatattacttcctcatggtctaaaatagtgtccctcaccccactatcactcactgcacctatattttgctttatttttcttcaaaacagtatcactccttctgactatatttattagtctattttcatcaactagattagcctttgttttattcattgctgtgtaatgagtgtctaaagcaatgtgtagcacgttgaaggtattcagtaatttgttaaaagaatgaaagagtaaacatttgccgcttataaaaggaaatatgccaaatttcaagtagatattgaaattatttgaaataactcatgagatatagaggaaggcaagctgttacaatgtagtcatatgcaaatgataatattagaaacttgagttactgatttgggttccaagaccatcttagcatttctgttttgtgctgcaggtatctcctcctcatgtcaaaagtatctcataagtgaagttcattgggaagattttcatgtattttgacaattttataggttggagaattatagataggacaatttactttgaaagacacacctttaaaaagcctctctaacttttcttagctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtaaggataattttatagtttcttaacgttcatttctaatgttcttatagtttcaatgaacctacctagaattcttcagataactgtaaaagattacataaagtaatagactgagtatatcaaagtattctgttttgtctatgaagatacaaaaagaagaaaagctaagaaatcatcttttcttagctttaaatgtctttattactattattttatagaggcagggtttcgctttgtcgcccaggctggagggcagcgacgtgatcatagctcactgcatccccaaactactgggccaggtgaccctcctgcctcagcctcctgagtagctgggactgcaggcgtgcactaccatgccaggctgttttgtctttttgtagagacaagttctcactatgttgtccaggctgctcttgaactcctggcctcaagtgatcttcctaccacagcttcccaaagtattgggattacaggtgtgcaccactgcacctggctctttaaatatctttaaaattaaattttaaacaacttaagttggtagtattagagagactatttgaaaagagtattatttgtgaaagagaaggtagcagctttatttccagtatgttcaaaagaatcaagtatggagaagaaggaaagtgagtgggatggaattatttaaaaccttaaaaaccagaagtgaactatgtgaatttaattatttaaaattatttaaaacaattttttaattaaaaaaatttatttaaaaatttaaaaatgttttaaatgatagtaaattataatttgtttaaagaacattttgattgttaaaaatgaatttattttggctgggcgtggtggcttatacctgtaatcccagcattttgggaggccgaggcgggcggatcacctgaggtcaggagttcgagcccagcctggccaacatggtgaaaacccatctctactaaaaatacaaaattagctgggcatggtggtgcgtgcctatagtccccactaccctggaggctgaggcaggagaattgctggaacccaggaggtggaggttgtagtgagttgagatcgcctgtccggcctgggcgacggagtgagacacggtctcaaaaaaaaaaaaaaaaaaaaagaatttattttttctgtatttcctatataaattgccattgaccttactaaacctaagagaaaaaggaatctcttcttttctttaggttggttttagttcaaatcagataacttttttttgtttgttttttgttttgagacagagtttcactctgtcacccaggctggagtggtacgatctcggctcactgcaacctctgccttccaggctcaagtaattctcccaccttggcctcccaagtagctgggaccacagatgtgggccaccacatgcagctatgttttttttaatttttggtggagatggggaatcactatgttggccaggccggactcgaactcctgagctgaagtgatccgcctgtcttggcctcccaaagtgctgggattacaggcgtgagccaccatgtctggcccagagaacattcttataaaaattttcctcagttttgactacatctatgtatctatatctataactatatctatttaaatgttcagagattaactggaaaatgccaaccaaacctgagctggttgttttggtgttttgtttttttttaaaatagtaattggctaaattatttgaatttcttattcctcagttgattatttttatagggtgcatttttgagggagcaacagtttctttttggagtaaaactgtgagggaactttgaaattcaaaattactgtttttttttttttttttttttttaaagaatcagaacaggcttaataggaactttgaattttaatccttctattcatctgttatagattattttccctagtgatttctgtattaataaaacttaaacatggcaagttttttctaataagcaaaataaccaacagcttaatatatttgtattaaactctaacagtgcactaactttaaatgttgaaatagattacacattttagggcataatggcagaatatttggctacaatagaccataggattttgttgaagcaaataacaaaatgatgatttatcattttaatgcaaactcaattttattgtttaatgggattttaatttttgtctttgggaaatcttttgagtagctgattttgtgcactttcaggtctttcaaacatgatgtcagatggtgaatttttaagaacaagttgtggctcacccaactatgctgcaccagaagtaatttcaggaaggtagtatttgataccctgcctccctcaatacatttgaaattgtctttttctcctagattttgttagtctatagtgtcatatttaattctaatgaaaggaaagaaagataaggcttattcttaaccacatttatatgtgaatgagggttaaggactacaagtcaacattatattaaagttgttagaagagagtacattaatttttttcccaggtggaagaaatggaaagtttaaaactagggtgtttaaaaagtaggtaagacactggaaacttgaataatacagaaatatctagtagttagaaaaggattactatttacttagaggaaaaattaaacatgtaatgtgtagctttaattttttacatagatggcattttgtagtacctttatgtttcatgataaaatgtcttggggaactgggctgaagtaatctttagacttcatttatgttgaatctttgttctttaaaccttttagagactgcaatattataagaattttaacctctcaatttactaactaccagcattgagaacatgaagatatttgtacagtgtcgctttttgaatagtttggaaaacaggagaatttaatatttttaagaataactctttgtccttcactatactactgaaattgaaaacagaagctgaagtttgctagatttataatgaacttttaataacttttcacccaaaccatgcttatttgtgtgaatgttttgcatcttgattaactcaatgcagaaatactgtagtattttctatttttataagcttgttggcctagactgctcaaagaaatgagatttgtgtaaaaatatggctgtgagtaaggcaggagtacctaattttagatttgtcaagtttcatcttttttttaaatattaacttaatgtcaaaaattatttaaaaaatttttaaaaaaatggtgttgtctatcttaattcttttaggaataaaacaattcaggacatggagactgtggaaagttgttatttaaataaataaaaagaaatgttataactgtgcatatatgcaatgggctattactgaaatttaatttttctagtttggataaagtctttcttcaagctcttggtgtatgagaacttttactttcaaaataatatttatcgatcagttcagcagtacataaatttaaagaaatccttttcctgaatccaggctttgaatgggtgatctaactagtctgcagctagttaaggcacttgactacaatgcactgcaaacgggatttaaaaactctgtgaaccaatttgcctggctttctttcacagcctcaggatcctttcaccttggtgtaaggggtcttgtgttattgggattgtgggctcagagtccattactaaagaacattctcagttgatgaaatatcacttaatctctcctctgtaacaaaaaccaatggttttaaattgaatagtgatatgtttgttcaagatttggccctattgtcagatcccatcagggccatagtaaatagtagaacagaattttagccatggtgtgtaatttacaaacttcttgacttttgttttcaaagataatactgatggaattaacgttgtaacatgtagtagtggctataaaaaccatattctgcttaagaattctttatgaaatatccatatttgaagtttttgatgaactgaatcttaggttaaaatgattctttaatccaattgttatttcctgttacagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcaggtaataaagcagtttggaagttatcagatctgatagtatccatgataaaagttatgtgaaaaaaaaaaagttgcagaacagaatatacagtgtaatcctgtttttatgtgaaaaaaatagagtgtatagacacatttattttattttgttattagaaatacatagtaaactggttaccttagggaagtaagattcgtaagagggagggctttcactttttacttacacatctttgttttgaaatttttacagtgaacatcatattactttttaaattaacaaaaaagctaatgaaagattggtgctgtggctcacacctgtaattccagcactttgggaagctgaggaaagaggatcatgtgagctcaggagtttgagaccagcctgggtaacatagcgaggccccatatatatgtatatcttttatttttatttatttattttttttgagacaaggttttgctctgtcacccagcctggagtgcagtggtgtgatcatagctcactgtagccagtaactcctgggtcaagtgatcctcccactttagcctccctagtagttgagactacaggcatccaccatcatgcctggctgttttttgttgttattgttttgctttttgtttttgtttgtagtgacaggtcttgctatttttgcccaggctggtcttgaactcctggcctcaagtgatccttgtgcctttccctcccagtgttgggattacaggtgtgagccagtatgcctggcgttaggattaatacttttcagtagtaaatttgtgggtggctattttatttcttatctcatgaattattgtattttttttctttttttaatcccaaggaatgagatttaattgacatgtttttcctggtagtatacattgaattacatgcaaaattcctgttttgtaggtaaaagtcagtataaccagtttcatctggttcaacctaatagtttaaattagacaaaaatgacgatgacaaattttcttctcaaattagagtgagccatttctgatgaagacttaaacaattttattgcaagccttgtttcttttttttcccccctgtggaaattttggtccttttggtcttctaatggctagactgcacatttatctgagaaggaagaaagaaatcagatatggatctaggaatagtaaatatgaaagcattagtataatgaagaagaaggaaagattatatgtggaacttgaagcttgattactttccacttactacacgttttagactagctaaaaaagagaccatgaatggcacggcatgattttatcaccaaagggaaaggacaaatcattctctaaaatttatattttaagatatctaggtaagaaatgtttttgtttgtattttacctattttcttccaattaaaatataatacatgacaattgaaaaaacttagaaaaacaccaacaatagagaagagaataaaaaattatctttaatcccatgacccagaagataaccattgttcttttcttgttttttttttcgtctctggattttatttagttttagcaaagtgacatagttcaggtcaaacatattcttaaatatacgaagttagggaattagaataggaaatcattcagggcatggcctttccagtcacacagaactgggtcataatcctggttctgtcacttactgtctttgtgaccttgagcatgttccttgattttttttttaacctcaattccttcatttaaaacaaagagatattatcttcatataattgtttcgatgatgaggggagatagtgtatatgaagtgtttagcataaaacttagcatatagtaagtactcagtagttgtctactatttttcttgttgttacattatcttcacttaacattatatcaaaagagtattataatgaagctacctaatatgttctctttctaagctggaaataagctgttcttttcattgtttgtcgctgtcatttgtcccataacttttttccccccattgctgtgtcaatacattctccctcttaaaactggagggaaattggagcatttccctcaacatacacaatgaagtgcgagctagaagaggaaaatttcagtgcaaaaagtgacaataatacagtatgaatataaatataaattaagtcatattctaaattccctaaactgttactttcagtctcagctctattcaaagtccttctcctgatcctgccatttttctctcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggtaagaaagaaataacattttgattattagcatatttggcaaacccatagtctataaaatgttttatagaagaattacttttgacttggtttttgttataccatgtgctaggttgtaaacccatattatttgcgtgtacgaaggaagaatcctgtgacaagcacttactccaaaatgagtctacagttataccaagtggatagtagaacttatctactggatttccgtagtattgatggtatgtacatcacacaaaacaacatagattagaccttgttactaacttggtattttacgccttgattcttttgaggcttcttgacttgttcctagtaattcaactgcaaaggaataaaaaatgtgatttcttgtgcctttgcaatattaacatttatgaatcttatttttcttgtaatcttatagcatattgtccttttaagattatcatcttgtaaaatccttaaagccaggtgtagtctgatcctaaggtgatagttttctgctgcatttgtttttttggtgtagttcattttgataagagacaatgttttatttagaaataaatattgactcttctgtaagcttttatttattattaaataagttttcagttaagaatgaagttatggcaattcttcattggccaattcaattgcattaagctacgctgttgagtgcaggtgtggtggcttatgcctgtaaacagcccagcactttgggaggctgaggtgggaggatggcttgagcccaggaatttgagaccagccttagcaacatactgagactctgtctttacaaaatattaaaatatatatatatagtatcacctttgcttatggaaggttgcatagaattattagatgaggttcacgtttgaatttttttcttctttataaactcaaagatagtacacacatagtagcagaaagacacaggtttgagccatgatatgttggccaaaccagtttgtctggttatctttaggtccatatagtacgtatctgctaacatatactaatgcagtctgaaatacggaatgagttttatttttcttgtatttggatcaaatttgcaaccttagatttactagtactggggtataccaattgaatgcccattttgtttttgtactgtgttcccaaccttagtttttcttcgatttttattcattggaattgttgctcttttatgaaatactaaatgaaatatgaagggaaagtggaaagtaaaaagcactgagctgagacttaggagagttgggttctagacttacctttctgttcatttgttaccttgggcaagtcatttctctgggtttgttttcttatcaataaagtgaggggctggatgagatggtttccagtataccctccaaattttaagtgcatcgattctatgattttaatatagagggattactttttattgctatagaataatatttattaatccctagattgttggtttactgggctcttaaccttggattgcaactgatgagtagctatactgtacccaactttggttagctatcttgagaatacatactatatgtaaaaaagatgaatagtttaatacaggctcattgactgttttagaaggtatttagaataagcgtgctcttgatagctggccagcagccccacttaaagaagcaaattcaatactgttacaaaaatttttgggagaaggtcatagactataataaattgaaattctttttacccagatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaactttgcttatttcttttgcagcaataagcatgcataataagtcacagccaaatgcttccatttgtaatcaagttatacataattataaccgagggctggcgttttggaatgcaatttgcacagggattggaacatgatttatagttaaaagcctaatatgcagaaatgaattaagatcattttgttgttcattgtgcagtatgtatatagcataatatacacagtgaattataggtctcaggcttacttgatttttggctattttatatttagtgtacacagggctttgaaatattaatttacataaaggccttcatatattattacgtgttatatattacgtgttataaatttattcaataaatatttgcctagaattcccaagacctttataggtgattttgttttctgggctccttaacttcataaatagctagtatcttccagcagtagtaacagtctggataacttcttccatatccctccctctttgtttttttgagacagtgtcactttgtcacccaggctggagtgcaatggtgtggtctcggctcactgcaacctccacctcccgggttcaagtgattctcccgcctcagcttcctgagtagctggaactacaggcgtgtgccaccacacccggctaatttttcgtatttttagtgtagacggggtttcactatgttgcccaggctggtctcgaactcctgaccgcgtgatccaccacctcagcttcccaaagtggtgggattacaggcgtgagccaccgcacccggcctccatatcccccttttaaaattctgtagtgtatggtaagtcatatcagatatcagacctaatttaaatttcattttagctttacaagtccaaaaacacagaatttatatattcagatactctagcactaattttagtcttaaaatattcccacgatattctgtacacaaaatgttctttttgttacaagagctgagttgcatatactgtagataaatcatattatttttgccaatttcacaaattcctctggcccatcatgtcagtcattattgagtatatgcacacattgctacttatttgattatgtatcttttaaattgattcagtgcatagaaaactatctcttacaaactttaagtgctctgatatgacttcccccccaaattttattatgaacatttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgtatttactttttatgtggccctctctttaggggattctaattttacttagggtctctaagtgcagcataatgttcctgatgttaacagaagactgtatttttaaagttacaaatttgtatatggaattaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggcaatgcaaatgatttttaatctttttttattatcttttcagcagtttatattttttgtgactttatgcaaccatatttttactttgtcttgacaactgaaagatgtataaggttttttgccagaaatgtactgtatacatagttttaagtataacagattttactgatatgtaaaaattttgccattaaaataaatgatttctcactgagaggaacttttctaccaggttggggcatatgggagcttaatatatcatatctaatttaaaataatttcactgaaataaactccattgcttttacctaatttttttcttgagatgcttttgtagtttttcagagttttagatgattttatacaaaatcctctgcctagcactgctctttttgatgttgtagtgacaccatttacattgaattaatgcttggtagcctggggctagatgtggaactccatggatctgtgttctgactggcacctttggaatgaaagaaaagtgtgtgctgtccaaattttttccccttaattctttccctcatcttctcacccataatagaaattttatttccattgtgagttctgacaagaatgaaattccacatacaacataactgtaaattgttggtaggtagaagttaatatttgtggttcatgtatattttgaccagagtatatttaagtatataatttcagcttccttgatttagaaatatgatataataaagaaaaactccatttatcatctgtta

SEQ ID NO: 546 - DNA, 68579 bp, Homo sapiens
ggggatttggggctgggtcggccggggtcggggaggggggtggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcctggcgcgcaggagcggagacctggacgccctggacaagcagcacaggtagcgggggctcagccgggggtgggagggggcccccaggcccggcttccccgcagaccctgggacggggccgtgcagggcgccgggcaccctcggagcggcggagccaaacggactctcatctgttttccatccctcataattccctggctggagcagttggagaatttgagtgatttaactcacaaagttaagcatatacagcgttgttatttttaacgtacacgtttaaaacatggtttatatacattataggaggtgcctaatgagagtacttgttcccctatcaaaaataaccgtgagttgtttcagtgggcgaaaagttctcagataagagagcttacttgaaaaatatttactatattatatatatatattttttcagatgaaaagtatgttttcattttatagggaattcattatattctttttttttttttttgagtcggagtctcgcttctttgcccaggctggtgtccaatggcacaatcttggctcactgcaacctctgcctgccgggttcaagcaattttcctacctcagcctcccaagtagctgggattgcaggcaggtgccagcatgcctggctaatttttgtatatttagtttcaccacgttggccaggctggtctcgaactcctgacctcaagtcatctgcccgcctccgcctcccaaagcgctaggattacaggtgtgagccaccgcgcctggcctatgttgtttattatatatcataagatatatatatattactgatatgtatacatatataacacatataatatgttatatatatcagttatatatacacattagatgaaaagtacctcttcattttacaggaaattctttcaaatcaaatcatcaaacactctaaaagtgggcaaagtacctttttccagatctacaagttacttatatacataggaaaaaatccttcgcatttctggtataagaatttaaactaaaagaggaatgaaacagttttctatccacaatatttgtgaggatgttttatactgctgcttgaagttgctgattacttttcaaagtactcatttgaaaatggtaagtactacatttaaaaaatgtgtatgccctttacccaccaattccattatactaaaatacccttaggaaataaagatacatgcactttatttttcacagtacttactttaaagagaacccatagaatggatcctataaataaatttcagttgcatccataggatggaataatatgtgaccactgaaggtggcagtagatacagaagtacgttgatgtgcaaagatgtattttgttatagctagcaaggagaaaaaattagttaaattatacatacacaaacatactatggtcttgttttagcaaaaatatgtacaaaatataaaatttgtaatttctgagcatttgtattttaagtaaagtttttttcctttttcttatctgtgattgctgcagtgagtacaaaacttctagtaaaagtttattattaatggactaatccttgggaagagaggaatatgaatcttgcgctgatgaaaataatttctcactttctattttttatcattattgtgtgtgttgttatcttctttgagcttttagcctcttcagaagtaaaaaaggaatgtttttatctgtttccagattttattatctatatattttattatgtacatatgttttgcttatatactcattccatttatgcaaacataatcatttcattttaattgtgttctttaaaaataaaacaacacatataaataattactattgcaaaaatattgctttataggagtttatttaaaaataatgaactccccaactgtatttatccattctttcattccatttatggatcaagcataacctgagtacctgctatgtagcagacatattctatcatctctcaggacccgtccatccttaaacacttcatgtttacctgccccgcctgcacaagctgagagatttaaaataggaatattgggacttaatctccttgaaactttatctcccacctttcaaacaaaagcatttctgaagttagaaaatagtagaagataacctttaactgctctttcgaaagtttatcagtcttaaatactaatattaatcattggaaagtcgtatttgcatatattttctaagtataaatattgaatacaatgagccatatgtattcatttgaatcatgagtttcctttggtttcaagttgtttgaaaatcaaagaattaatttgtttaaaaaatgcattattgttatttcagtgctctttccccatagtacctttaagaactaaaatgtatttaagtttcagttacatgcctagaactgccctagacctgctgagtataccatattctacttaatgtaaggtctcatggattgcgtgatgccccgatattttatatatcaataagataatttttaaaatgctaccaattatagttataacaaatcatgaattataagtggcattccaatgtcagaggtgttaaaatgtgacctactcgttaagtcatcttgcaaagtaggtataattgtatcattctacctaattaaaatggttttgttaagtagtagtaatagtaataattataatatctggctgggtgcagtggctcacacctgtaatcccagaactttgggaggctggggtgagaggattgcttgatgccaggagtttgagaccagcctgggcaacaaagtgagattcttactctacaaaaatttttaaataaatagctgggcatgctggtgctcatctgtagtcccagctactcaggaggctggggatggaggatcatttgacccaggagttccaggtatagttacaccattgcactccagcctgggcaaaagagtgagactttgtctcaaaaaacaaaaatcttacaattattgagttgtcgtaggaactgttctacatactttacatagcttctcatttaagcatcacgatggtgtcctatgagatagctactattgtcatctttattaatgaggaagttgaggtacagaaaggctaagcaatagttggtaagtgtcaaggcttaaagtaggactcaagccctagttgaaccgaatccaaagactgagctctttctactcaaataggctgctgttttcattaaggcagtgagcaataagagctagtaagtattgtactttcttcaaaaaatttatttgttttgaaggcagaggaaaaacatgctattcagtttttacattacatgaatgattgtatgttttgagatattgtactacagtttcttaaaaaatcctcttactctcatagaactgctctacacttggcctgtgccagtggccatgtgcaagtggtcactctcctggttaacagaaaatgccagattgatgtctgtgacaaagaaaacagaacgcctttgatacaggtatattagagccaactcttttagcatgacatggatttgatttacatatatagaattaaaataaattgatctcatttacatataactagttggtgaaacctgtggaatgtgtattttgaattcttggaatttacaatctgtttcttggtctaacacggacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggtataggtcaatcaactttctttccaaaatatttgttttaacattgacataggtaagggtcaattttttatatttggaagctcaaccattccctgaatgcaaatacaaattaagttattttgaaataacttaattgtctaagattttattttaaatattgatatttttaaagaagcattaaagggcacagctttataaaatgcactttggaaaatatttgtgaatttgttaaaggtaaaaccttttcaactttttttctacacaggcttattcttttttttttttttttcttaattagtgtaaaacaacacaggaaagaaaatattccccggaattaggctttatcttaaaactcaaacaaaactaaagcaacttacaataaagggacatgttgctgttgctgctaattttctgaaaaactgatgtatcatctttcagtggcaaggcttaagagggaaaaatgggaggggagaaagagagcaatcagaaatatgcaggtcacttggatattagataatgagggaaaatgccaggaagaggtttttttttgtttttaagtttgttttatgtgttgagacaaggtgctgtttagctttgggtctaataatttttggtttgaaaaagaatgaattgcaacttgcctagagatgaattttaggaggactctgaggaaaccagattggcagtgaatatgtggtgacgaagtgagaaacacttcagcagaaggtggaacaaattattaactgacttattgctcatcctggcagaaacagccacttagataagaacctaaagcctcctctcaaatctagaatgtcttagtgggaaggtgggagataaggagcttgtaaatagcaaaatcaagtgggattttgagtttacttgtccctgttctacccgtagccaggaaacttaactggagttttaataaatgacactatctcttactcttttctctttttggccacatctccaactgataaaggaattagccatgtgggtgagaggtgagactgaagtgattgtctgctgcactgattctcagaattgtgcattacagtgacctgaggacattttgttaaaaatctacaattgtaggctttcccctgaagattttgatgtaatagacctattaaggcctgaacgtgtttaaaaatgttttcttgaagctgggcacagtggtgtattcctgtagtcccagcttgagcctaagagtttgaatccagcttgagcaacatagtgagactcttgtctctaacaacaataatagccaaaaaaaaaccccacaaaaaaacaaaaaaccttcaaggttgggatacactcttgattaaaaaccccagaatagataagtgcaatatataaatttctgtatctcaaaaatgtaagaaatctctagaagagttggcatttgatagttgccacttccttcaaagttctccttttcaattatattagcctgacttatctgtctttctctacatctgtgactgggaagtgaaaggtaatatcattggcaatatctctcagcttacagaataacatgttttgcttcccaccatgaatcattcactaccattcagagagtcttcagaaatttgcttatgagtaatctttcaataggtagaggctgaccctttcatgatttcatgtccctttgtcaccacgcaggtgattatgtgtcaacaaatgttcattacaagtttggctttctcaattagaatagtagcaaatcctaaactattttttttagttgaagttttgttatgaactatctcagtatgtttgttaagtttatagaactttagcatacccaaaatgtcagttttaaacactgaaatccatgaagttaataagaatatagataggaattcttttaataatttagttttagcagtcttgtgaaccaattatctatttggttaacaatctgggaaaattatatacaaacatattttaaatgaatacatgttggaaaaattcttgaagcaggtattgtgagtctttttagcaatttttattatatatgagagcctgattttttggtagaacatatgataccagagaaagaaaatattttacatgaaaatacttggattatacacaaccatttagtaacacattaatagcgaatataaaaaaaacaagggctgtattctaatgtggtacacagatttgtttgtttgcctctataagttgaatcaacatgtaaaatttagaagactcgtgaagaaatgtggacttcaggcatatcctaaaaaatcaaatctggtgtcccctgagtttctatcattctttggtctgctgtgcagaagttgcccctttatagaaggcaggtattctccagtttgctactgtgcccaccttagtacttcccttactcaggcaaccttcctttgtccttgtaagtatctgagtttacaactcctatgttatagtatattttgataaaaatttcaaggtttttaagtcagcatgtatttgtttataatatatagtctatagagtatataaatccctcagttatggagttgaattttagagtttagaagtttttaactcttttctttatatataccacaaataattctctgcccataagaatgcctagaagcctttttaggttattcctggttatagttggataatttatgaatattgcagacagtacatccttctcctcagtgctcttccttaaggatgcaagtgacttattggcttgtattatgccagaaataatccatgtggatcagtatgagaacttctattgataagccattatgtttttatttctgatttatattttgtctaaaataaaaaataattttaagtagccatttaagtggaagccagtaaaaatggatttaaaaagtagagctgcactagggtcccgggattaccattataattgagaatagtatttcttactgagttttggtttttaaaatatttgttcttaagttttttaaacctatctctcttacacagaatatactgagctttctaacagtaaagataaaaatctcttctcttgtattaggggaaaaacccatggactatttaataataaggaaaataaatgcatttgaagccaatctctcttaattcaaagctcatttccatggtgacccatttggagcaggagtgcctgacattggcatctgggatcctgacaccattgataaaagtgaatcaagcaagtttgtaccacccagagggaactgccacctgtattgggaagctctggcaactgtatctctgaaactcttaattcctcaaatgttaatgtttgccacaaatagtattgtgaaaggggattaggtgaaattaaagagatttcttgattattggacataaaatacagttttgtaatacttctcaaatacagatggtcatggagtctttctcttgcggtataatacttctgataaagcaaatattctttggaatatagtttaagagacactgctttagagatagtaatttagatcattaattaatgtaaaaaacttaaaatatttgctactgtgtcttagggttttaggcccttgcctcaagaagctcttggtttcagtgggaaacaatgaaatgactacaatgtaccatgataagtgctgtgatcaaagcaaggattcttgggactagtaaatgtttaaagtgagttttggcaatgaccacagttaatccagggagacagaggagggttgtttgcaaggcaaagcacagcacatcagaaagcacagaggagtgagaatgaagggactgcttttcatttacttcctttctatattgtatgttgaagttcaaagcatcctggagaagattttcagttcagttgagaaatatgtaattttgtgaattattaattttttctgctgttttataggacaataataccccacttttatttgctataatttgcaagaaagagaaaatggtggaatttttattgaaaaggaaagcaagttcacatgccgttgataggctgagacggtacagtagttctttttttaaaaataaaacctgagtattctagagtggtcactcaagtcagaaatattaataagaagattaacataattattggcatataatgaaaaatatcaccatgaataatcaggtagacaagcaaatatttggactgagtaacataaagaatagtatatagtaggattcatcttctcttataatatacagagtttggtatttataatcagatgtttttcgtactgtaatcttttattagctaaagggttttgtattagttttattaattttttttttttttgagatggagtcttgctctgttgccaggctggagtgcagtggtgtgatctcagctcactgcattctccacctcccaggttcaagcgattctcctgcctcgacctcccaagtagctgggactacaggtgcacgccaccatgcccagctaatttttgtatttttagtagagatgggatttcaccatgttggccaggatggtcttgatctcttgacctcgtgatctgctctccttggcttcccaaagtgctgggattacaggcatgagacactgcacctgacaagttttattcattttcaaagtgtggacttttagtttatgactactagcattgtcattattattattgttgttgttgttgttttcagcctgcagataactcttatctgacccctagctgatttgactaggaaagcaatggggaaatcttcatctaaatctttgcctactttagataagtgacctcagcacagtttcttggccatcaaaggactataagttagcaacttgtattatgtcttaccccagtgggacaagaggcttccctgttgtccctttcttttagccttggtgacaatttacaaagatgaacacttgagcaccctagatgcttatagacccaagctagtacatgcaaatagttattacatctatactgacaggcggatattaaactggtaaagtgtatcaaactagctttttaaaaaagtctttattaaagttcttgagtggagttatttctttgttgttttaggtcagctctcatgcttgctgtatactatgactcaccaggtattgtcaatatccttcttaagcaaaatattgatgtcttcgctcaagacatgtgtggacgagatgcagaagattatgctatttctcatcatttgacaaagtaagtgtttatgttaaaaggccagttaatgctaaattgaagtttaaaataattgcaactactccatcttatgcattaggtgagagttcatagtttggttcagatagtttgaaatagcgaagagttagtctaccttttagccagaaatcaagcagaagtctagattagttagaagtagagtgcgagattttttctggatttttgagacatttatccctagggatctcaatgttattcattttattctaagtataatccccatgcatgggataaaaagagccatgtctttgatttcttttcctttcctttccttttttttttttttttttttttttgtagagacaaggtctcactctgttgccctggctggtcttgaacttttgaggtcaagtaatccccctgcctcggcctctgaaagtgctagccaccatgcctggcctgacttttctaattagttattgagtcttgtaatgtccagtttaacagaaaatcatgtattgtcccctggggctctctcctgtgtcttccttctttgaattttccaagaagctaaggggtttcctaagtccaaggaaggcaatctttctttacaagtcagaagaaggggaaaaaaggccattctaatcattctgttgtttccatggactcacttgctgtattattgccattataactggtcctgcaatctgataatgattgacctttgccaccaggatgccttcactgattcagacccctcagttttcatggtgattcatatatagaggtcaaagctacggtgtttattagtttatgtacttgtgctcagtcattgttcccagcaccctgctctggcagctaggcctcctagctttatccacacaaatattgagcaagttgatgctcaccctacactaaaaaccttatttggagcccacgtcttagctagactttgcctaggccttcgtggtatgttatcctttgagagccatgtttgtctttcctttaaccaatattagttgggattgttctcaatagtcagggatgttcaaataatgttgcaggaagagatcagagttccctgtctcttttgctatcagatctgtaccttgaggcttttttatatcctgtgcagcagctttggttagatagcggaatgttccatgttatctttccactgagtagtgggaaccagcttgcagttggcccctcaagtaatgtgtctctataatcatgaaaatctcctgggctacttgcagctcttcctcaagttttcaatatattttaaaattctacctcacaggaagccattcaataaaattctctgaatctgaagtaagtgagttggatttaatagagctaagcctcatccatgactcatgaatatccatgtatcaaacagggctttgtacttatttcaacagcacatattttaaaattggatcaatacagagcagataagcatggctactgcctagggatggcacacaaattcagaaaacattccatattttgcctagtcccaggtaggccatttgactatttgttgagtagctccaaggaagcagtgtgagcaaaaccaaaacaggtgacacgcaatattgaaattgtgattatcgctatgaaactattgatgtatggtgatctctgaaatgggaacagagctgagtaataaggggatgttacatgttgttagtacatgtcttggaaatgagaaaatgtcaacttgtatttccttcatggaactgaaaaacaatcaaagcagggttttgtcttgtctgttagttggagaggaccatggagatccagcagccaagcacagatctgctggctcagagtttgaggaggtagagaaggagtggtagttgtccaagccaggttttgacacctattagttttctgcccttggtgtgattgatgagctcagtgatgagctcactaaatttatatatatagaaatttagtaataagttatgaattaggtaaaatgccctgaattacaagccacaatgaatacaagtaataaccaaaattagcacttaataacattttctgaaaactgcaacatttgagtattagaacttacagaaaaacacacaccgagcattatttgggattccaaaatggtttcagcaataaagttcaagaataaattattccattgctttactatttctctgaacatataaacatgtaatctcattacatcttccaaacaacctagtgaagtaaggtagcagaatccttgttttttagaagaaaccatggagcctaagagaagcaacttgtctgaagacaaaatacctacagagcgaggtattttggttacagagcaaggacttactctgagtgcaggacactttgcatgatatccagctaactagagttcatttactgagctgtgcttcctccatttatgagtacttcactttcttttcttctttaattataagcttaataagcttgtaaggtttacaaatttgaagtgtatgggacattaaaattctgatattaggtctgatattgcttgaaagtgttttggaatttaatatgtttggtgaatattttttatttcattataaaaatggcaattttatttattacttttgtatacatagaattcaacaacaaattttggaacataaaaagaagatacttaaaaaggagaaatcaggtaagacttctgattgtgaatttcttacttgtcttggtggtcctactcttgataagaaaatacaaagtaagatgtaagattaaggtagtttcagtcaaaaaagaccagtttaaaaatatgtgtaaattgaatgtgtatatatgtatatacatatgtaaattaatttttaaaatttaacttctttagtttgaaattcagatttatttaagaaggtagttgtagctaatttacaatctcaaacattattgtctgaaaacattcatttatttaattatgatccctaaaatcctatataatatttttgcataaataagaaaaaagatttttaagttagtatgttgtatgtttcctctatagtcacattataacaaattggacttgttatacaaatggatcttcgatttcatttttataataaattgtttatatttagtaaacaaataactacagttgacccatgaataatgtgggggtgagggactctgatccctgtgcagttgaaaatctgagtataacttttgattccttcaccttagctactaatagcccacaattgactggaagccttcctgataacataaacagttgatgaacacctattttgtttttgctgcattattatatactgtgttcgcacaataaaataagctagagaaatgaagctgttagaaaggaaatcatcaggagaaacatattgacttttcataaagcataagtagtcctgacaaaggtcttcatgatcttcaggttgattaggctgaggaggaagaggagaggtggatcttgctgtctctctgttgcagaggcagaagaaaatctgcatataagtgaatccctgcagttgaaacccttgctgttcaagggtgaactgtattacatattgatttgtgtcactaagaaagtaactatctttagaaccaggaactcagcaatccctttctggtaccataaataaatggcaataagaactgtagaactgaaccagtgtgcacccatacaaataggagattattttttgaagacagctactgagcacaggagacggaaaagcaattcctttgtgagaagcacaagttatattacatattcgtacacaagcaaaatgattttatctgtcatagtttacatacatacacatacacacgtgcacatgtgcacacacctgtgcacacagacacaaagttaaaagtcctgctgattcttaatgaccaaatccaactgttcacagagagcggtggataacgcatcctactgtttggatgcaattcttttgactttttgacttgttttgtgatgaactgcctttaatgggtttaaatcatgttttcagttttatgagaaatgaagaaaaagattagaagcaagtaaacaggaactctatggtcagtagtagactataatagtatattcaatagtcatatgtttttctccagttacacaatttacttgaatgatgcacaattaatcaattattattatcataggagatggggtctctctatgttgcctaggctagaatacagtgtctattcattggtgcaatcatagctcactgtagccttgaactcctgggctcaagcagtcctcctacttcatcctcctgagtagctgggactacagttttgtgtggttacatctggcctgatacacaattatttatttgtttatttatttttaatacagggtctccctctgttgtcagtactggtgtgcagtggtgtcatcttggctcactgcaacttctgcttgctggccttaaatgatcctttcaccttagcctcccaagtagcttggactacaggcatgcactaccacacttggctaattttctttttaagggatttttgtttgtttgtttgtttaatagatgaggtctcactatattgccgaggccggtctggaacttccgggctcaagtgatcctcctgcctcaacctcccaaaatgctcggatttacaagtgtgagccactgcacctggccttcaaaattattataaaaaggaatgaagcccagttgagttgcagaaaattgaccactttttcattttttttctagaaacattcatattgtagaacatattgtcaatcacccagattctctattttttattcagataaaagaggattgctgctcatttcacattattttctgacattattttttcatttattccttctatggctttattcaattggatagatatagaaatacgagaatctccaagtcaaatatcaaggcaaaaaaagaaaagaaaaacagattaggtaaagttattctgtgaaataaccatctgattacagttacacgtatcatatcaacttaatacaaatcttacacaatgaatttgtgtcaaggtttcccaagaccaccccaggtttggtggttcattagaaggactcacaggactcaacaaatagtcatactcagatctttaattgataacaaggaaggggacaagcaaaattagtagaggaaaaaggtgcatgtggtcaattctggaggaaacaaggcacaagcctccaggagttctgtcctgtggagttcccgggatctgcttaattctcccaggctcacattttgacaacatatgtgcagtgatgtctaccagtaccagagtttcattagagactaagtgcccaagtttttctatggaggttactctccctcacatgtacccaaattccagactcttacaaggaaagcagctgtttagagtaaatacactgtttctataagcactttagacacagtgagccactcttctcagggaatggtggaaaccctcccatttccaatttcctaaacaccagccaagggccagccttgcatgcaggcctttctaaggatggcagcctcttgcctgctatatgaaatcttttctgcacaacacttgtaaccccaacttaatttttggtgttgttttaaaatttcattttaataacataatattataagataaggtaacttggtactaatttctgttgtataatccatcttaagttgcagtgcttgttacttttttgacttttggtgatgaacagctatttgtatataagttaccatagcaatgttaggtaattataatctgtcctatttatctcattaacctttcagtaaaattgttaaattaaataagcaaaataatttctgagttaacattagaataaaaattgtcttttattttgattacatgaatagtctagttttcatattgtgctaaatccctgtttagaattatgaaataagataaaatattcaattatttttatcaatattttcttacctaagcatgcaattaaatttatttattttatatattttatatagttcaatttgagaagtaatgaccacatgttgttactttggtcttcaatgatctctaatttttagggtcaccgtgtcttgcttaaatatatcatagtaacaggttcagtgaatatctttattttttattttatttacttatttttttgagacggagttttgctcttgttgcccaggctgcagtacaatgacataatcttggctcattgcaacctccacctcccagtttcaaatgattctcctgcctcagcctcctaggtacctggaactacaggcatgcacaatcatgcctggctaattttttgtatttagtagagatggggtttcaccatgttagtcaggctggtctcgaactcctgacctcaggtgatccacctacctcggcctctcaaagtgctgggattacaggcatgagccactgcccccagccatttatttatttatttatttatttatttatttattgtaattgttctggagatcctgggatgcatagacagtgaatatctttttgttttttgagatggagtctcactctgtctcccaggctgcagtgcagtggtgcgatctcagttaactgcaacctccaccttctaggctcaagcgattctcctgcctcagcctcctgagtagctgaaattacaggtgccagccaccatgcccagctaatttttgtatttttattagagacgaggttttgccatgttggccaggccggtcttgaactcctgacctcaggtgatccacccatctttgcctcccaaagtgctgagatgacaggcatgagccactgagcccagctgaatatctttttttaaatcaataaccttatttcttagagcagttttaggttcacagcaaaattgagaggaaggtacagagatttctcatatatcccatgcctcccacacatgcatagcctcccccattattactattttccaccagagagtggtacatttgttacaactgatgaacttacattgacacattataatcattcaaagttcatagtttacatcaggcttcactcttgatgctgtacgttctgtgaatttggacaagtgtataatgacatgacatgtatctattactgtaatattatcgacagaacagtttcacagccctaaaaattctctgtgctatgcctgttcatctttccctttctccctagtaactcgtggcaaccattgatgtttactctgtcttcatagttttacttttttcagaagagtcacatagttggaataatacagtggatatctttttgaatagttaaaaaattaaagctccatggcagttgaatgtagtcatttaagatgttctttgtccttttgtttttcttttgcttctttatcattgtaaagaatgatatattctgatgacatatgctttacatacttagaaaacatgatttgtatagatatgtgcacataatagaaagggttgaggaaaaggacaccatgctgtaccacacagcacaaactggagcatcttgctctgtgaggtgggtccagatagattctctagcaatggaaggggacaagtgcaaggggttgtactttataaaactggaatcacaaagtctttcatacttaccttcggttggaaataagaccagacagtgaatgctataggtaagtacataggttcctcactgatcctcttcctttgagggatgaggttgacaacagcctgtattatgatgatgtgactcacctacaactagattctgtcatgagggatagcaagagagttttgctttctgtgaggtgaaaaagaatttttttcccctactagggagaagggcaagcactggaacattctggtagtaaaagggcattgatggttttctttctatatatttttcacatcatatagtactgtccagcagcctgccacacctccctggtgtttcttcagcttctctctgaatgtgaggtgtggttcctagcgtataagctcttaaaggagtgatctttccagtggtttttctgtgggaggtaaaatggcaggtgaatttgggccttgctatatgtagggcagagcaaatagctacaactaagtaaaccacccagcaccttccccaaagagtagtagccagagtaatacattgatctcttttgagctcttttccactagcggctggaaagtctttgcaaggattcctgtttctggtcggattcctatgttttgctgacatctggtgttagggtgttttattctaaactgagcagtttgaactgaagagctagagaggctgtgttgtgttataacaaaataagtgcagtagctcccccttaactgtgggagatacattccaagacccccaagtggatgcatgaaaccatgaatagtactgaatcacaaactgtttttccctatacatacatatctatgctaaagtttaatttataaattaaattgaatctgatgttaccagcagataaggtgtgagaattgaattgtgtcatcagcaggaatgattgcttgcttgttggtggggaaaaaccctccacacatttggtcacagaagccttctttgttgatgattgttgctgtggtgtgacagtagagaaaaatgtgtcaagtatgtctttctgcacgtatagtggataaggggtactactgtgtactctgttttaatggcgcctcatattttggtccagaaatcatgctctttgacactggtgactcatcacacctgttctgctaacaataccatttttactcaacctcatagggtttggctaagatgacttgcatactgcagttcacttgtagataccaaattttaataaatttattcttctttgcatctaataaatacaaagggaagagttcttactgcattaattacctaccaatatgtataacgaatgttaattctaataaggtcccaggcatgctctcaaaggaatgctttgtaacaaagcatcagtcttatgctttaaaaaaccaaaccaaaacaaaacaaaaacaacaacaacaaaaaacaggatctaaagcatacatacaagtgtgcacaatttttttatgaaggtagagtcttactatgtttcccaagctggtctcaaacttctgggctcctcaagtgatcctcctgcctcagcctcccaagtagtttggattagagggatgcatcactgtgcattcttatgcttttaatattctgtacatttgttattgatttaaaatgcattttacctttttctttaatagatgttggaagttctgatgaatctgcagtcaggtaggattttatagatttaaaaaattatgttaactaagaaaatatagatggaagaaacgaatatctgttgagtgttgtattctgggctagacatcctaatatgttctatgcgtttatcatctcataaagccatcacaacatctgtgttcctataacctactgtttattaaataaacaactatggattagagctgattaattgcctcatgatcccatagttaacaaagtagctggcctacagtttgaccatcagcctgcctgccttccaaatcctgtctcttgctcctcagcatagattgacagatatctgtgcagcccttggatcaaggtataggtctgaatcagattagtcagattgattaatttgattaatgtctaaattaatgagagtttaaataccttgaactctcatttaagtttatcattagaatgtggttagtccaagagtttgtcctaataaatttgacaatttcagtggtaaccagtatcttatttttaccatcaaaggctctagggcagatcttacttagctttgccataggggtgtaagttttacaaaagcaagtttaggcaagtcttagagacaaattatttgacttcccagtttggttttccatttaggcaagtatttctgcttacttccataatacattttttagtcttgttgctttttccgtgacttttctataatcttgccttcattttttaaaactttcttctctgcttttcttggtatttcttttgttctattattttttcaaactctgctggctatgtattctaagtttttctatagacagaatcaagaggacatagaattacagaattttaaggaatcttggaatgaattaaaataccttctagtatttttacctgtgttgaacattctggtcaaatgattctctagatagagaatgtgaggctcaaagagtttaggatgcttttttttagacataggaattggcagaaatgagatttgaactcatgttaaagcccagtactcttgcttctttttatatcctattggcgtgtgttttaataatacaaacgggagtgagtctgtgggtagaatgagaatggaattagctggggaacccaatggaagtagataagaatggaatgagcaggggaagtccaagtttgaagataaacaacactggattggataggagtacagactcttctataagagatcaaaatattggggtttatgacaagtttgataaagataaattataaaaatgaaggacacaagatgttgggaattatctacgaaggcacattaaaatagaaggttcaagggagctctaaaaagtttgctgcttttttttaaatcaaggactgacaaacttgaagatttttactgaaagatgctaaaacattttgagacactgggaggagcgtctgcagcagatagaaatgtggtgtcatctacttccatcctgacttagaaaggggtggcttagagcccctggagtactaaggggctggagattgctgaactacatagatctgtggcccagtacaggtgtctcctcacctctgcctcttttcccgattcactgatgtccttcccatgtccatgtgggctggttcaggggcatgattggctggcaaatcagtcatggagttcagttgggtagttggtagtgtgtctagctgggggcaggtgatggagactccagttagcttgtttttcaggagcagggatatagagagctcctagtcctggtcatttgaggccatcctttcaggaatctgtgctttcatagactgaagatttaaagattggagacttctgtggagccctgcagaagtggaatctggaagtgggagcccataggaagacagatacttagagagtacttagggaaatagaggtacacctaccaggactctgtttttttctgacagtctctctccttgggtgtctgagtgcctatgaaaagttttaagggcttgctagtttatgtggacctgaataaggtaggacctatagggtgaaaataatgggattttataattgttaatatttcaatctttctgggaaaagtattctcaataagaacatacacctttgttatttgacttctgtacatttagctttcatacatttcaaatattgtaggggctttcctgtactgatttagggcaaaggaaagcaataggaccttcctaagtgggttccatgctgaggaatcaagactgccatattgaagtgatgcagattagtcttttatccagagacagatcatggaaaagagacagtggatctttctaccttgttttaggttgttagttttcttccagtttaggtaacaaaatttatgtcatccattaattgaattttaagttcagcttcaggacagataatttgtgagggcaaatcattgtcaggctctgccaatttattgactgtcactatttgttataaagctcaaggttagttttcattgaatattttatagatttagacaagtggaggcagaaataggtaactaaaatctatttttagaagaggacatattttaattatatcaagaatcactatttaatatatagattgctgacctttccctagattatggtttccttttttgagggggaagctggatataaactggcagttaaaaaaattgtaaagaaatcaacttgctcattttcgttgtgtgtttttgctctcaagcattttccatgaactgcgtgtggattcattgcctgcatcggatgacaaagacttgaatgttgctactaaggtaaagtggtctcttgtaaaattaattttctcactctgaatgtacttttgcatagtatttacttttcaaatttagcagtggtttacctatcattgttttatggtggtaatggaaagttggtcagagaaaaacatacatatggctagttgattcaaaaaatgtgtttaactttggtaactaacaaagattgataagtactgtgacagggtgggagctgaaaaaaaatgaactggaaaattagtagtgacaggaaaatcacattaggaaatgctttctccaatagaggaaatatgaaatttgcttaaggtttatttggataaatactaatactttgacttttaaatcatacgagtgtgactttcttaatatttatgcctgtataaatcttcagtggatcaaattatttgcagtaatcatgggatcctcctggtgatttttagtggcaagaatattcagcacatagcatatagcttttgttcttggaaacttattattttggtatcatattgtttttacgagagattgtttttctacttatattattggttctgtagtgagacaaaaaaaaataaaaattgtagaaaaataactgagtgtggtggtgtacacctgtagtccctgctacttgggaatttgaggcaggaagattgcttgaacccaggagtttgagaacagcctgggcaacatcgtatctgatttaaaaatataaattgtggaaatatagaaatttaaatttatgttctcaaaatgtgtattgcaaaggaatttttgtgtggtttatgagttgtccatgaagagtttatataaggcacttcatctaattgaataacatgtattttgctgcaaataaccagttctagaagcagagactcttaataccaatggatggtaagactttatcctcataattttgtcattgtagtttatttaaaatatttacttcaccaggtgtggagactcacctgtaatcccagcagttttggaggccgaggtcggtagatcacctgaggtcaggagttcaagatcagcctggccaacgtggtgaaaccctgtctctaaaaaaaaccaaaaccaaaacaaaacaaaacaaaacaaaagcagaaaaattaaccaggcgtgatggtgcatgcctgtaaccccagctgctcaggaggccaaggtgggagaatcgcttgaacccgggaggcggaggttgcagtgagccaagatcgcaccattgcactccagcctgggtgacagagcaagactacatcttaaaaaataaaatagccactcaaagtcctcatatcatattctgaaattttgaatttcagaaggttttctatttagttgtttaaataatcattggaagctcctgcataccgtaagctactggaggtcagtaaacatatttgtgtgtatcctggagtacctagaatacagtcttccatgtaagaagcattttagttgttgttttttgagatggggtttcactctgtcccccaggctggagggcactggtgagatcttggctcactccaatctccatttcctgggctcaggtgatcctcacacctcagccatccaagtagtttaaacaatagagctatgtcaccatagacctgtgtcaccatgctcagctgagttttgtagagacagggttttgccttgttgcccaggctggtctttaactgttgggctcaagtgttctgcctgcctcagcctctcaaagtgctgggttacaggcataagacattcagccttaatagttgtttaatctgaataaatagacaaatgaatttttatataatggaatgttataagtaatataataaacctaatgtatctaataattaaatattgtatttaaaatattgcttacattgtattttttaatatttaagggtgtataagttttgatatgttatgttgagaaattatgccataattaaaaaggaaataaaatagaaataggtcatcagtagcaaatagggttacaatatattttctagtatcattcaactggaatcttaacattgagattttagattaacatttcttaagctttttattagctctaactcatgttctattaaatatacgttttcaagccatacattactctttattattcttatactgtaagttctagggtacatgtgcacaatgtgtgggtttgttacatgtgtatacacgtgccatgttggtgtgctgcacccattaactcatcatttacattaggtatatctcctaatgctatccctccccccttgtccgccccacgacaggccccagtgtgtgatgttccccatcctgtgtccaagtgttctcattgttcaatttccacctatgagtgagaacatgcagtgtttggttttttgtccttgcgatagtttgctcagaatgatggtttccagcttcatccatgtccctacaaaggacatgaactcatccttttttatggctgcatagtattccatggtgtatatgtgccacattgtcttaatccagtctatcattgatggacatttgggttggttccaagtctttgctattgtaaatagtgccgcaataaacatacgtgtgcatgtgtctttatagcagcatgacttataatcctttgggtatatacccagtaatgggatggctgggtcaaatggtatttctagttctagatccttgaggaatcaccatactgtcttcctcaaaggatgaactagtttacagtcccaccaacagtgtaaaagtactcctatttctccacatcctctccagcacctgtgggttcctgactttttaatgatcgtcattgtaactggtgtgagatggtatctcattgtggttttgatttgcatttctctgatggccagtgatgatgagcattttttcatgtgtctgccatacgttactctttagaattctggtgaccaatttttttctgggtggaaagttgattgaaagttctagttttctctctgtgttataataatgttctttcaggtagtggtcgatgaccatatttagctaattgaatgtcttatagtaataagctatatcacagaagtacttacaaaaaactaattgtagcataaatattaattagtattatcagggatatgaaagagcaaaaggctctgttatagatctatttccccatgtactttattgtacttcatgttgtctcttttctttcttggcttaagctcatatttcattgaccaattaggcttgttttttgtttgtatctctcttcattctcatattttaaattgaaatttttggggagtcagggtcttgctctgttgcccatgctgcagtgtagtggcatgatcttggctcactgcagtatccacctctcaggctcaagtgatcctcccacatcagcttcccaagcagctgggactacaggcgcacaccatcatgcctgactccttttggtattttttgagtagagatgtgttctcattatgttgcccaggctggtctcaaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacactttggggggcagaagtggaagatttacttgagctcaggagtttgagaccagcctgggcagtataatgaggccttgtctctgcaaagataacaataaaaacattagcatggcatgaagggacacacctgtagttccagctattcaggaagttgaggtgggaagattgcttgaggtcaggagtttgagacaacagtgagccataatcaggcccctgcattctagccctgggttgacagagtgagacccagtttcataaaaagagattgataagaaactcttgatgcaactcattataattttaaaatggaaactaattcttgatattaccttagcagtgtgtccccgagaaagtgtcagagcctttacctggatcttcgcatgaaaaaggaaacagaatagtcaatggacaaggagaaggtgagaaccgtattttatttaaaaagtcttttgatggaggccgggtgcggtggctcacgcctgtaatcccagcactttgggaggccgaggcgggcggatcacgaggtcaggagatccagaccatcctggataacatggtgaaaccccatctctactaaaaatacaaaaaactagccaggtggtgttgtgggcgcctgtagtcccagctactcaggaggctgaggcaggagaatggcttgaacccgggaggcggagcttgcagtgagcggagataccaccactgcattccaccctgggcgacagagcgagactccgtctcagaaaaaacaaaacaaaaaaagtcatttgatggaatgtttctttgaaaatatgagcactaatagagtgtaatagctaaagaaagtgtcctattaactgtataataagtaaaggagaagtgaaatggtgataagttgtgtctctaaccaagggtcagcagttgattctattgggagtaccactaaaggagctgaattgtgagttccattttaagatactctaagacctgaggcaagtcaggagagagggaagaggaaatgaataaagagaaagaaagaatgaggagagcggattgtacatggaataaataaaaaagcatatgcagaggtaagtaagagaggatagtaaaggcaaattgatctgtagaagaaggaagaacatggtgttagaaacaggaaagaagataaagtgagcttccagtaccaaaatgtgtcagagaattacagtaacattttccttctcttgctgtcatcctcgctactggggaggcattaaggattgaggcacctcaccacacagacctgtgttttatctaccatagatgaacatcaccaaagatggtcagccatgtatggctataatttgtttttatagaaaatgttgtaacctcataggatagtatcatataggccaaattaacataattgaatagtgttgggtgatttatggagaagaaattaattcaagaagttattgcctgattaaaagttcattagaaacattatggcttataatgtagtattaaattgagggacataatagggaagaaattgaggctaggccaaaagggcaattaggggaaaccaatatggaagcacatcagtgtagaacagggcattcaaattgtcatgaatgagttgaagagcttctggaaggtgcacattctgattcagcaggtatgggagtctgcatttctcatgagtactcaggtgatttttggtgctggtccttggacacagctctgaatagcaagggaatagccttcctttagagaactctggaaaaagaaccattggagagcaatttaaaaaataacagaatccagggaaagcattaatttccttttatttctgagcatgattctagccacaggggaaggagaatgagatgaaaacagagagattacaggtgtatactactgctgaatacagatgaaaaaagtggtcacaattatccataaaaagcagttaggaagggaagcatcaggatgacagttctaaaaatcactttttcaaaggaagagggattgtgaaaggacacggagggaggaaagaaagacatttgctggggtcttgggagttgaagccaagtaaacttgagacaactcacttccagttgcttcagcatatgcccagtctcacaaaagaggttattgctgtggagagtactggaggcaggagggagtgctagagttggggtaaaccacagcagctcatttcacttgataactgtcaggcctcagagagagaagtttcactgacatgagtgaataagatgtgattaagttgcatatagatgctttggctaattttttttgatattacaaaattcattctgtgaataccaaaattctctttttcaataaatactgcactgattttgaaatataaatatgtattcatatccagcaagtctgtggtaattcagtgttttcttttttgataaatattttgatatcggaagcttattcgacatggtttattttatgtgatccttgcatgagtggatcaaggagctctaactcaaggccaaatgaggggataggagaaatgtaggtgctgcagtagcccatgtgatcatgggaaaaatgagtagtttgattagctgtcatttcataagtgtgtatactagctgatcaatgtagaacactttctttgatgagaggtgaatcacacattcacctgaactgtcatcccaactgtgtatttcctcagtgacaagacaaggggaatttgtttgtggcatgctggcagcaatgcctctgctgtgttgagttaaaatactctgtacattcaccatcagctttgacgtcgattccctcaggtttgatttgctcctctgtttaatggtcccttttctcctcatcagtccacatgttcacggtgatatccatgcttttctattttaggtataggcatttgaaacataatctcactactgaaatgtaaactgtgcattttaggaatcctatattcctattttcctcattatgtttctgtcatgttgccgtcctaggcaatgaaaagatgccaagaagaaccctcaaaaccttaagtaattatttttatagccaggcatgagaattcagctcgatagtaccactgcatgaatgtttggttggccctgtcatacttacatataattgatgacatatcccctttgctttgtagggcctcctgcaaaacatccttccttgaaggtaattaattatgtatatttttgaatcactaactccatgttgtataaaatatatatgatttatgaatcattttcttttaaaacccattcagcctagcactgaagtagaagatcctgctgtgaaaggagcagtacaaagaaagaatgtacagacattgagagcaggtacatttaatggaatactggaaataagtacattcaatgattggaagtactcacattattcttattcctaattctatttgttcaaaattgaatggaaggcattgacataaatgttattgttggtatccatatttgaataaaaataaatttagaagcataaaaaagattttaaaaatgtaagctttaactcagatgtttctcttttaatgttttgaatagcatgaagttttcagtataaaatttttatacctgtcagggattcaaagcagtgaattttgagactctaagatatttccaatgagttaagtgctacttggagttctgaactttacctagaggaaagctttacttattaacatgtcagattctgttttaactttagaggcttgctgctagtgttattacactgatgatctgaagccaatcagatgttctaatgagcaagactgtgtgtgtaggtgtatatatagctgtgtgtatgtgtgtgtttgtggcatctttgactattaaaaatgaggaaagtaatgattcatttataactggtagacacagtcttttaaaatggtgattttgagactttttggtgttaaggtttttaaaacatgattgcatagaggctaccgacatcataagttggttgtttttcatttcaatgcccttttgaaatctttaactatattgtgatgctcagaaataatatgcagaattttttatttgtgtcccaaaatggtatgtgagtggttatacactttacatacctttctgccactttctttggtgtattttgtattatattttccagatgtatccacattgatatgattatctctggtttaattcattttacacttttcattgtattcccttataccactttaccacatttagttagactctcctgttgctgataaatgaagaaagaaagaaaaataaaaataatgtcagattaagtgggcttttctttaatcagtttgtatctattaatatttactatatgagagtttaaagttgaaaagttcagaatacaagcatgcaccaccatattttataaatgcccttagaactgtgactcatgagcctttagcctatgaagttaggacaattcatttctctgaagaagtttgttgtgctgttctcagaaaagaaaactgaaaatagcaaatgatattgtcttatttgacctcttggacatctttgaatgaaactgcaactccagggatactcagatcaaaattcagaactaatgttttgaacaatatagtttgtgaatgtccagtggatcatgagcccttgatgggaaaatgacctttcaagtttcacttttgcattttttgctcttttccttgacttgtcttaaaagcttaaattcaaccgttttatttttacagaaactgggaatataacttttaaaatttatgtctgtcctgtctcacggtgttgtgtactcttcagatcttgtgtgaatatagacttatgtgggaacaattaggtgttttgtttgtttgtttgtgtttttgagacagagtcttgctctgtcaccaaggctgcagtgcagtggctcggtcttgactcattaccacctctgcctctcgggttcaagcaattctcctgcctcaggccctcgagtagctgatactacctgcatgtgctaccataccctgctaaattctctatttttagtagagatggggtttcaccatgttggccaggctgctctcaaactcctgatctcaggtgatctgcctgcctcagcttgccagtatgctgggattacaggcaggagccactgtgccaggtacaaataagatttttaaggctattatattttatacaattctttggtctatgtgaattctgaaggtattcatgcattgagggaagatcatctcagtttaatgaaagcagtttttaatgtatattcattaaaaatttttttgaagtttttgtctctagtacagagaaacacacaatattgtcatgggtatttgaccttaatgtgtttatgcacaaacttagttattcaaatattttcttatccctgaagaatcctaattattaataaaaaaatttctcatggaaaacaacatatataatagagattgttgagtgataaagtaaattgtagtaaataacagaagcttagaacaagttaagtaaacttgtctgagttaatagcaattacaggacttttaagatacattagaccatgagggagtagtgtgtttgtggggtagaggacatcatggtcctgcttcagtgaagaaagaacttttacaccttattacaatttgtattactatttacattctaataaaaactttattttcagatattttagattatgtttctactagttgaaccatcaatagtaagacttttcaaagatttgggaagttgtgagttgatgataaatatctgtatcaccattcgtgatcaaaaatcagcaactacaagactttggacacacgaacttcatagttaaagaaaggattaatcttggagctgtgtttttatcagggaattatactcttcattacctctgtgaatcgcagttattagagtagaaagagagcaaagaagggaaacaaacatagaaaattttattctagattacctcagttggcttcatgctaccatagttctggcttttaaaaagtcattctgtggtcaaatgtactttgtgtttactccctttatgcagcctacaaccaaacaaaatgcttcttagcaaggcatttgtattcttcccttaaggaaagcaacatataaataacaaagagaatgaggagaaagagtaatttcattgaagttggtatttaacataaatttgtgtgcgggtaccatgattatatttagaattttgggcctggaatagaaaaccagctagacgtctacagatttcctactcaaacacaatgtgcctttgttttatttttacatctgtaattttgcaattattaggtacaactctatgcagtgtcactaaaaataccttccaaaaccaaatattaaataatgcctatggttttctgtattataatgttgatttccccaatattaatgggaaccattgagcatttgccttgtggtgtctcctgagctgtattcacacattccatcaccttgtcttaatggataatcatgcactatgagtatgggttttcagaagagctgtatcatttaaagataacacaggagcatcaaatttaattctgctagaatacctggtctattgattaactgcagctaatatggggtctacttcacatacaagttaaattcagtgcccttaatcagtcatatggtcaggtcaacagtaataaattatgcaatattttttcacccctatagttttaatttctctttccccttatgtctagaattaacattttattttacaaaacatgatgataatcttctagagtagtgatgacaaagtataaatccaaagtttcttacctatgcaaatgacttgtttgcttctattttctcatgagcttggtagatccaggaaacagaacttttaaaacaaaatccccatatgtggctgggcgcggtggctcgtgcctgtaatcccagcactttgggaggctgaggcgggcagataacctgaggttgggagtttgagaccagcctgaccaacatggagaaacacatctctactaaaaacacaaaattagctgggcatggtggcacatacctgtaattccagctactcgggaggctgaggcaggagaatcacttgaacctgggaggcagcagttgcggtgagctgagattgcaccactgcacttcagcctgggcagcaagagtgaaactccatctcaacaacaacaacaacaacaacaacaacaacaacagcaacagcaacaaccaccacaaaacccaaatgcatttccttggcacagtaaaactgaaacagaaaaagtgtaaagtaaatacaagtaactgaaacagtttatgtatattattctacttctcatttgataaaatttgtaaagtaatgagcagagtgtatttctccagggacccagatatatacatttattcattcaataaaaattcatgcttacaatggccactgatacttatgtcctaaatatttctgaaaacatctcctcaggcctgcatcatctttgcaacactgccttatattttatctttgttcattgatttatatgcctcagaattttatgctcctcacaataattagagttaattatctctaatgcaaatagatctgtgaaccactcctgaatacctatgtccaagcatcttaaagttttatataaggatttcagaaactgatttctgggttgggcatggtggctcgtgtctataatcccagcactttgggacgctgaggcaggtggatcatttgaggtcaggagttcaagaccagcctggccaacaaggtgaaaccccatctctaatagaatacaaaaattagcaggtggtaatggcacatgcctgtaatctcagctacttgggaggctgaggcaggagaattacttgaacctgggaggccgggttgcagtgagccaagatcatgccactgcactccagtctgggagacagagtaagaccttgtcccaaaaaaagaaaagaaaaggaaactgatttctgcccaaatctccatctgtagccctttccccatctgcctttttctctggaattactgagctgctggtaatggccccctcaccattcctcttttgcagagaaatacatactctcttggaggcttctctccctctcttgttgctgcctggcatgtgctcaccctttcctgccctctgcctcacttaatctggctaaccttactctctaagtctcagctcatgcatgatctttaggaaagccatccctgacagcttttattttccttccttataccccagtgcctaacacttagcaggaactcaataagtaattatttagcaaaattaagactgtttatacaaagatgattcaaaagattgtcctctacagtctaacagcaaaggggatcaacatgtaaagacatgatgtgcagttcaggtggtaaagtgacgctggaaaagttgacaaagtactaaggaactccaatgaagcagacacctgtgtgtgtggagaaagacagctagaatcaaggaagacttcacacagcattctgagcctttttttttctttttctgttgttggagacaagttcttactctattacccagggtggagtgcaatggtgtgatcgagactcactgcaacctcaaactcctgggctcgagggatcttctcacctaagcttcttgagtagctgggactacaagcacatatcaccatacctgtccaattttttgtagagtcaaggttatctatggttcccaggctggtcttaaactcctggccttgagcagttcccccattttggccttccaaagtgctgggattacagatgtgagctattatgcccagcctactttctgagtcttaaaagatgaaaataaatttttcagaatagtaggggaaaacatttgcgatgtaaaaaatggggtgcacactaattaaggtataaacaacaataattttgcaaattattagtaactgccaactcaattagtgtcttgttaaaaagatactgttatgaagtatagtaaagtgttacattgtatattttgactgtatttcaaaattttgttttgtttctaacagttttgttgatttatgttgggtggaacaatttgtgagtgaccctgagatttcatatggcttgaacctggtgatatctaatgtctccccaagtggtttgttgaaattttggatgattagaagtatttcttaaagaactaaatatttcagtaaacattaagcttcattgaaactctcaaaatataaaatacaaagaaatgttattctctatttatttttatatagattatagtctttatctaactgttcttagttcatttgaactaaaccaatgaatttgtcaacagaacaagccttaccagtggcttcagaggaagagcaagaaaggcatgaaagaagtgaaaagaagcaaccacaggtatatgaaaattcaagtttcttgtttaatattgggttttgtttttttgcttcagtaacaaagcatagtccaaatgacatgaccttttagactatacctttagaatccgatagatcataattttatatttaatttttaaaacatcttaaccagttatgaaacttaagatattcttactatctctagtaactattagttattctggtaattcttactatctctagtaactcatagctgtctttacccttggaattgaggcaagacattttcagaattatcttgctcttttattgttataaccttactcataatacagaaggtaacatgaaatattgggtcatattattaaggaatagaaattgtgaacaatttaacaatgatggccactgagttaaactagtgttaaaggagtcatcattgccaatggttcaaatgttgcagttttatattgctggtcaccagtgccgaggttaaagatttattctgttttgtggtcaccatttgacttctgtgtctgtgttcagggagtgagtggggtcataaaagtcaacccagttgcctattaagagaatcctaccttgtggaatgggacctttggtgtcagggtacaaacaataactttattttgacataaatacatagtaaatgttactaaaatttaaaaaatccatccactatcactagtggaacttaaaatatattagaagtggatataagcagataatccatctagatacataacactatcatagtatattatttgaattagaatttaaaattttgcttccctttcttattggtgttcagtttggctcttaataattcagtgtttgcctagtctgtagttaatcttcagaaatatacacgtactgtaggggctcactttttctggtatgctgaggtaaaatctttgtaagagaggaagattttataatactacctatcagctttgaattcatttctggtagattttacacataatgcattaagtttaatccaaacaaatgctaagcgttcagcttgccagttcatatttctgtcctatgttaagccaaggcaaattatttttcactttttagttacaatcccataatttaagagtggcaacacatagattaagtttcacagttaaattttaattattttctagtatttttgtttatacttgattaaagctaattttaaaacatgcactctgacagaaaaggcatctgagaaacaaaacaagcaaatttgttttccattttgcacctgccaaaaaaaaaaaaaagtctcaagaaccagaactgggtaagaattgtgataaagggaataatctgtctgtatattcacgactttctttaaaattcattacaaacaagttcaagctgaatattggtgaaagttttgaaaactccagaattactgcttgccctgaggaagagctcctacatagtaactctaaagagggacgaacaaaaaaggagtgccctctaatctgatgaatcaggtccctgattgtgaggaggaagatgcatctggagggtctaactctgtggcattccaggcagcgcctgaacagaggaagcccatgtcaaatgtctttttattccattcatactccaggtccctgaaatacagttaccagtcatcttctaagcttcatttaaatgaaaataaatcagactataaaaatgatagcaaaccagacacatagcttgtttctaacacagatgatgaaaatttttgtaatgatactgaaaccaaaaaattaaggaacccagtaattatgattgaaatgaaagatgattaagagtttgacatgcaaatggcaaaaaatgtaaacccagataccactaattggaaattggacattaggcattggcctcagtctagagatccagaaagtctttttgatttgttgtttacccaccccaaagaaatgaagcatatgattcagatagaaagccacagtatttctgctgctacagatacttataaaaacagaaaaccaatacagcgtttattccagcagccactatatggcaatcccagtgctaacaactacagaagcatgaatcttgaattataaaatgtgagttattctttaccacatagtgagagaacatcaaaaatatagctagaagacttatgggaagatattccaaggtcaccaacatggcacatgaatagatatgtaacaaacctgcatgttgtgcacatgtaccagaacttaaagtataataataattaaaaaaagaatgaggtaggcatgttacaagttgagttcctggctttggagaaaagcaagtccaacttcaaaaagacagaggttcacttgctgcttctttttcctctttatcaattatttgatttagtcaaattttctattcaagaaaatctcatgtgtacagttacagtggggttatctaaatgtgtaattatgtgtcaaagtagattagttctgctatctaaataatggttctggagaatgttctcataatgtttgttcattaatcaacctatgtctcactatcagtcttccaagtggcgtatgagctgggaaactaattaagccacataccatgtgaccttctgaaccagatcaacataaagaaattgctaaagaaacaagctctagattctagattcttttttcttgtattcatttagagataatttacatttatttaatgatagaatgggaatacaatgggagggaagcaatgactgagacaagccacaaaaacacgtctagccttgagagttgcaacgaatattcccagccaaatgagtctgtttaatgtgttttcatgcatgcaagtttatctgcttagctcaaactgtttgaacttacagtcccatcatggttatttccaatatttttgaaaacaaacatatacttacacatattttaaaaaatcaccactctgcaatatttctgttgaatcagaccttacgttatgttgtttaataaagtatggtaagttttggcatgtatgatttttatcatataagaagcataatttcttagccaaaaatttagcctttgactctttagtagaaagttgagttctgtacattgtgttctaaagatagacaaaaatctagagattttcttctttcaaagtaaaagcagatgaggcctttttccaccctctgaggcattaaattgctttgctcaagttagacttttaatatatctaatttgataaatttatctggtaatttatgtaattcagcaatatggaattgtatcatgttatatggtgccatgaaatgctagtgaatgccacctcaagagctctggatgaaacatttaatatgtcttggttggtttgactcccattatcagtagataatggggttaaagtaggtaactgtaccatatgttttccacctataaacttttgtggtaattgaatgtgaaatctgggaagcatctcattttccagaattctgcactagaaactcagcagtttcactctgcttcttttgttgtggcaaacgttggttcccataattcaaagagaacctttacttttttgatatcacaggattcaaaaaaaaaaaaaagagagataaaaggcagtggggaaaagagtagctcagtacagaaaagggaaaacttctttactgttcctgaaggcctacaaggtcacatcttcttaatctggctatttcatgtaaaatccaggtagtaaagacagaagacatatattatgcctgtgtctttttatttctctgtttctgccagccagatagcataaaaatttataccagatagcaaagagtggatgggaataaaagcacaaaatggagaagagccctttttgaaattttggaaaattcttctattccctcaaacagaaatgagcagatttgacaaaaatttcgatgataaaataagagtatcttataattataataattatgtataatgataaaattaaagtaagcacaaaatacttttatcattaaagtggtgatagttaacctgaatcaagtaataaaaatcagggaaaaagttctttttattgaataaaataataacaattattattcatcttttattaaaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgataggtaagcctatagcagtgtttttttgtttgtttgtttggttttgggttttttttgtttgtttttgtttttttgagatggagtttctctcttgctgcccaagctggagttcaatggtgtgatctcagctcactgcagcctctgcctcctgggttcaagcgattcttctgactcagtctccctagtagctgggattacaggcatgtgccaccatgcccggctaattttttgtatttttagtaaaaataggatttcaccatgttagccaagctcgtctcgaactcctgacttcacgtgttctgcccacctcggcctcccaaagtgctgggtttacaggagcgagccaccgtgcctggccgcctatagcagtatttcacaggagataattgtcattgtgctataaactaattgaaaattggactaatattccttatgattaacaagttttatatttttaccaggggtatttagccctgcctggtattcagaaaaaagcaaattaacataaaataagatatattttgtaaagtcatgctgatatttaaaaagtaattattagtgttggcaaatgtgaggaaaaaggcattctcatacactgttggtataggaaattagtaaattatttctgaagggtaacttagtgctgtgtatcaaaatttcaaatagcctgacatccctttaactcaacaactccacttctgggactagatttcacaggaaaacataactggtgtaaacatacacacacttattaatatataattaacatgcattaattatatattacacataatgaacaataggttaatgaatatataaaatatatgtaataagaaggtgaattgaaagtattaagaaagaaatataaaaagtgtggggaaacagatgttagacttttcagcctagttttggatgacagtcatctgcagatatagtttgtgtgagagacatctgaaggtgtcatctcactctgtaaatcatttggagaaacacctgcaatatttcataaagatgaaaatttatttctagtgaacttatacgcttgtcaataaatagtaactttaaaaatttagttgattgtaaatgatcttttctaattagggagtaattatgactgtgtgatttaaaaaggtaattttgaacctgtaactttactgaattatctctggtatccttttttataatatatattagagtgactagtaacaaaaactttagcagaatattctttccttactacttttcaagtatatgcattcatttgaagatgttgaagtgagaaattaaatatctgagaactgcaaaggaaaaataatccagaacatagaaattttattaggataataaacaacatctgcagaggtagataacaggatgaactccttattttttaacaaaatgaattttaagacaaatgtctttatctgcagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaatcgggtaaatcaatctttggtaaaaattctatattttaaactttatcttatcactgttacttataatatccacttgatttaatatatattgtttaggtctaaaaccataaatgttatctcatttttaaaaatgaatgatgacacttacaggtacaattattaatatttattataaatcttggcatccacataggatattattttattacaaagagcttttgaaaacaataatatgccataatttatacttagtgataacctattgataaaaattttgttccaggtaaaatttttccttgtactttcccctatttcatattgattactgcacctaatattataaagaggaagcagaaattattgcaatcgcaaataatctcatgatattctaagaagagctctataaattttatcttatttactattggcattttgaaataaaagttttctttcgtattgatgtatttacaccacagaagtaactgtgatctgttggagaactagaagtagagtcagaagtcctggggaaaatcctgtagcttgcttatatttttaacatttctttttcaaaattatggtaactagatgagttcatcaatgaatgtatataggagtgactagtataatgtctagtttatgatttagtgaatgtaattcttataactgactataaaagtgttaaaagagtcaaactgaaatagaatgttatcagtgaaacagaactgtaataactctgggaaattttatctgtccaaatatgtgtgaacaaaagttcttactatagggtggtgtatgggttaggtatcaaagtgtaaatgcaattttttgatatatcttaatttagtcaaatttgttaatgctttaatttatgcttttgagtttgttgtaattcagggaaaggcttttccaattctgatattcttaaaaattctctggtgtgtgtgtgtgtgtgtttacttttataaattcattgactctaaatacatttctgaactttctggaatttatgctctataaggttcaaagttttgcttcaactttttctccaggtggatatccacttatggtaaactttttagtggtacggatgtgcaggttattctttaacttcagaggtaatcatgatatgttattttattgagtactagctaaaactttcttttgttttatttaggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaattatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagatgagaatgagtttcttactgaacaactttctgaaacacaaattaaattcaatgccttaaaagataagttccgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacctcgtgctagaagagaaaagtaagaagctaatgaatgaatgtgatcatttaaaagaaagtctctttcagtatgagagagagaaaacagaaggagtagtaagtatcaaggaagataaatattttcaaacttctagaaagacaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaacttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtgtttttatgaccatgtaatgttttaaaggcacctacttgttataaaatcataatttaggataaatgtggtaaaacttagcaaaactatatttggtttagttttcccactggtatttatagtttactttgaatatttatattaataattagctcataatttttattgcaaggctcaatgactgtcattggaatataattttgttcagtacaaagatacttgtagctgtctgtgatttacgagttaggcactacatctccattttcagactgaggggtggcaggcttcacatacagtgggaatggagtaattacaggagggagttgtaggagctttgaagtcagagagggaggtagaggcctttttacctagggcctcaaaggccattggaattttacttttattctgagataggaatctgttggaaggatttgaacaggtgattgaatatgttaggaactttgaggctgagttgagcttctgagatgattgaatgttggaatgaatctgttgtgtaagtaagagaataccaatttggcaggaagagaacatattctgcatccctcactgaattcagtaataaataaaaatgtgtacatgtgattaaaagaaggtgaattgatatgtgtggtgataattttcaaagtagatatgttagaattaaacattattaacataatttaataaggcagtttataaaatcagtaacaaatattttatcaggtggttgtgagacaacttcaacaagaagtggctgacagcgtaaaaaaattaacgacgttagagtctccactggaaggtatatcacgttgtcacattaatttggatgagacacaggcctcaaataagaaattatttcaagtgaaaagtcaaatatgtatggaatttaacatgtcaacagttattctgtagctagttgaattatataacgtgttttaggatactaattttggcagaagcttgattttttattttcattataatgaatgatttccattttactatctttataatgtactatttttttatattgtgactttcattataccattttgaaaaaccattgcataccttttctcttacaatatgtacccttggaaaagttgagaattatacatcattcctcatagaaaattgacttttttcctgttaaacagtatttttaagtaatttgtgtattgctctgatgaggcaagccagattaaatcagaggagaatgtttcatggaatgttccagaaaattgtcttatttcttcacttttgtgaatggacacagaatctgtgtctatttgtttcacagattctaggttaacttgtacagaaaggccattatactattctttgaaatgtgcatgttttaggttaatttacaaactatttgaaaagttaggcattttctttatcttttatttaaaatatactgtaaaactgtagaaatatttagatttgatatagcatgtacatcaaaaattaagagttgagaaaattatcttgatcctgcctttggattttaaaaagattcactgagatgtcattcacatatcagacagttcaaccatttaaaatgtacaactcagtgtctattagtatgttcacagcattttcgtcaccctgaaaagtgaccccacatctcctaggcatgactgcagccttcctccatgtccctccacctacccctgttgtaggcaaccaccgtctacttttgtctccatatgtttgcctgttctgcatatttcatatacatagagttatacaatatgtagtcctttgtgactggctttttcacttagcataatgttttcagaattcatgcatgttttagcacacattcgtagtttatttcttcttatagttaaatgatattctattccatggctatactggttttccattcgttcatcagttgatggacctttaggttagtttccactttttagctattatgaaaaatgctgctgtgaacattcacttacaggttattatgtggacacgggtttttatttccctgccattggactttatcctcagagttaattgggcagatttcagcacttgtcttgctcatgctattctttctgccttctcagtttctgttcatctagcctcattcattcagacctggcagacaatttttttgttttcatgaagctttctctgactgttctgtcattgaccttatgtgttagcaatcgttgtctagtctgtgctgaaaaacttagtccttaattttacatggcttttatttttttatggaagataattttctctcattataaatttgcttaatgggggaataatatataatgtgtatgccacctatccttgcatacattgaaaatattttagcttagaagtttgtagcatacaattcaatcatttataccataccaattatttcttctttgagaccttgacacagtaaggttatattctaaatatatttttagcaattaaatatcaaatctaacccaattagtctaacacaggagatgcgttcaatcacgtgtttatgtttttctctctatgaaaaagaatataaattggccttttttcactatgcagccattactgtgtttctggactgctcccagtctgtcagctgaacagttctgggtgcagcttgtctgatgaaggatagcacagcccctcaatctgagtgctcagcagagtgcttgtgaaggcagcaccacagcaacagttgctcagagggaacggattcaggagccttgacttagcaatagagtccagggttttcagctcagtgtctttagcctgtctctgctggtcatgtcagttacgtactattccatccaggaggtgctatttacattgtagtacatacacagtcattgcctaatgagtcatacagagagaaaagtaagttataaattatgtcccccatttgctgcaactctcagtgttaagaatgattcagtgcagctataggagactacttccattggcatgccacctgcgtaaatacacaattttgttaagatatacaataaaattattatgctaatagcaaatattttatgtagctcactatgttccatgtagtcttctaagtgcttcatgttagtccccatttaaacacctggttttggaaggctgaggcaggaggattgcttgagcccaggagtttgagaccagccagagcaatatagtgagactctgtctctaaaaaaaaaaaaaaatttttttaaacacttagctgaggcatggtggtgcatgcctgtagtcccagctacattgggaggctgtggtaggagggttgtttgagcttggaatattgaggctgcagtgagcagtgatcaagccactgcactccagcctaggtagcagagggagactctgtctcataaataaatcatgttgtatagattcccatagaagtgagttagacatcaggcatagaattattagccgctttgatgtctgccttgggagtaaaacacataataaggggcagctttaaaccatctcaatcaatagcctctaacttctccagaaggttcttatttcatgaatttctaagcaagggactacctggattaagacatttggtagacaccattttgagatgaagaatcttgaatgggaagaagggagatctctacttactgaagcttcccgatgacatagttgagtgtcccccaaaaggaactttagaacaagatgttcatcatgccatatctctatggaaaaggaaattatttaaaagaaaacaaaggcaaacaattgataatctgattctcatgggaaagttttcattatcaaagaaaaagagggctgggttccatggctcacatctgtaatcccaacactttgggaggctgagaggggtggattacctgaggtcaggagttcaaaaacagcctggccaacatggtgaaaccctgtctctactgaaaatacaaaaattagccaggcgtggtggtgtgcacctgtagtcccagctacttgccaggcagaggcaggagaatcacttgaacccaggaggtagaagttgcagtaagctgagatggcaccactgcactccagcctggatgacacagtgtgactccatctcaaaaaaagaaaaggacaaagtatattggtccaaaaaagaagaaagaatgaaaaaaaggacaaagtatactggttagtatcgtaacagtgagatagtccccctttgagattagaaaataacagtatactcaaagtaacatcaataagaaccaacataaaatagacaagattcactatctacaaaagtaatctgcaccaagtagcaatgtatgagcatgtggtggagaatattgtctataatatgtgtactagaaggaagagacctcaagaaaaaggtcagagctggaaatgtagattagggaatctaggtcaaagttttgagattttaggagtcctgagagaatttaaaaagctaaatagccaccgggcgtagtggccacacccgtaatcccagcactttgggaggccaaggcaggcagatcatgaggtcaggagttcaagaccagtctgaccaacatagtgaaaccccgtctctactaagaatacaaaaaattagctgggtgtggtagcacatgcctgtaatcctagctacttgggaggctgaggcaggagaatcgcttgaatccaggaggtggaggttgtggtgagccgagatcatgccactgcactccaacctgggtgacagtgggagactccatctcaaaacaaaaaacaaaaacaaaacaaaaaaccagaaaaggatagggctgaagaacagaggtcactgcatttagaaaggaagtggggtcagaggagcagagggagcatttggtcactgctctgctgagtaaagcaggataaagtccttcatgaccgttggacttttttattggaattattaaaaatcagatttcagtataaaaaacacaataattgatgaaaaaagatttctgaatgaaaccatgtgtcatagagtccaatggaaggggagaaacaggataatagaaaagccacaaaaagtagacgaaagttgtttttgtttattgtagaaaaaataaactttatttaaagagaaatggttaagagaaagggaaaaactgaaacctatgggtgaatacttagaatgacagtatttagctcagcctgaagacagatgaggatgaaaaatgtaatgggaactagataagagttttctaaaatttgtcttagtaagatgtaatttaagagaacttggaatatcttaaactgttaaaaacaatatttctagagcatctttaaaaactaaaatgtaaatataactactctttttttttttaactaacccttagtattttgtgtgtaaaaaccctcatttgtaacaaacattgttggcagtttaaatttcagaaaagataatgatgaaaatttgaatcatttttagcagttttaagaaaagtgactattattgaaatctgaccttattggcatcaggtttataaaatgcactttatacacctgcataaatacgtattactaatccacttatgagaaataatatttttgagataaaagagggtctccagattttacaaaaataattttaaacactttttttaagcctaaaaaagaaaatgaagaattaagaaaactttttgagttaatatcatcactgaagtataatgtgaatcgaataagaaagaaaaatgatgaattagaagaagaggcaactgggtatggttttcatattgtagaacatgttagccatttattaattgatttaactctaattttacttgactaaaacctagatacaaattcattttatgtttgcattttcataattaaatgaattctgttttaaaatgtatttcagaaactcacagcacaactttttagacgtgtgtcatgggggtgggagtcagctgagctgctggggcaaggtgaaattttttttgaatgccaaaatattctttttttttttttttttttttttttttgagaaaaagtctggctttgtttcccagactggagtacaatggcgcggtcttggctcactgcaacctatgcctccaagcaattttcctgcctcagcctcctgagtagctggcattacaggcatgtgccaccacacccggctaatttttgtatttttattagagacggggttttgccaagttggtcaggctggtctcgaattcctgacctcgtgatctgcccgcctcggcctcccaaagtgacatgagccaccatgcccagccacttattctttaatgattttgaaaacaatgaccacgccttggacatttaatgtccagtgcactcttcattatctggtttgaatttttatttctgaagatatttttttgctgtctgtggtcattttttcttccttttgtagtatcctctgctgcattcaaattgtttaaagaagacctgtttgtgtcattctttaacatcaaatttatcttgatatgtagcttatattttgtttctgctttttcttttagatataaaacgtggaaatttactcattgtacatgagtacctctgttgtatacatgaagtatacatgttattaaacttgttttacataaataaatttcatatatataaaaatatacgtataacttaaagaaaaagtaaaatgaacattcatgttttgatcacagattttttttaaaacaatggaatctgtctttgaagccctgaacacagctacttttctatttatttactgagcacttaatttggttttctgattagaatcaacatttttctgtcattgcttttctctacatggttttgtatctctttcattttgttgacattatgtcagcaaagatgtctagatctcttcttcaaagtctttaaatcgtcacacatctctctgcccctttccttttttctaaaactgcctgtatcctttttctcctcaactcagatattaaagatgttttcttctctttttctacattgaatgatctccttgatgctttttgtgtgtacttttttttcttctgatagactgtggtcagtgggtatcaaaatgtacttttgtgtctttttaaatgtatgtgttttacttttttatcttggttactcatctctgggttatggcttatatttagtaatacgttattttacttagcataccaacatggatatcagtagtttatttacaaaaagtgtatggttaggccaggtgtggtggctcacacctgtaatcccagcactttgggaggccaatgtgggtggatcatttgaggtcaagagttcaagaccagtctgaccagtgaaaccccgtctctactaaaaatacaaaatgagccaggcgtggtggtacacacctgtaatcccagccacttgggaggctgagacaggtgaatcacttgagtccaggaggcagaggttgcagtgagctgagaccacaccactgcactttggcctgggcaacaagagtgaaattccatctcaaaacaaaacaaaaaacaaaacaaaaacactgtatggctataatatcactttacctgccatatatgccataaaattgttcttcatattatttatctaagattataatttcatatagaatgctttcaaactatgttcagttgaaactgaaagtaacatagtttatagatttgtttctttgatatgccataacagatgtttaaacaattattaaatatttactcttaaaaatacttgacttactaattctgtacatttctgcagatataagaaactcctggaaatgacaataaatatgttaaatgtatttggaaatgaagactttgattgccatggagacttaaaaacagatcaactgaaaatggatattctgattaagaagctaaaacagaaggtaatttaaaaaaattattttatcttaaggtctagattacatgtgtgagacgtgcaggtttgttatataggtaaacgtgtgtcatgttggtttgctgcacctatcaatccatcacctagatattaagccctgcaggcattagctattgatcttgatgctctccctcctgatcctaacaggccccagtgtttgttgttcccctccccgagtccatgtgttctcatcattcagctcccacttctaagtgagaagatgcagtgtttgtttttttcttcctgcattagtttgctgaagatatcagctttgagctcatccatatccctgcaaaaagcatgatctcattcatttttatggctccatagtattccatgatgtatatgtaccacattttctttatcccgtctatcactgatggacatctgggttgattccatggctttactgttgtgaatagtgctgcaatgaacatacaaatgcatgtatctttataatagaataatttatattccaacgtatggtaattttaaatcagttttggtattaaaaatcatgtaattttggaaaatattgataatggaaaaacccaaattctgccaaaatatgttgagaaaatagagggtaaatatatcttttcagactttgaatgcctcaggctcttagttaatcttccccagatctgggaagacctagaaggggagagattgggctacattaatgaggaccatttcaatctcttggccctgcagcagccatttcaaaatatgacaaaaaatatattttggggtaaaatattttgatttccttcagcttcttctctctgtgatgctgcaccagaatcaggttagaaaggaagccacattataagagttaataaaacccatctgatgagatttgatagtttgaagggtgtgattcccagaccctttagatagaaattggggccaaggaaaacaaggtcttattcctcaatataaatctgtcagtgctttaagcagtgaaagatttttcatttaattttacagacttgaaactaatgaaaaggatagcttttaaaatatcaatctctttttctatgaaaaggacatgctgttgattctcttaggccttgaaccctggccagtgatctgaaaccaagcagtacctgtctccagatcactactaccaaaatcactagtaccaaattaatttggggtggggggtaacaggtttattgagaaataatgaacacaccatgcaattcactcatttaaaatatacaatttattaacttcagtattttcagagagttatgcagtcatcattacaatcaattgtagaacattttcatcaccctaaaagcaaaccccacatcatttagctatcttcactagttttcccttcctccctcagccctaggtaaccacccaccttctttgtatagatttgcctataagcctctgaaatgaaaagcaagtggtctactgtgactggcttatttcacttagcataattttccatgctgcatctgtgttgcagcaggtattgatgcagggtttttgctccttagttcagctcaatctggtttcttctctcatgaccaggaaaaattaagcacacagacacattgaagggtgaggaggacagaatttattaagtgaaaggaaagctctcagcaaagaggggcgtcctgcaaacaggtttccacctcacaattgaataccaggagcacaggagctgaagcggccaggctcctgctctgcataaggcgtgaattcctggtgactccaccccatccccccagtgcttgtgggcctcgggtctgctgccggcatgtccaggcaagacaagtccaggttcccttatctgcacataacgtctggtgtaaacacttgtgaggcttgttggggattctccggggacccttccttatctgcctaggcattttgctgtctcctcctaatacagtatcagtacttagtttcttcttattgctgagtgatattccattgtatggatacatcaaacagtttatttatccattcaccaggtgatggacctttgggttctttcccacccaaaggtgatggacattttggttctttccacttttcactcttattaataatgctgctgtaaacatttacgtatgagtttttgtgcttgcatatgtttttgattttctggagtatatactcatgactggaatttctgggtcatatggtaacttcatgcttaaccttttgaggagctgccagtttgttttccaaagtggctgcaccactttacatccccagcagcattggataagggctttaatttctttacatttttcctaacacttattttctcttttttattgaataaaggtttcatcctgtggtgtgaagtgataccacacgtggttttgatttactttttcctaatgactaattacattaagcatctattaatgtgcttattatccatctttatatcttctttgcaaatatatctattcaaaatctttgcccattttttaaattgggttatcttgttatttatgaattgcaaaggttctttatatatcctacatatgtaagtcccttatcagatacatgcttttcaaatactttcttctactcagtatcttaccttttcacttcttgatactgtcttctcaagcacagcagttttcaattttgaagttcattgaatccatttttcctttggagtcatagctaagaaaacactgccaaatgcagtcacaaagatttatgccagggttttcttcgtactttatttattttttgcatgtggatatccagttgtcgcagcaccatttgttgaaaagactattcttttcccattctgttcttttgttaaccttgtataaaatcaattgactgtaaatgtgcaggtttatttgtagattatcaattcttagtttgtttatatctattcttatgccaaggccaaattgaatttaatgagaagattttttcaagcatgttgcatattaccagttgtcttatatcataataaaaattaaatttagtggaatatctttaacttcaccttttgtgcctcaaaggaatctctggccagcttataccttacttactctaagacatgatggcaagtcaggcttacaagacactctttctttttttctctattcaaacctttagtctcttttccattgcctccctctatagttatattttcagtaagttttcatcacaggatctgctgatgtagtctaatatttagtgtattatgttttgctaactcattataattcatagaatcttccatagatgtttaccatccaggaaggagaagtctgagctgccagctttcctcagtggaaatcatgtgaagtcatcatgttgtagttcgcagatcctctttccacctggtagctggttctcttgggtagctctgcatctaatcctttacttggtgcagatcttgcattctcagaaaccacagttccctgtattgacctccttttactgaaacagagatgcacagctctgctttctagctcagtagaggattcttgggatataaagtttaactcattccaagaaaaagtcttaggagtgcagcacttcaaaatcaggtaatgttcaggcaatttatcagagacaaatagtagattagtattttgacttttgaaatttcggagccaagttgtgtgctgtagagaagcattgtggtataatacagagatgggatggtcttaacttctccatacaaacaagcttgaagtaagataaaggagaaattgcatttgatgtcttaacactcaaagcatattgtgcttattttacttctgtgaagactaaaaatcattccataatgttctccttatttcctcattgagaaaaggaaaatgaaaattgaatactagattgattaataaatactcaaagcttattcttttagaattttcattaactgaaatcaggcaaatgtctgattttggttatctaaccaagtatttctagttgtttttcaaatcatacttcttctttctttgcagtcttatttcctaacttgaggggaaattgtaaggagacacccttgccttgttatcagagttcataattgaagggggttttaggaaatgttcctcctcagcagcttatgtctctctcctggttatctactgcttctcaataatgtttgccatcaataaattaatctcaacatttattagatcctactttaaaggagactcttttctctgcataagttatgtttcctgttgtctctttttaaaacttatttttctaacaattatccaggtttttgtggcttaaaagaaaaacatttattttgttcatgaacctatggtttgaaaaaagcttagccaggacaggtcatctctgctcccctcagcttccctaggaatagctgatcagttggggaaatggaatcctctgaagctttgctcacccatgtgtttgatggttgatgctggccattggctggaaccttggttggagcaggcagcatgaatattgacactgacactcccaggctgtctctctggcctgatctcactcacaatctgggggctgagttcaaagggaaagcagtctgagatagggaagccacatgatatcccttttactgcattctattcattagaaggaagtcagtaaggattgcccatattctgtttttttaatgggataaatatagcttctcttttgttttaattgacatgtatatacataattttggccaatagagtgatattttgatacatgtatatagtgtgtaatgatcgagctaactagcacatttactacttcaaccatttttcattttttgaattgtgaacattcaaaatcttctgcctttttaaaaatatacaataaatcatagttaaccatattcaccctacaatgccacagaacaccagaactcattcctcttatctaactgtaattcggtatccattaaccatcctcccctcccctacctctgtgagcttttttgttgttgttaagagacagggccttgctagtccagtctgggctctgggcatctgtagtcacccagactagagacagtggcttgatcatagctcactgcagcctcaaactcttgggctcatgtgatcctctgacctcaccctcctgagcagctaggattatgggcatgcaccattgcacctgtctgatttttgactttgtagagctatctacctatgttgtccagggtgctctggaactttggcctcaagtgattctcctgccttggtctttcaaagtgctaggaaattacaggcaatagccatgttgcccagccctcagtttttctttagctcccacatatgagtgagaatgtgcagtgtttatctttctgtgtctgcacttaacataccatccctcagactgatccacatggccacgaataacaggattgaattcctttatacggtgaatagtattctactgtgtttgtgtgccacagttttttgtccattcatttggttatggacatgcaggttgattccatacatcagctattgtgaatagtgctacaataaacatacgagtacaggtatctttttgatctattgttttcttttctattgcctgaatacccaatagtgggtttgccggatcccttggcagtcccattattagctttttgagaaaacctcatgttgttttctatagtggctgcactaatttaccttcccaccaacagcatgttagagtttactgttctctggaacctcaccagcatatgttatttttttgtcttttcaatgatagcaatttattcaaattgaagcaagattgtatcacattgaagatttgatttttatttccctgaggattagtgatactgagcgtttttaaatttatttattggctatttgtatttcttttttctaaagaaaagtatagttagatattttgcccaattttgaacccagatttttttttactgtcaagttttttgagtttcttgtatattttggatactagtcccttattagatgaatagttgacaatattttctcccattccactggttttctcttcactcagtttgctgggcagaagctctttatcttaatgtaataccatttgtctatcatttggtttttgcctatgcttctgatgtcttacccataaaaatctttgtgcagactaatgtcctcaagcatttttcctccatttacttagagtggtttcataattttaggccttaaatgtcagtcttcaatcaattctgagtttatttcattatgtgctgttacataggaagctagtatcattcttctccatatggatatttagttttcccagtgccattcatttgaagagactgtccttcccccagtgtatgttcttggcacctttgtccaaaatcagttggctgtaaatatgtggatttatttctgggtgtgtattctatggcctttaccccaagaatcattacttcgtaaaatgcaattcaaattagcatgaaacatttgcagtttaaggaaaggcttatggcatcagaatccttatttacaggattcattattttgtgtttttttgagatatggtctttgtctgtcatccaggcagaagtgcggtgatgtggtcataattcactgcagccctgaactctgggtacaagccatccttttgcctcagtctcccaactagctgggtctagaggcatgagccaccatgccaagctaatttaaaaaaaaaattttgtagacatgggggtctcactatgttgctctggctgatctcaaattctggcctcaagtgatcattctggcacaggcttttaaattgctacaattacaggaatgagccaccatgcctagtatagagtgttatattattttcaaagtcttattctgagagccatttattgactttggcctaaataactcaatatgatatctctgaaacttttttttgacatattatggggaatgataatgagggaaggtggttagacactttttactaagagataacttagtgccatctaaggaggaacaaaaatgaattatcagaaaaataaaagtaagatgaagtgcaaaaattctgtggcaaagatgatgatagcaaataatatatttttgtgactcatggtagctttaactttgttcttaaaattctgagtaatttaagggttcacatttgaagaatccactgcattacggataacattttattgcaagtaaatgcatttcaaaatttgctattggttttgtattagattattctcagcctacttcattatcaagctatattattttattcatgcagtttgatgatcttacggcagagaaggaagctttatcttcaaaatgtgtcaatttggctaaagacaatcaagttcttcaacaggagtttttatctatgaaaaaagtacaacagcaatgtgagaaacttgaggaggataaaaagatgttgaaagaagaaatattaaatcttaagacacatatggaaaacaatagggtagaacttagtaaactacaagaatataaattggagctagatgaaaaggcagtgcaggcagtagaaaaattagaagaaatccatttacaggttagttttttaaatcaggtaagtttatctgtaatgtgctttcatttatttcaccgcaaattatattttggatatgtatatattatgtttcctctgcctctcttgtagcaatttgctttgtagagttctagaaaaaaaatggcatctgttttttcttttaaatatttacatttccattattattataacaaaatcaatctttcagagtaatgattctcactgtggagtcatttgatgattaagatcagttggcataagaaacaattgtgatttcaaaattatgtgatacttttgaattggtcttaagctacattgttcattaatcactttttaaaattatgaatggattctattactttttatatgaccagattacattaatactaacataattatgatttcaaatttttataaatcagacaattctgaattcagttattagttttgaacttgctgataaatattttaagcttcagcctcttttactaacatattcacaattgctctttgaatcactgactcaaaatgaaaggcaacaaacatataataattaggttataattgttttaaaagtgtattcttttcctttgttttaggaacaagcacaatatgaaaaacaattagagcagttaaacaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaaattaacaaagtaagtcaaaacatacactcatagaaaatgaattaagctcattaatttgttttgaaagcataatttttagtgagatggcttcaggagattagtaggaagtgaatgctaatctaataatgtaatttcagaaaataatgttagtaaataatcttacctttaaaatgttagtcaaggatagtttctgtcccatttctttctctctctctctctttttttttttgcttttgtatggcttttttcccctgaaaagtctcatgtagttaacctgatctgttagtttttgtcactaagtactttcgaagctttataattaataatgtgatcttgttataaaattgcttgtcagaattttcctaaatagaaatattaatgagtttaatttattttttggtagatcacaacctaaacccaaagtttcaagtggtactgctactccgggcacaatcatttttgattgtgatctttagtattatcactagagcgtgcctcaagaaagactatttgtgtaacattttcaagatgttacagaaaggcatccttgtgaaatagggaataattatcaaggaatttaaagaagtgtaattcacaaagtggttaaaacataactagaaataccatttgacccagcaatcccattactgggtgtatacccaaaggattataaaccatgctgctataaagacacatgcacacgtatgtttattgcagcactattcacaatagcaaagacttggaagcaacacaaatatccaacaatgatagactggattaaggaaatgtcgcacatatacaccatggaatactatgcagccataacaaataatgagttcatgtcctttgtagggacatggatggagctggaaaccatcattctcagcaaactatcgcaaggacaaaaaaccaaacactgtatgttctcactcataggtgggaattgaacaatgagaacacatggacacaggaaggggggaacatcacacaccggggcctgtcgtggggtggggggatgggggagggataacatttggagatatacctaatgttaaatgatgagttactgggtgcagcacaccaacatggcacaggtatacatatgtaactaacctgcacgttgtgcacatgtaccctaaaacttaaagtataaaaaaaaaaaaacttgttcagcctgaaggggtgtgtggaaggcagaaggaaaaagccccacctccagtgccttggtcacagtgctgggcgctaattgccttcagacatgctttagttctttttgatcaccaaccagccaatctagttctcccccaggagttgttgttctgaattattcctcagtgccaaatgcttaattgttcctagataatgggtgaaatgcacaagggtgaaacctaaaatttgtttgctaaacacaagtattcctaaatttttttgttgttgttcattttagttttcttaacctacattaaggagtacaacatgatgttttgatacaattatttctagtgaagtggttcttataatcaagcaaatcaacatattcttttctcacattgttaccctttaaatatgagtatttctaatggaatcttcagaatctcacaagtagagcccttttagaaggcagcaagtgttacctgtcaagccatatatcactgatagccatttctcttccctgtctactttgtttgtactgcttgttcagtataaatcaccttagaaacacaggtgcttctttagaatgattttaaaattatacttgcttacaacaggtatgctctcacacatcttcagtgtgaaaacactgtttagtggataatttggtttgctctcagggcaagtttttaaaaactgcaagtcattaagaatcattagaggaaaaatgaaatactaagcgtgtgtctttgctatctttacagatcaaataagaaaatagcagtgatcagcatgaagctccttatggagaaagagcagatgaaatattttctcagtgctcttcctacaaggcgagacccagagtcaccttgtgttgaaaatcttactagtataggactcaacagaaaatatattccccaaacacccataagaattcctatttcaagcccacagacttcaaataactgcaagaactcctagactgtggttagttacatgaccatttctcttttgggtttcatttctctaatataattcttgtttttaatttggtgaaatactgaattctgttgacttatgcatgttttgtaaagatcataattagctgtgttaacacagaaaggaaatgggaactttacattttttaattccctggagctctcattttcaagagatacccgtttactaactttattccataaatgtgactaaactgacacatttaaaatgtctttaaaagctgcatttaagttaggttttagaaattgcatattattgcctgataactgatgatatagtttgagatgctttggcttactctctaattgattatagtttagctgtggttcatactgcccccccttttttttaaattgagacagtgtttcactctattgcccaggctggagtgttgtggcaccatcttggctcactgcaacctccacctcccaggttcaagcgattttcctgcctcagcctcccaagtagctgagactacaggcacctgccattacacccagctaatgtttgtatttttagtagagacagggtttcaccatattggccaggctgttctcaaactcctgaccttgtgatctgcctgcctcagcctcccaaagtgctgggataacaggcatgagctaccacgtccagcccatgtcacttttaaagtttctttgcaccagccaggtgtggtggctcatgtctgtaatcccagcacttcgggaggctgaggcaggtgtgtcacaatgtcaggagttcaagaccagcctggccaagatggtgaaagtacaaaaagtagaaaaaaaaaattagccaggtgtggtggagagcacctgtaatcccagctactagggaggctgaggcagagaattgcttgaacccaggaggcggaggttgcagtgagccgagatcgtgccactgaactccagcctgagtgacagggtgagacttcatcttgaatataaaaaatttaaaaaaaagtttatttgcaccatctcaactcttcccacccataatcacaactgaatgattggcatccaaacagtttaccacatatagatgtttattatttagtagaatccaaaataattgcattttatgaattaaacaaaacactaaaatgttcatttccatttttatgttcaaagctttgtgcttggccaggtgccgtggctcacacttacaatcccaacattttgggaggccgaggcaggtggatcacctgaggtcaggagtttgagaccagcctggccaacatgatgaaacccaactctactaaaaatacaaaaattagcaaggcatgttggcaggcatgtgtaatctcagatacttgggaggctgaggcgggagagtcacttgaacccgggagacagaggttgcagtgaaccaagatcataccactgcactatatggagactctgtctcaaaaaaaaaaaaaaaaggtttgtgcttttcttacataagagtacatcctctgactataaaaatcctggaagaaaacctaggaaatactcttctggacttcatacttctcaattaatttatggcaaagtcctcaaaagcaattgcaagaataacaaaaattgacaagtatgatctaattaagctaaagagcttctgcacagcatgagaaactatcacgggattaaacagacagcatagagaatggaagaaaatattcacaaactatggatacagcaaacgcctattatccagaatccataagagatctaaacaaatcaacaagcaaaaaataaataacaccattaaaaatgggcaaaggacgtgaacagacacttctcaaaataacacatgtaagtggccaacaaacatattaacaaatgcttaccattgttaatcatcagaaaagtgccaaacaaaacatcagtgagatactatttcacaccagtcagaataacttttgttgaaaagtaaaaagaaaaaaaaaaagatgttggggaagcagtggagaaaagggaacacacaccgtttgtggcaatgtaaattaattcagctactatggagagcagtttggaaattaagaactaaggatgaccgttggatgcagcaatcccattactatactaggggtatacctaaaggacaataaatcattgtaataaaaagatgcttgcacatgtgtgttcattgcagcactattcaaagcagcaaagacatggagtcaatccaggtgcatccaaggcagattgaaaatccaaggtagattggaatgttccatacataccatggaatactatgcagccaagaaaagaacaaaatcatgtcctttgcagcaacatggatacagctggaatccactatcctaagcaaactaacacagaaacagaaaccaaatatctcatgttttcacttatgtgggagctacacattgggtgcacattgtcataaacctgggaacaatagacactgggaaataagaacagggagggacagagtgggccagggttggaaaactacttattgggtcctatgcttactacctgtgtgatgggttccactgtactctaaaccttggcatccctcaatattctcttggaagaagcctacacaggtaccaccttaatttagaatacaaactagaaaaaaacaaacaaaaaaaaaacaagaaaaatttactattaaaaaagtttactataagtagagaatagaaatttctttttaagataaaatttattgatgtaaaaaaattggattaaacttgtataaagggcagagttttgctaagaatttcaaagcaatgcattcattgaaaagatgactttaattatttaattttttttttttttttgagacaaggtctcactgtatcaccaggctggagtgcagtggtgcaatcttggctcactgcaacctccacctcctggcttcaagcaattctcctgccttagcctcctgagtagctgggactacaagtgtgcaccaccatgcccagctaatttttgtatttttaatagagacagagtttccccatgttggccaggatggtctcgatctcctgacctcatgatctgcctgccttggcctccccaagtgctgggattacaggcatgagtcaccacacctggccattgtttaacctttgtactaataaaacactacctttctaaaatcatgtatatgcagtagaccaatattaactgtatttttgtctgattactctaaacagcattacacaggtgcatcctctgttatctaaacttaaaataagtagaaattttactttatttatgtgattatttttctatttaagcaaacttcaagttatgtctagtcactaaaaatactaaaggtcacattttgtaagtgatacattatttgcatgataatgtttcttgtttaacttaaacattattattatttttacttattttagatggagctggactgtgtagaacaaataactagagaaacaaagagaagtatgttgccaaaatttattaattacatttaggtttattttagaaattaagtgtaaataacaaatggcattccttttcattgtttggttagtagatactatgtcaagtattttttttcttacacacatctaatgcaagatgtgaaaacaaaaactttcacagagaagactgtacttatgcactataaattcatcatgttccatagcttaaaaaattcccaagaagtctgtgcatctgttttttactggctctacactttcttaagttttgccatcatcatggaactgtcagccagcacactgaaacgattctcagaaaacaaaggcatcaccaagttctcagggttttggtacagattgaaggccaacagacctcagactcattttgaaattcttagctgggcaataacccttcataagcagtcacttgacaggtgacattttaaatctcctatcatatactgtgtcattggcttacatctgttctcaggaaaagttccaaatttttcaccatgaaataaaaacacccacgtcaatgtgattcttgtcaagttactcagccttgttttttgccacttaccgcactctaccctttgctctagcaccaaagtggaggagagtagaactccgcagggctcttcctcacctcaggctctttgccttcgcctcttccctctatctggcaagcttttccttgtccttcaggtatcaacctatgttatctcctccaccagaaagcccatgatattgacataaaagtgggatagatgtcccttttgtgtgttccagtagtgccctgctgtatacctgtcatggtatctatgacactatgtggacattgcctacctgtctgtgtttttaggttatagcatatgactattgggaggtggaccatgccatcttcatcttggaattccagtgctggttctagtaccttagcacgtggctgttgattacatgaatgaagaatgaaaaacctctaatatttaaacacaatagaattaatgccatgtgtaaattatttaatagtaattttgtattgtaaatgtacatagatatttctcattcttactaactctgataaagttctcaactctttagtatttaaactcacatttagttaactgaagtgttttaggtaaagaacataattctttctctttccagttgttgctgtgttgaacacttgctcccgtctacttacttctctataatccactggtaagccacatctaatgaagagaatgtttaaccataaagtcttaaggaaaaattttattatttaaaagattataaaactttattactgggctgtttacacaacattttaattgtttctcataaaatatataacattacaatctttactgaagtaggatgtttttgtatcacatgtgtgatgataatttatagggtaatttaaatgatgttttttagcctccttaagttttaagtggatcttgcaaatgaacaccagtattattgagtttgacgtactcaaattgcccaaatgccagctgtttaaacagccaaagaacgaagtcatcattgatactttagtaaaggtcatcgaaggcttctttgcattttacagcttttactacttaggggagttaaggagtacctgccaggcttgtgcatgctaatgtgacaattttctttttgtagttgaaccgtattttgtggggagatactttgaggctctgtaaatatccagttactcccagaacccactagatttagcatttcatggatgacttgtgtttgaacaattattactatgatggttgccagatgattattttcttctcttctttgctgtacctggagaagtaaaaccaataaataactgagaagggaaagctcatgattctggtgctccaattccccaagattaggccagtggtagacatttcaagctgacttcttgtcttttttatttgtcttcgttactctgtcagcacttttttagtttcaggaacaagatgttctaagctaatgttgtattttctctgctccagccatggaatgagtgatttttcttagaagcagaggtggagccactgaggaagcacaggcgagccctccccagcacgtgctcactggtccccaacagaacaaccgctgccacatccatgaggtaccaagaaactagcaaagggccttctggctgtctgggcacagtcctcatgtggtccctggctcagcctcaagggtcctgcattagtcttcctgtagcctctgtgctgtgtctgtagatcgggactctgtgggaagggccctgggatgcccaacagcacaagatgtctcatctgccaaatgtccctgccttcctcccactctgacactcaggaataggctacatggcatgtccaggcagtgccaggccacctcactatctcctttgagattggcccagagggcttttggggtgagtgtggagctgggcacctggagcctgaggccagctgtctctccctctgtcttggaggaaaagccatgtcccaaaaaaaaccccagggcctgacctctggacacacatacagggagggagggtctgtgggctgaggggggcattgtaatgagactttgagcacgctgctcaggggcctggtcagtggaccatgctcagagatgacctggtcattaggacctagtcagttgggacctggttagtggtggcctcctcagtaaaggcctcctcagtggggacctggtgacctagtcattggaagcccggttcatggggacctggtcactgatggtcttcttagtgaggcctgatgggctggaacataaacaatgaaaaactggtggggcctatgcagtatactaggggcctggtcagtgtggggccttagtggcttggagcctcgtcagtgagggtctggtcagagggggctcggtcagctggggactgatccatggaaaattgtttagtgggggtcaggtgagcagcgacttggtcaactgtggtcttgtcagtgggaacctggtcagtggggaccaggtcagtgggaaattggtcagtgaggtctggcctatgaggcctattaagtgtgagcctggttaggaagacatggtcagtggggacttggtcagtgggaactggtaaatggaggagtggtcattagaggcctcatcagtgggaaactggtcctgggcggctggtcagtaggaacctggccagctggccactgtgtgacctcaggcagggggtttgtctgtggagtctccttgcctccatctgcagggaaggtgagtcagggcaccttggagggtggctggaaagagaaggtgagaagatgtgttgaatccagcaccacttggcagacctacaactttacacatgacctgtgtgccacctagagggggtcccagccctctctgctgtgcctggtgcccctcctctctctgcatccccaggaccaccatgggtggggaaggcagagattggggagcacctgtagaagctctaatgctggccatgagccctcggtgatgacctgggtgcacctgtgagtggagaagctaggcctggccagagaagcaagagaaacacacacacacatatgtgcacacacacacacaggcacacacgcatgcacaaacacactgcatccacacatgtcagttcaggggatagaggacactgactctgggcgctgttgacccatgcaggctcccattgtggtgggttgtgtcaccccacaatgtcactgttgctgagcccccatcgcctctgtgttgtggagcagttagagacacactgtggtgtctgagtggctctgcgtgaaggaccgttttctaggtgagaggcacatctcaacacagctgactgatcagactca

SEQ ID NO: 547 - DNA, 1111 bp, Homo sapiens
atgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaggcggacaaggcccgttatgaaagagaaatgaaaacctatatccctcccaaaggggagacaaaaaagaagttcaaggatcccaatgcacccaagaggcttccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagaagaagatgatgatgatgaataagttggttgtagcgcagttttttttcttgtctataaagcatttaacccccctgtacacaattcactctttttaaagaaaaaaattgaaatgtaaggcggtgtaagatttgtttttaaactgtacagtgtctttttttgtatagttaacacactaccgaatgtgtctttagatagccctgtcctggtggtattttcaatagccactaactttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaagttgcagctgttttgttgacattctgaatgcttctaagtaaatacaatttttttattaaaaaaaaaaaagaa

SEQ ID NO: 548 - DNA, 148510 bp, Homo sapiens
tttacgcggccgcgaccggtagtgacgtcacgagatttggagctcgcgggaaaacttgtctctgcgttgtggggaggacgcgcgctcgcgcgggattttcaagcgtaggcccccgggaactcgagctgccatgagcctctgggtggacaagtatcggccctgctccttgggacggctggactatcacaaggagcaggcggcccagctgcggaacctggtgagtctgcgggggccgggagcgtgggagaggggaggccccccggctcggggtttcgcgcccccctgaggagcagtgcttctcccgcccgcattggaaggtgataagtgctatggagaaaaataacacagggaagggggaagaggtgtgggaggctggcttgtatttttaaacaagaaaagctccactgagaagtggcatctgagccgagacttgaaggaaattgaaaagtcataaatacagaaatccgagcaaagagtggaacaggtaagaggggacagcaagtgcaaaattcccgggcagggatgtgcacggcatgttctaagaacctcaggaggccggcgtagccgatagtggtgaaccagcgggaagggtaatcggagatgggtgtatgtgttgggatggagttggagtgcagacccagtcagtctcagaataagacgagaagccgttggagcattttgagcggagatgacaccatgtgatttactttctagctggcttaagatttctcgatgtcattgtcatttacaagtaaagtgttgtaaatatgtatttactccaaagatcgtttctaattctcaaataaattgtattaggacgttcctgagattagttttttttttttttttttttttttttgagacggagtttagctgttgtcgcccaggctggaatgcaatggcgcggtctcggctcactgcaacctccgcctcacgggttcaagcgattctcctgcctcagcctcccgagtagctgggattacaggcgcccgccaccacgcacagctaatttttgtatttttcagtagagacggggtttcaccacgttggccaggctggtctcgaactcctgacctcaggtgatccgcctgcctcggcctcccaaagtgctgggattacaggcgtgggccaccgtgcgtggctgagattagagctttgtgaaagatcctctcccctctatcctgatgcctctttgtctgttgtagttgataaaagtgcccaatggcaatattttgtgagaacgaactgaatcttccagggagtagagagtaaagaaggatctttaggagaataaagtgtctgtggaagacatttatccactccttttaaggaactcaaattaatatatgatgctgatggaaacgtttttgcccaataccctggttttcccttccgacctttcttagatttacagatactatttaattaagtgcgtcttaaaaataagaaataataagaaaagattgtacacgtaaaaatcattagactagttgatagtgttgtgacattgaaggtttttttttggtctctttattgatactgcatgtatactaatttaaaataaattgattactgcagtatccatcatttatagacaaattacattttccgtcaatagctttgtcttcagttttcctagtgatagaatacattttattttctgtggccacattttgttgtacagaatttggaatgtatattttggacatgaatttaatataatggtcttatgtgttaaatttgcttttaagaaatgttcacctgtttactcttttatttgcagcttaatcaaactatgaaacatttaaagcataacccttatttttgattagattgaagttgaaaaaacaaggcagtaagtgtctgtgggacacttgccattttccaggcagtatattagattgaatagttcttttccttgggactttttagtgacagagatggatgagtttacaaagtattaaaattcattgcaataagcgcttctcttaagatacgtattccattttttcaataatggttatttacagaacttcaccttacaagactttatgctcccgaggctaaggtctgtcacccactcatctttatagccttcatagcactggttcccaaaccagactgatcatcagaaacacccgaaaagcttttgcaaaactcatcatcagcagatactgttagtgccctacccagtcctcttgcttttaagtgcacacagactgacttctgacttctaactttgtacatctgtactttgcctgagggcttttctctctgtgacacccatagtagatttgaaatgcctggaattaatgctctttcttttcccccatccacttttctaagcaggcttcaagaaagaactcatcagagataatcatacggcagcttccccaccctttgggtgggttaacactctggtgggtgtttatgttggctttaagagtttccctagcaggatcaaacacagatacctagagccattcaacttgacaacacactcttactggctgccttcctttccctgtttcgcatccccactctcctatgaagttttcctttatctcacaagtaacctcccaaagaaaccaaatgcactgaattgttatcacagggactgtttctaatagtccgaagtaagaaaggcctgaatctcagagttacagaatcctaatctcatggatgatagggtctgttcattagtcagtcctttattttaaaaagttttctaggagattctgatagtcaggtttgggagttcccgctttctagcatttagttttgtatcttgcatgtgctgtcacgtatataagttatacaaaattagtgtcaggcgaatagtaaacttttcagcatatatatatttatatatatatatatatatataaaagatacacaatattttgtgtatctacccatgaaactccaagttttacacatatataaaaaattgggtgtatctactcatgaactgggagtttcatgggtagacacataaaatatttgttacttaaaaagtagtttggttctacctagagcagttcagtttgactagggaaaaatgccttgttcttttttttcaggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacagtaagcatttcactttgaggccctgaaagtaatttatagcggggactttcagtcttggtcatgtatgtccccccaactcagttgcttcctaatgtatgatttaaataagaattccacaggtagtcttggggcacaggatttgagagctactgatatggatctgttataaccagagcaaagccatttatgttagataggaaataagagcaacagagggtttggggtaaaatgtagagggtgagattaatttcagattacctaataagacaatgtcttagctgaaattagaactcaggtttccagacttcatttttctgagagcagtagtggggatggaaagaaagagaatgattttgagaaaaatgttaaacatggtatcaagtgacttggtaaagagtgggcaactgactgactgggaaaggaggcctgcaactctgggaagttgagaggctttctgtgatcttgcccttgccaagatgtccagctgcataccgtgtagcacattcttatgctcttccattatggatgatgtttaagatctagctgaaatgtatccttccttttcataccccattagaattaacttttcttctacaacttgtagtttgtacttttaatagtacttattttgttttgctttggttgtagtagtttatacatcttttactttgaaaagattgtatttgttttgactgtatgtcgagaacatatattcattttcatatccttcatatcttctggtaaaatgtctttacatattaggcattgaaaaaatcatatgctgagtgtggatggtagtgctataaacagaatcttcaggaaggtaactgggttttaggctaatgttgattagcatatatttagatacattgagtttgagatgctggttgtatgttgtggaaattcgtataaatatatagggacaaatttaacaaaaatggtgtggatgtgtcagaagaaactaatatcttatagagggacaataaacagccagtcaaatggaatgttgcagcatcttcccagatgggtggcttaatattttaaattatctgtttgccccaggtgacactataaatttctatgaaattctaattaaaattcaagtggttgttacaattgtatgaaatgatcttaaagtccgtccatatggaacggtacatttctgagactagctaaagtaattatgaaaaaagattagtgaagtagggcttgtgttaatgtgtagtaaatcatattgtatgtctattgtaaataaaacagtattatattggcatgaaaatagagaattagacaagtgaaactggaaagagagcttagaaatgtgatagaggtgctatttcaaatcagtggaagaggataagccagcagtgtgtcatcatagctagttatctatccagagaaaacgaagttgagtccctatgacatacaatttatagagataaattccagatgaattaaagacttaaaatgaaacactaaatatcttcgattaaaattttttagactatatgaattgctcctgggtcaataaaaccttttgtaggaaaacatggaaactatagaagaaaagtagatacctggatatatgaatttgaaaaattgctatgacagaaattatacataaaatcaatagaaaaagattgtcacaaaaatttgaaaggactgtgtaaataagagatttttacaaattggcaacagaaagacaatctggtagaaaactgaaaaatagattcttctgtaacaaatagtcacaggagaaaaatataagaggcattaaacacatgtaaggatgtttgacctttgtgatagtcaagcagtgtgagtctattatatactcaccaaactgaaaaattgaaaggcatgataaaacctactgtagatggggaatgttggggaagagtgttgccagtggaaaagtgaattgttaaactgttttatgaagcagactggtcaatacatacacacatacacacacatgtattatattaaagttagaaaacacattcccttcaatccagaaaactgggaatctcttacatagaaatgaaagcagtatatgcaacatatgtacagagatattaattgtggaattgtttgagttcagaaaacaaaatgtccatcagtatgaccagctttgcaacatccatgccataggttggtgtgtgactataacactgtgccaattgtctgagagggattgccaagatatattaagtaggaaaagcaaaacacagagacgtgtatgatttcctttttttaatttttattttttacaagaaacattgacactccatgaaaatacatttgtgtatgtttatttttgtgttaacatgggaaagactgaaaggaacagatcgtttgcaatgatctgtgtttcagatggtatacagatttggtttggggatttctggagataaggaaaagaaaaaagtagtcacaatgaaacaggatgtgtgattgacccaatttatataaaaacatgtttatctgcacattgagaaaagagtgggattaacaaagttaaaacatgaatggtggttatctcaagttttactttgtgtaataaaaggaaaaccaatgaaaatacaaaagagtggggaaataggcaataaataaatgttaaaaatatctttttctttgtccacagactccatctaaaaaaaaaattgaaattagcaccattgcaagtaactaccaccttgaagttaatcctaggtaagttactactatatagaaattaagtatttttaaagaaattggttttgggctttctttttttaaaagattgaaacccttttttgaaataaattgatacgtgtggaagcacagtttataaaacagactaaagtggagctgccctgcttgaaatgggaatcctagagcccttcctgttttgccttctgtgtcaaataatttcaacaatgtatttaccttttctagctctagggagctcattgatgtacacacagtacattgtattgtcagtaaatttttgttaattatgttggctcattcattactgatgagcagtgtgtctaaaaagtttacagtgtttggagtaaatatttcagaaattgactttgggttgccaaatctttctttgtcactctctttgtttaaatttcttgattagaggtattataatagttcaccaaccaatatctttattctctatatcatgcagtaataagaattaggaacttgttggagaggcgttgaaaattcatgcaatagctattaagcattaagtggtgtagaaatgattctgggagctaaattgggtaagctgctatgatctgtggggctgtatgagttcttaaaggagaacagaattgaggatattgtcagtcatattcaacatgggcagtgacatagaggcaagagtgaacatccatttcagggagagggaggagaccgaatggagcaggaggaataccattacaagctaatgtgtatcttgttttcagtagcaggcactttgtgagaagctttacctgtattattacatttaatccttaaaacaaccctaacagataggttttattattttctctaggcatctcaaagaaaactaagagaaataaggttgttgggaatgggtttgatcaaagaaacaaagggaatgttaattccagatacaaatggagaatgttttggattcttggctaggaaaatgatcgtaagagcaacactgtaggtatattgatctataataatagtagtgacttgggaaaacttagtggctctttgagaaaataaagttaactgctttgacctgtttttctcatcgtgagttcttctgaagcatagataagcaattggagaataagccgattgcttttggggtgattgaaattaacattgaatcagcctaaattgacttctcttggcttgagaggtctttgactgaagtgccaaagcaataatattggtgtaaatgacagctcaatacctataataagtcatcagtttacggagttttgactttgtgtcttaaactcaatttgcttatctcatcgctttactgagtctctgaatcagtttcattctagtgctgggagcagacttctctttgtttgttctctcttagatctttgctattttggggatgtggaagaggactagggattgaatttctgtttcaaagagttacgttttgtattttcaacaattatagatagttgagaaattagctataattaggtattaattttctatagtcggtacagaagtgtcaaagtatttgctaaactgttacctaattattagtagttgctctttttatgttaacagtaaacttaatgtaacaacatatttagtgttttcagtgatgttaatccaattggaatattgttagtattttcaatgaccctaaaactttttacttttgaagggcttataattatagttaagtgatattaattttgattaaaattttgaccacttaagaacttcaccatttttcttataataacaatattaagggcatactatataccattatttttgttttgtgtagtgatgctggaaatagtgaccgagtagtcattcaggagatgttgaaaacagtggcacaatcacaacaacttgaaacaaactctcaaagggattttaaaggtaggtgatcaaaagacttctttttatgaagctgccaagcattagtgctctctcttttttttgagttatgaaagtgaacaggagagaagcctgatctctgggctcatgggagtttatagtctaatggaattgaattttatgtgaaagaggattatttgtgccatccatttgatattttagaacaagatgaataaaaatacgtgatttaaaatcagaaattacatgattttaaaataattgttcttatgaccgagtcatatgttcattatcagatatttagataaaaaagaaaataatatcagctatattcccaccatccagagacagctactaataacagtttagactttaccatccaagcatttttttctatatatatggatacattcttactggtgagattttgtgataataaatatgccatcatttaatgcttttgatatattttgccaaattctctatctgaaagagggtatagatttatactaccaatagcagtgtttgggagtgctcatttctccgtgacatttaccaacactgaggataatttgttttaatctttgtcagtttgagtggagaagatagtgttttgttcttctttagtgagtgtgataaatttttcctttattgctcatttttattgttttgtgaattcgctgtacatattctcagctgatttctttcctcagtctccatatttcaaaataaatttacatttatgaatttattttttgctactatatatggagtcttatattttctgaatgttttatatatgtgagttactaacatatcctacttttatatcttgctatgttattaaattctcttactgtttttaattgtattttggtagtttgagtttttttagatgtatattaatgtaatctgtaaattgtttttcctttttccaatttttatggctctaaatactttttcttctctaattatgttggccaaccctccaatagtgtggttaatagtaatagagatagcagatgtccatgtcatgactctggaagtaaagccttagtgtttccccataattaattgctggattttggtctgaggtgtatgtatttgatcatggtaagaaaatattctcaagttcctattttattgagtgtctttaacacaaatgtgtgttaaatattgtctgatgcttctttttcatccatgaatatgcttttatgatttttctttagttcattaatatcataggttatattactggattttctaatattaaaacttttgctaggcacagtggcttatgctagcaatcccagtgctttgggaggctgaagcaggaggattgcttgagcccaggaattcaaggttgcagtgagctgtgattgcactactgtactccagccagggtgacagagcgagactatatctccaaaaaaaggcaaaacaaaactgttctgcatttctagagtaaacatgacttgtcatgttgaatttgctgttttctgcctaccaagtactgcttagtcactgtttcaaacatcactatacaaaataatgatatgtgtatgtaaatataggaaatattgtgccattatcctcaatctgttattaatattataagagaaatgttgaacatcggttattataagaaatttagttgaaatttaaaattttaatcaaaattaataatacctgattacaattacaaacctttaaaagtgaaatgttgtagggtcattaaaaatgtgaacaatattttaccacccaattacagttgaattaacctattcttacatgaagcttactgttacttaaaaagaacaataactatgaattaagtaacagtttaggaaataatttgtctctttcatatccataaagatgttattctgctcctctgctcgtctttcttgcataactgttgaaatttggccatgatccttttgtgttggtcattttgttaaaagtaaagtgatttttcctgtacttagggaaggagaggaaggccagagagttttttttaggtctggggctctacagctacctcttgtattatttttacaaagtgataaaaaatatatgacactttacttaaggccaggaaattgagaccaacaagacccgatcttgccaaaggaagaaaaaaaaaaaattaggctcatgcctgtagtcttagctacttgggagctgaggtgggaagattgcttgaacccaggagtttgggattgcagtgagccatgatcaagctactgcactcccgcctgggtgacagagtgagaccctgtctctaaaaaaataaaataaaaaaataaagtaaataaatgaccttgtgttctgagctctattccctatcttattttctgtcacctttattgggattctttcctttgtctctcttttacctgttctcaatttggtctgggatttcttctcattgtggagcattgtcttagtctggaactcctgtcctcaagccatcttcctagctcggctacccacagtgctgggattacaggcacaagccactgcaccagccacagccacctggaacactgtcttagaagggaacttcattttggtattctcagagtctgctgttctgtcaaaccttactgcatcagggttcccttgctctcacccataaattgggctctgtcgaatctcccccctcggtaagactgctgctttctttgagacagtgtctcactgtgtggcaacaggctggagtgcagcggtgccatcagagcttactgcagccttgacctcctgggctcaagtaatcctcccacttcagtctcctgggactacaggcacacaccaccatgcccggcaatgttttgtatttttgtagacatggggttttgctatgttgcccaggctagtgttgaattcttgggctcaagggatctgccttcctcagcctcccaaaatgttgggattacaggcagattacaggcatgagccactgtgcctggccaactgctgctttcaaattggccgcaccatggtttctagtatgttcccgtgggtgattttgagcttttcctgtcataaagtctgtcaaaatcttcctcccacaccgttgctgatactatgtgggcctttccagttttagttgcttattctcacttgctcatgtttggggttcttgggtaaagcttgttgcctggtttctgtataatgttcatgggttctttgttttggaatctttagttgttctgtttatttttatggggcagatctaaatgctacatgctgccagttcatcttctagaaataatttgttaatataatgaaaaatacaatattggattcagtttctgtgtatacattattcctgaactatgttaaggctgatctgtgattgtggccagatggaatcttactttatggtggccagatatcctcatgccttgttgcctacatctcttgcaccactgtcttccaaagtctattccttggaatttaatattttagattaaggtgtaccacagaaatgtgctgctgagtaaagttattttggggaaatgcagcacagtacttccttgtcttggtaaattttagcgcatataaataataaaggttgcaatgatttctactacaaagtgaccttttaacttcatttagcctagtgtttcttggtcttgtttgattatagattcttttcttttttttactagccctgccaacgcaaggtctcacaatattaaaaactcagagctgttcctctctatagaagtctttagtaaaaggcaaaatatttatatgatctgaagagaaactggagtatgattgtagcattttaaaataataaagtaattttaccatacttataactttatctttgccaatgggaagagtagtatatcaggcttattatttaggatttcatcctggataatgagaaggaagaaagagacaagttaaagtttgagtgaactcaagttaaagtttgttttgtttctctttgactcagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatgtaggtcaagttacacttttctgaaaaataaatcagttcagattctctgaatattgtatgcttgttgtaaaagaagggaatcgtatcagtaatttaagaacacctacagacctggatgcaaagcattaatatgtgaacaaaccaaagcgtatagttgtaaataccagatgccaatatatagaaagtgtttttccctttaaaccatctttactttgaacaagtaggtattacgaattctactaaactaggtaagggctagttatttactgtcttctttctcaagctgatttagttggctataagaggaggctggaatattgaggaaacagattttgcaaagagatgatgtgggaatacctagtccctaggaagggaattaaagttagtatgaaataacattaatatgaatatatatacatagatatatttttttctccattcttaacagccatcagcaaaaattatgattcctcacattaaatatctttccagcttttaatagattttgggagatttcatgcaaagtagggataatatgcaacattgtgttagatgcagagtggtaagttacttttagtgtaagtttcacttataagaattttgagagtaatacagttataagggtctaggaggatatcaacagaaatgaatcttaatctgctttttaatggattgcccatttttgttaattttatttgtagatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacagtgagtggaaggggtagttacattctaggactttggcccccaagctttttggcaccagggaccagttttgtggaagacaatttttccatggactgggcaggggtgggggatggtttcaggatgaaattgttccacctcagattattaagcattagattttcatttggagcgtagatcccttgcataagcagttcacaatacggttcacgctcctatcagaagctaataacatcactggtccgacaggaggtggaactcaggccataatgctggcctatccgctgctcactcctgctgtgcagcccggttcctaaccgcacggaccagtggttggggactcctgttttaggacataagcacacttctgtttaacttcttgtgttctctttttgtcatgtagatatccttttactgcagatcaagaaatccctgagacagattgggaggtgtatctgagggagactgcaaatgctattgtcagtcagcaaactccacaaaggtaccagtataaaatgatgacagtaaagctttcattatcaggatatcataggacacatattaactattttatgctaatgtcattttgaattataattaaatcctgaatctatgtattaactttttaaggaaaatgtagcatttaacttcagaaatttagtggttcagaatagttggtgtgtgatattatggcttttattaagctgtaatatcatggcttacatgtgatcatgtaaaagtggaatttatattaattttaattttccttttaggatctcagattacttaacattaacatacaacacaaagctagagataatgtgcgtagctttctagtaaaggacaatgtaaaactttgtaatcaatgatgcatcatgtgctagaaagacaccagactataagtcagacttctagttcttgtcctgaactcctagctaagtgttcttgatcaggtaacttcattttagagttttatcttcatttgtatattgaagatattattattgcctcaccaagggtacttttgcatttgttgtgaagagcaaaagagttattaatggtttgaaaactaaaaaaccctgtgcttatagatgaccatgcgttctactaaggatagcattgtgtatataccatttttactcaggaagtattttttgacacatttgctcaaaattgcttccgttacttctgtaggtctattatttgtaggttgaccattctgaaaatacctcagctgctagttgtttgacttatggcagcttcgattgagaaacacagtttgctttcctccaaataaaaaatgacaatgttaaggcccactaactttggagagtatgaagaaggttcctcagacttggctaaagcacagtctcatatccttgttgggtttctgaactgagaaatgatctttggaccttacagagggtagttgatcattttagggttcagaataaactgagttcagtctatagactgaatagactgcagccaatagagcttactcttccttggtctaatgaaaataatagaggaatatgccatgtttctccttttgttgatacatctgatgaattctaattttttaagaaattcttcaaaggtattgtaacatgtattccctggttaccatatagattggtggaggtggatagtggatcatacatagtgggtacttagtatttcatttaaggtttgctttgaattctcagaattcaattattttagttgaagaaatcgatagttttctccaagaagtaccaaatgttataagtagtctcattagaaaagaaacttcatctttaggaaaaatatgttcattttattttgtaaaatgttgattatcaataaagagacctcaccctttaaagagataaaattcaaataaagcatgtcttaggtgccttttacttttataaaatatttctacactgaagatgactttcttgtttttgttctgatattaaagaagaaaaattgatagcaatataacttacctacttttaggggatttaggtacttgaggttgtaatgtttgataattatcacgtgcttttataaaactacttgattattcctttgcttaattcttctagctgctgttacaaatttcttctggttttcctaacacattttgacggcttataaatgaacttgtgcaggaagcggtgctcctgtttcctgtttaaaccaacaattgtaggaattgattccattgtgctacataaaaagaaattttgctcaattccagaaagccttggggctggccagaaatcctggaagtctggtatctttctgatcactgggctacacaattccaaatgattacttctgatttctgactcctttgtcttgctggaatatttgtggtctcgatttttcatttgatctgtcttagaacagtcataattttctaatttgaatagcagcgaatatttcatgaatgattatgtcagctcttacaccgtgttatttaattgatataacacacctatgagaaaaatattaactttttagattaaaaaaaaaaccctgacatttatggagattaggtaccttgttcaggtacattccattattataatagagacagttctaggatacccatgtttctctgacagaagagtttgtactcttaatcacttgtaagctattaggaaataatgacacagacatggtaaatgtagaatatgttaattttgtaaaacagtaatgttagaagttaactcaagactaacacaagatgcatgttaacatgtatgcactacacacagtatagttacttcaattgtataggtaactacatcctgaatcaacttttcagaagtaagctatatacatatattaaaataatttcataccatatgaaattatttttattattcatgctttaataatcaagttttattcttgggatgtcagagaaatcacaggcttttgagtcaggcctgaattcaaatgctggctcaaatacacaagtcttgatggaagcctgacctgtctgaacttcaggtttgtttcagtaaaagagcatcattgttgtggggaattaatagtgtattgcagcgaacctagtacagaattaaggtgttaaatactttcacagacattggaaagggtgtggactttggagtaagaaagatagatctgtgttaaatcatgctttgctgtggtcagttctgtcagttacttaaaccatctgggccttagttttttcatctgaaataaatgggctagtgtaagtactgagttaaattatttgtttcaattcttacacatagcagatgccccagaaatgctagttctttttttttttcccccactttttttaagatttaatgtgccagggcttcatattcctgacgtcttaggattgacttctgctttttaagaattcttataaatcactacctggatttatctgaagtatggaacatctgtactgtgtgtatatatatatatatatatatatatatatatatctgtactgtaaaaattcagaagtttttccctttaagaatgtgtatttggaactttctctcttttttttttttttctgttttaaaacgtcatatgtacatttccctcctcttcccctttctctccctagaatatgagaagggcctagaatgaaggactcagaggtttgaatgttcctattcgcttagcctggttgcgtgcttacctgtaaacctttgtgccgccccttttatgacagggacagctctgtatccctgccacattgcttttttactgtgcaatctaggcagtggcattgtattatatttcatgcgtatattatcttgtgtcacctatgtaattgactttttaatcttttcatgaccatttcctggatgtttcaggtatctgtctggagaaaagaaaaacatattacttgacatgtcattaaagtttgttaaattccatggtgtgaataagctcaacccgcgctcttcatgaagtctcaatttctatctggtattttcatggtgttttgatataattaggaaccctgaatatagacgtctcattttaaaagagttctgaaaatgttctgtttcaaaaatgaactgaagttaggagaagcctccatatgtttatcctaagtatggtaaactatttaagaaacagttattatttcttactggattgtttgttaattcataaagttaggtcataaagttgttaattctgtattggattgtttgttaattcataaagtaaaaccatacagtgggaatttggaaaaattacctcttattttcttcacaaaataccaattattttgttttatgtaggctccttgaagttcgtggaaggctgtatgagcttctaactcattgtattcctcctgagataataatgaaggtaacccaatttcagatcttgaactttttacagctataaaatttggacgctgggtgtgtgatcatagggctttttgcagtatcaagatatcacctctttctctccagcgcattaattgcacgtatttactgaacctctatggtgtgccaggcactattagaggaatgctgaagaaaagaagggagggcctgcctaaagtgaagttatattctagtggtgtgaaaaggagaacaaataaagaagagaatttcagagtgttgtaagtgctgtaaaggaaataccaaggtgcagggatgataatggagggtggggctacaaagaaaaaagtgaagttccacccatccgttttcacaaaggtaaccacttttaacagacctcttttctattcacatagaaacaagtacgtgtatatatgtggtttcacaaaacttctcagttttccacactttagtatggatgttgtgtcatgaccatatgtatagatttacttcgttctgttaatggatgaatggttttctgttgtgtgactgtatcatagcttttccgaatatgacctccattggtggaactttaggttgtctacaaattattattgttattataaatagtgctgcagaaagcatccttacacttatatccttgcactttgtgcagttaaatatttggaatttagaatgtggttgatacccaccacatttttatgtcatggaaaaagtacccaaagtttttgcttttggatgaaggtcgttgattcacataaaaaattaaagatctcacacatataaagagagtatgtttaactttagtctttttgtgaatgggagaaataaggcatgcttagctgtttttattaatgatttttaaattactgattatttttgtttagggccttctctcagaactgttacataattgtgatggacaactgaaaggggaggtggcacaaatggcagcttactatgagcatcgtctacagctgggtagcaaagccatttatcacttggaagcgtttgtggccaaattcatggcactttataagaagttcatggaggatggattggaaggcatgatgttctgacttctgtcagttattcttgcaaagatttctcagtatcagtatttacatacagcttatattaaaagagctgtgggtaaattaactgaacttaatcatgtcgtatttgcgtttttttggtaataacttctctgtgaactattaatcatcctctgagttaaataattgctcctatactattgaagtatgtagttttgtacataacttagagactttagagtctaagaaaatgatcttaatttactttaagcattggttattcaagtattcattgttgatcctcctattctcttccgtctaatctctcacctgctaaaggagatttacacattagaaagcaaagattattttcatttatccagatgaccattttctgccacaggtaacatgattgtttgacacaccattatatttaattctagtttctctcaatgaataattgtatttttgtaggaaatgtaagatttcattctgaaacataattattggtatggacaaaattgcagataccatttctgttgaggctgcagatttccaacttttatttcagtggttcagattagtattaggtcggtactaagaaataagcatgttttcactaatttaagtacttgagactcttgaagaaaattcagaatgaagttctggagaaaggtatgttactgtagtaattactctttgaacaggttttgtgttttgtcattagctctgccctttttaattaaatattttggttcatggaccaaagggtttacttgacaaatttgtgtgacagactccgaacaattcctttactacgaagtataatttataaaataaaatatacccattttaagggtacagtttgatttttgaccagtgaaactatgatcccaatcaaggtatagatgccgtcaccccaaaaagttccctccatatccctttgcagtcagttcatccctaccctggcccagatgatcactgatcttgtcattatagatgagttttgccagttcaagaatttaatggaatcagatattgtaagcattcttgtgtaatacttcattctctctcattattgagattcatccatattgttgaatgtttcactagttaatgtttattgttcaatatttttgtatatacttttaaagcctattcacttgctgatggatctttggtttgtttccaggtttggttattatgaataaagttgctgtgaatacttacgtgtaagtctttttgtggacaggtttttatttgtcttgagtaactacgtaagagtgcaatgactgggcatacaatattgtaaacattaacttttaaaaagttgcttaactttcctaaagttatattactttacacttctaccagcaatataagagaattcctgttgttcctatagtattggttttattgactttctatgttgttgtccatttatattttattaccttttttatcttctactttttccctctacttatttttctaggttatgtacttggaaatttagataattaactttagactattcttttctaatataatttaaagttataaatttcactctgagtactgattaagctttttaacattctcctacaaatgttgatattttaggttttcatttctacttagttcaaacttttctgatttcacttgtgattttttttttaaccaatggattacttggaattgtgttgttcaatttccaagtccttagggattttccaaatatatttttacacctcctctgtctttcttagtttttagtctttcactgagagaaatattgaaatctccctccataattatgcatctgtctaattcagttcttttggacttcaagcattttgaagatcgttcttaggtacttgaataatatcttgatatattgactcctttatcattatgaagtgcccagttgcttctctgtcttttggctaagatcatgtgtatgaaatgcccttttttatttctaatgatattccttactgtgaaaatctactttttttaatatttatgtagacactccagctttcttttgattagtgtttgcatggtaggagtatttcttatagcgtacgtctgctaacaattttctcagtttttgtttctctggaatgtagtttaccatttataggattcttggttgatttgggtgttttaaacccccaccactttgaatatgtcattctgctgccttcacgtttctgttgtttctgatgacaagttagccagtagtcttgaggttgtttccttttacataatgagccaattttcttttgcagttttcagtatttctttttttctttggcttttagtagtgtatgatatgtctacatgtagttttctttgtatttctcctacttgggctttgttgagtttcttgaatcagattattatgagttgtattagttgctttgaagtatttgttaaacatctggctccactcagagtcagtttcttttggctgctttttctcctgtgtactgttacacttttcccttttttccctgtctggtaatttttggctgaaaacttgacgttttaggtaagatattttagcaacttaggattctcttttgtttttctgacgttttttcctcctgatggtttttcttttttttatttcatggattgcttagatgtcagctgtgtaatttgtctccaccgcattgtgcaatcactgatgtttctgctcagtcgcttttattttagcctggctttatccttctgtctgtgtagtttagtgaccaaccaatgatgtgaacagagtttatacttagacatcatgagactacaagacaactgaactacatgtggaatgaggaatgcattcaaggttgcaaccagtcctcagtaccccttggtttttattttctagtttagccgtccgtcagttatatgtgtgagcttagcttaacccctctgtggttcttccacttctaggatctctcagtttaatttctgatttgtctgtcaatggccatgaactaggcctgcaacttagggctagcaaagctattgtatgggttttccccatcctttttgaaccaagtctgccatttttatccagcaaagcaatgagttttccttgccccgatgttgaatcaagtccactgctctggctgcatccagccctaaacttataaagctacattttttactggccaagtgacaggtgtatggttgtatcactaggcatagagggtcataatgttgctgccatttttacctgcagctgataagttttgaaataatagacattcttcaatttgttgtgtgactttgatcaagcttcagtgtactgaattggttgttttttgacaattttgttcacttctctacttaactgtagtgggaaatcacccaatatcttcctgtttccattagtagaagtagccatccactgattgatttcttcattgcttttgtagactcaaatttcagtctggcatcatttattttaaagcccgaaaaagtttatcatttcttgtgaagcaggtctgctggtgaattatcttaagagttttttggcttaaaaatgtctttgttttgcattccttttggaaagcattttcaatggacaaaatacagatggtttcaaaatacaaaatacagattaaatactgtagtttgacagtttttcttccccatctgtgttttgtcttctgggttgtgttgtttctgaagagagatatgtagtcatcatatttttaattttattttgctactatggctgcttttaagatttccaacttctctttatgactagtttccaacagtttgagtaagaagcgtcttggtgcgatttgtgtgtgtgtttatcttgctttacactactttgggtttgttgcagtccttgatttatgggcttttgtattttattaaattttgaaaaactgattttgaatatttttctgccccttcctctaagactaattacatcgttatttggtagtgttgcataagtcacagagtctctctttttcctagcttttttctcactgtcctacagtttgaatagtttccttcaagttttcagctctggcagtttcatttgctgcttttttatatttctcattgtttttatgtttctctttaaatcttttgaacatatttataatagctcttctgaagtctgtctgcttattatatctgtcatttctggatctgtttctattgactgatatttttcctggttgtgggttagatttcttgcctttttgtatgtgcattaatttggattggattctggctctctcattattacattgtcatgttacattatcaagtgtctgaattcttttttttgtgtgtgtttttttttaactgttggactttgtcttggcagacaattacagttgatccttgaactacagaagtctgaactgtgtgtatccatttatacgtagtttttttttcaataaacaaaaaatttttttgagacttaatttgaaaatactcatggaaaaatgcataacctagaaatatcttttaaaattttaaaaaggtacatcataaatgcctaaaatatgtgtagctactagtctgtttcatcatttactgtgataaaatatatacaaatctagtacaaaaagttaaaatttatcaaaactttcacaaactcagaccatacatggtgccattcacagccaagagaaatgtaaacaaatgtaaaattcaggggtcctcagccccctgtggcctgttaggaactggggccacacagcaggaggtgagcaaccagtgagcaccagagactattaccacctgagctccaccacctgtcagatcagcaacagcattagattctcataggagtgggaactctgttgtgaactgtacatgtgagggatctagattgtgtactccttatgagactctaatgcctgatgatctgagatggaacagtttcatccttctccaccccttcctccagccttctggggtccatggataaattgtcttccacaaaactggtccctggtgctaaaaaggttggggagtgcagtattaaatcataactgcataaaattacagtacatactatgctgcctgaatacttctgtagccacctcctgttggtattgcagtgagcttaagtgttgtattcatttaaaatgccatgtggtacctttacagattgaggtctaaagctgtggttgccctcaatttcagacagtgtattcattttgaagtatcagtacagtactgtaggtgtaatttctcttccatatcactcaatattttctgtagcttatataataatacagtatataagacatatacaaaatgagttgactttatgttattggtaaggctttcagtcaacaatagactattggtaattacattttgggggagtcaaaagttatacaggggtttttgactgcataggggtctatgcccttaactcttgcattgttgaagggtcaactgtatttgattatcagcttgttgtttttcatgcttgtttgtaaacttttttggagtaggcctggcgtagtcttgagtcctaatttagctttaaaataggggcatgatatttctagggtctctactgcatgtcctggagatcattggggtataaccattctgggtcaccagaactcaaatatcttccagccttgtgggagctctggaaattattcagcttgcagtttttattttctccatggttttagttacccatggtcaattgcaatttgaaaatattatgtggccaggtgcggtgaccatgcctgtaattccagcactttgggaggctgaggcgggaaagttgcttagcccaggagcccgagatgatctgggcaacatattgagaccctgtctctacaaatgataaacaaaatagaaaattagctgggtgtagtggtatgtgcttgtgggcccagccgctagtggggctgaggtgggaggattacttgaatctaggaagttgaagctgcaatgggctatgatcgtgccactgcaccccagcttgggccacagagcaagagcctgtctcaggaaaaaaaaaaaaagaaaaatccagaaataatttgtaagtttcaaattgcatgccattctgagtaatgtaatacgatctaatcttccaccatcctactccatcccacctaagatgtgaaccctctttgtccagtggatccagactgtatctgctacttgcgtgttagtaatcaaccaaagataacaaggcaactcttaacgtaggagtgcttttctgtgtaactcccttctttccagatctctgcccaacataggcagccacctcagcctctctgaattctgctccttttcctcaactcactgttatcacagttctctacctgggtttttccttcctaccctgcagccaaatgtagggtgggaaggaaggtttttctttcccaccccgcagccactttcttccaggcagaaagccagaatgatggtatagagttgaccttactggttgctttatatattttgtccagttttttagttgtacagtgggagggcaagcccattaacagttagtggcagtataagtcttgaagctaggattctaacctaaggccctggtttccatgtgtgaatcagtgttttatgccattctttaaaaatctatgattttatgtttcatataaattaaaaatttgttcatgggatttgtagttgtgcagtatacatcacaacagaaacttgtagttttaagtgctgttttacactctgagatttatcagaattgagtaatagtacattaaatattatttccaaattatagcacttaatcacaaaacacattccttaaaaagtaaaacaaaaaaacaaaaaaaacctcaactcttggcagcaattttctttgtaccttgttcccaagtaaaacatagtcatctcatatttttcaaattgatgaacagatttctctagctatttgctcctgtttttttttttcctgtttacaatttctatggaaatttggagcattatcacaagatgttctctatcagtttgattatagtgtacaagatttacaataaattactttcctctctgcagctttgcaaaaatagtggtctccacaaacctcagctcctatctaaattgcagcctaatgccaatttacaaacactatatggtacctttgtggcttagtagcttatgctccttttgcagttgtttaattagctgatggcccactgaagttaccttctctttaatatagcagcaccagaaacttaagcaacttcctgaagagcagctgtgcaaaataattactagctgtaggcatggaaagagcttgacacagtttctctagaataacattaagtacctttatgtgaggcactatgctagattcttcacaggcattctctcatttaattctcctaacactctttgaactagacattatgatcttgttttgcagatgagaaactggatccagctgatcatgggtgccactctaataaattcacagctaccaaccaagaaatgggctgtcaacactgcccaacggacatatgtttctatgatcaagtctccacaatgcctttttcaaaacttaatttggagcaaataattttaccttcttgttagctaccgaaaccaaatccatatgcagcctatgttaccatatcctcatttgtatgcatcctgttgactatatctacatttatatgcaacctatattctcctaatacggtagagaagctgcccatcttccttgttaagcttcccatcttgttgggtttgttctatgttgattgtctttttcttttgatgattaatcatgtttttctacttctttgttgagtaattgtgaatagtatctagtggttatgaatgatctgggctttagagattacagaagaaagtatttgcagaattagggttcaagctctcttgttctctcttttaaaggattgcctctatcattttgtagcagcagtggctgccccctagtcttctggttctttaatccaataagacagtaaagttttcataagagttttagctgcccatgttagtgatgactgtggcctgccttcaggctaaatgccttaaaaatgaaaaactctagtgctctgcccaccttccaattgttgattaccttccagtttctgctgttcttctctctccagcagttgttttttctactaccgttttatcatttgttttctggttgttttgtggccttccttccctccttcttgcttgcctgcttacgtgattttctcagtggtgtgtttcaatatcttgctttttcttgtttgtgtatctgttgtaggattttttatttgaggttgctatcaggtttgcaaataatataactcattattttaaactgatgacaatttaacactaatttcaaaaactaacagagaaaactaataaaaattctacaatttaacttcatcgcttctgctttttaacttttggttatttctgtttatatcttattatactgtctatgttctgaaaagttgttgtagttatttttgataggttcatcttttagtctttctattcaagatatggatagtttacacaccacaattacagtgttataatattctatgtttgtctatgtacttactattgccagtgagtcttgtaccttcagatgatttcttgtttctcattaacattcttttctttcagagcgaagaaatccctttggcattacttgtatgataggcttagtgttgatgaaattcctcagcttttgtttatctgggaaagtctatatttctccttaaatgtttgaaggatattttcacaggatataagtctaggataaaatatattttccttcagcactttaaatatgccatgccactctttcctgcctgtaagatttccatagtgaaatctgctgccagacatattggagccccattgtatgttgtttgtttcttttctgttgctgcttttaggatcctttatccatgacctttgggagtttgattattagatgccttgagatagtcttatttgggttaaatcttggtgttctataattttcttgaacttgaatgttgacatctttctctaggcttgggaagttctctgttactatccatttgaataaactttctacctctatatctctctctaccttttctttaaggccagtaactcttagatatgccctcttgaagatattttctagatcgtgtaggcatgcttcattcttttttattcttttttcttttgtctcctctgtatattttcaaatagcctgtcttcaagctcattaattcttctttttgatcaattccattattaaagggctctgatgcatttattaataggccaattgaatttttcagctgcagaatttctgtttgatttttaaaaatttttcaatgtctttgttacatttatctaataggactctgacttgcttctctatgttatcttgaatttcattgcacttcctcaaaacagctgtttggaattctctgtctgaaaggtcacatatctctttcacttctggactggtcactgataccttatgtagtttgtttggtgaggtcatgtttcctggatgaccctgctgcttgtagatgttcatagatgtatggacattgaagagttaggtatttattgtagtatgggcttgtttatacctgtccttcttgggaaggcattccaagtgttcagagaaaattgagtgttgtgatctaagtctggttactgtagccatatatgcattagggggcaccccagtaatgctgtgactctttcaggctcatagagatattgccttggtggtcttgggtaagatacaagagaattccctagattactaatcagagactcttgttctcttcccttttctccagacaaatggagtttctgtctctccatgctgagttgcctggagctaggggagaggtgatacaagcatgcctatgaccactaccactgggactgtgctatgtcaggactgaagccagaacatctctgagtctcacccaagacatacagcaaatactgcctgggtacaactgatgtttttcaaggcccaagggctctttagtcagcatattatgaattctgccagagctgggttcttcccttcaaggcagcgggttcccttctggcccagggtgtgtctacaaaggtcatccgggagctaggtcctggaatgaggccctcaggactctaccaagtgtgctgtcctactgtggctgagcaggtctccaagttgcaagacaaagtcctctttactcttccctcccctctcctcaagtggagggaaggaatctcttctgcagctgcaatttgtactgcctgggattggaggaggggtgatgcaggcactcccttggctgccctggctggtgtctcactgggtcttgtgtatcccaagttggctgactcaagcacggtacagcaccagagcttgcccaggaattgcagtcttgtggcgtagactgctattcaagtttatttaggaccccagagtgctttagcccatgatgatggtgctagctggaactcagtttctgcccactgggatagacaattcccctgtggttagggctggtctaaatactctctctgtgggttctgtcatgtgttgctctccactgtgacggggaagcactgtccagtgcacacagattctctctttttctttttttttggtggagtctcaccctgttgaccaggcactgaagtgcagtggtgcgatcttcgctcactgcagcctccgcctcctaggttcaagcgattctcctacctccctctcccgagtagctgggattacagacacctgccaccacacccggctaatttttgtatttttagtagagacggggtttcaccatgttggccaggcttctcttgaactcctgacctcaggtgatccacctgcctcagcctcccaaagtgctgggattacaggcgtgagccaccatgcctggcctacacagattctctctgcaccatgctgcagctgatgggggatgagagaggggtgtgtaggcaattcaatactgtctttcctaccttctacagtgcctttttctttaatacagtgttaaaatcaggtactgtgatcactcatctgatttcttgttcttacaaaggtgctttcttgtgtgggtactaatttggtgttcctgcggtgggggagggggataatctctaggaggtgctatctggccatcttgcttcacctcctcctccagcagttgctttttataagtttgttcaaagcttatagttgttatctactgtaagattgtcagccataccagaagcagaaattccatctcattgttttataaatatggtcaagtatctcttaaaaaaaaaaaatcattcatatacctcacatcctcatcttgcaccctctctttctactctttacacattttttaagtgttttctgttcatattgcctacattttcttagtttgcaatccattttaatctggttttccttcttataacttcaaaaatacagtttagtctaaaagggatgtatgtatgtgtgcatctccatccagtgaattcttgctctgtatccagtgaacttttaattgacctcagcaatatgtgttgccctttcttgaatctcctttttccatggtttccctgagacaaatattctcttgtattttttcgcctacatctttggctgctcactttacaggctttttcttaccaagccatcaaatgtggaatatagctttattctcgactctctgctgctcataagattctctccctgggtgaccttatacatgcccaaggctttatataccatctattagctgttaactccatttatatgagctcaaactttagctgaatttcacacttatgcatctaaacacctatctgacgttcgttcacagatacttcagagacatctcaaactgaacatgttccacactgagcttttgatctcttccagcccaaagtagacctttcccattgttcctttctcgatgtcatcttttctgattcttttccatgttctacagcagtggggattatctggggttctacctaattttctttattcaatgatcagcttaatatctgtcttttccatgctccttccccctttctacttctgttcatgagacaactcagttttgagttcaaaaagagtacatgtgttgatgattcccacatccagacatgaggtgcttttcctaatacaaccatcagccatttcaattttggtttatctaaaacaaattcaccagcatctgttaaaccagctacttctcttagcttattgcttgtgtcagggtactacttttcttctagataccgggtgtaaacctttagcatgtaagttgacccctctctccattttgacagtcatttgtcaagctctggcctttatcccttgtagatggatgttgctttcatctctccctgtatttgtcatcaaatgaaccataacaggcagactagatggactcatggctaggtatactcagatgagcataagagatttaaaccaaaagcatgggtgtcattcaaaacagctatttgtgcatttaaaaatcaataattcttcatactcaacatggcaagtaatttctattaaaaagagatagaaatgtaaatatttagatttagaccactaagggcaacttctatccattcatttgttcagaaaaatatttattgagcacctgctgtttgccatggcttttttaaggtactggggatacagcaggacaaaattgacatcagtttcctttgtggagtttacagcctatcacgaagagatgaatgcaggatgatagatagatagatagacaggcagacagacaggcagacagacagatagataaactgataaaatattctatgtcatgtgtgctgtggaggtggagaattttggtttgttgttttaggtagactgtgttacacagtaatttacatagtccaggcaaactaaacagtatatgcaagacctgaagcaggaaggaatatgccagtggagtaggttgggcaaatgggaaagtggcaaaagatgaggtgagaacattgagctaacatggaggtgaggtgggatagatcatatagggtactggtattctggtaaatgtttagcagctggctctctagggaaaaaaatcaataataaaaggtcctgatctgtagtgtttgcagtttttctggtgtaaacactctcaccatggccaatttcaagctagcaatggaaaatataacagtcagctcttgtgagctagtataacccttctccaggccatcactgatatagagccttgtaggacaattgcagtgatttttttttttaagtgagaaaggatgccactaaagaatattagagtaggccaggctcagtggctcatgcctgtaatcccaaaggaggccgaggctggcagatcagttgaggtaaggagtttgagaccagcctggccaacgtggtgaagccctgtttctaataaaaatacaaaaaattagctgggagtagtggtgcgtgtctgtcatcccagctactcaggaggctgaggcaagagaatcacttgaaccgagaggcagaggttttagtgagccgagattgcaccaccacactccagcctggactacagagtaagactctgtctcaaaaaaaaacaaaccaacaaacaaaaaagtattagagttatgatgtgttcaggtttctgtttcaacaatcaactgtctcctgggttgagaatattaattacatgttaacatttgtctgttttctttgatttacatagtgctagcttacacattgttttcaattattaattgtcaatatttaaaaatatagaaatacttcaaaaacattaacttcttgattttcttaaaaaatcaaatttgatctttatgttactaatttgaattgtggagtggctatcttttttacataggtatgcattttccatttctcaccagttttagctattattttacacagttttttctttgtttttaaattgtggagatgagaaaaataaactttctaataaccaaaccttttatcaaaattggtgtaaaatgagaggtaagagagggttatatggttcaagaaaaattgagcatgcgtatttctttatagatgtaaaggatatttttaatttataataaaatgtatctattttgaaggaatacagcttaatatatcattatgaaacatcatacaacaggttatgattaggtatgaagatgatttttaaattgatacactgagaaaacatcaaaatttaatcaggctttgattttaaattaattgaaataaattatgttcttgtaaaattaatatttactgtatgaaaaattgtcagaatagcaaaacaatttgcaaatgtcagtttcataaatgagtgagtacaatatatattgacttagaaaaacaaacattagcaaaagtatatctaaacataagtattgttttgaaaatacagttaacttacaggacaaactcattttatgctgtttttaatagtgatcaaagtgcagatatttaaaatacatcactgaattaagttagttttgtacatgataattttaataaaggatttgaaaacttggtgctcatgagtcacaacttttttttaattttgaaaggaagtcaataagcttaatatacattgatcaaaattagaaaacataactaagacaattcttctgtggtagttgatattactttcggatttttttcctcacaaaataaattcagttggaagggtataaaacttaaatttactaattgcctgattcagcatgaatttctttgaaaagcaagccaaaaccctccatggaatgagaaattaacatcatgaactagattgattcttatggcttgagagcataatgctttgttgataaattgggtccataattaaagcgtctgctgtagttacacaaggatatatgcaaatgatttttgaattgttcatgtcatccaagggaaaatctactaatttttctctacccccatttcctgctttacaaagattggattccttagtttataatatagttgacccttgaacaatgtcgggggttggagcatcaacccgtcacagttgaaaatcaacatagaacttttgactcccccaaacttaatagactaatgttgaccagagccttaccaacaacagaaatactcagataacacgtattttgtatgtcgtgtatattacattcttaccataaagtcagataagaggaaagaaaaggttattaagaaggtcctgaggaagaaaaaatatatttactatctaaaaatatatatttactaagtagaagtggatcattataaaggtcttcatcctttctgtctttgtgttgagcaggctgttgaggaggaggggttggctttgctgtctcaggggtggcagaggcaaaataaaacctacatataaatggacccatgcagttcaaacccatgtttttcaggggtcaactgtataacccatctaaacagtgactattttttgtgtaaggtcattcttaaagcattgcacacacatatgatccaattcacacattctgcagttggctcgttaggaaactatttgtctgggaataatctggtctacaatcttgtgggaaaagaatacccagacatttaaataacagacctaagtatgaatccattccccaaactgtgaagttgaagactgaattttaaaattggctttcagatatcaaattttataaaaaatgaattgacattgatattgtgaaacattgatattccacaaatgagatatattaaattgaggtgcaacatggtattgaaaactaactatgagagtattgcactatctgaattgcacaaatatcttgagaaaagttactttcaatataaaaagcagtaagcaaagattttaactgtaagttattgtcatccaggaataattgtttcctgtttctaatctttctttcctggaagtaagcttcagtagtgttactgcaggcctgtctttattcatccagctcttagagagatggagtattttatttaattctcatctttgagaagaatcagtgaacctacttgacgtggctccaactgtttttctgttgagaatgagcctatgtgtaagtagtcaggcttcttgcctgtaaggaggcctaaagtctagcactgcccccacctaaaaccgtgtcttctggcctaatttctatcagtaacaggttatattttggcttcccactgaatctgttttgttgatctcaacttgttctaagcagagcatagaataatggtgccatttattggggagtaaccctcagaaacctcaaaatttggtatattcaccaggaacattgagaaataataataaaagagaaagtttggaaggagaaagtttttgtgcatccaaggcctacaaatgtgggtcttggactttagggattaaatgtattgagtataatagtttataaagacttataatagtttatagagacttattttaggtcaaactgatttttacttgtttgcatttggctttgaacttctgtagcctgggaagaaagctctggctgtcatgaggaattttaagcttggcaggtgactgcaacctatgacttatgcaactcgtgagaaaataagacacagtcctttagctgtgttgggtgcttcaggtagagactgctttggcttaatgcacagaccaaccttgtcctaaattgagacaagattccattgtagagaagagttttacaggcattttaaacattggtggtcagaagaatatttgccacttttaaactgcaaggcaactagctctgcatgtataacagagcactagaggggctctaggtctacatggttagtaccaagaccagctagataatctagattgggtattccagattcaagagaagacctctttcaggatcaaggagggctgtgaaggcacctgctaacctttcatgtggcatttccacagacttttaagactccctctcccattatagaatcccaaattggctctgaatacattaatatcttaagttctaaccctgacttgctatctgagacccaaattgtgatttcaccatagatgtgcattagactttattaattaggaaataagagatatgaactcttattagaaagaaattgctatccccttgagacagaaaatcaactaaatgacattattagaaacccaaacacaaggatatcaaagtgttctgtgcctgcaactggttgcctccaattatcccatttgctcaagaaaagaaaaaactagagtggttaaaagatggtacttcagttccattaaatccagaaacagaggaagattaataaaggaaagtaggcaggatacgctggaggaagagattatttattcactaagaaagaatacagggagaaaggtacgttgaagatggagttagaccaacatacaaggggcagaaaaaggtacctaaattctaactgcttttaaagagggaaatacatgtttgttgttactaaatcataaatggtgtatggaacccaagagagagaagtccaggatgataaccctaagaaaacccaagtcactgagaggtgactttctaaacccacaggacctcacttggagcaactggggaactactacttaaagactggaacagctgtaccaaggagttgtagaaatctggacagacttagaaaatgcataagagatattcaaagcatttcttacgtgagtttccatgtgacacagtcatcacggggagatacaagcattgcatttactctgagagaacttattgaccttagttgatgaatttatgaaattaggatcttaatggaaggtagtagaaagatacgaagaaatgtagatgtgacaatcagagaccaagttcaggtttttgttaactgtctgatggaagaatctctcttggggagattatccatgtcattgagagtatggtaaacaaaatctgaacggtgaacagagagcttgttgatttcttctctcttactatggtagacctcacagatgaatccagagtagttataaaaataattgcctgagacggaaagcaaagacaaagtaaatggaagggagccactcagttcctgcaggcagcattagctcttacatagactagagaagaaaaaggactggtttaagaagtagactaaattgttaagaaactcaagtagccttgaaaggggttggggactagcacagggaaattaaataccaatgcatcaaaaatttaatttcagaagcaacaaaactgctttagtgcaggaatctattagtggtgattcttcagctaagatgaattatgaatgaagaagtctttcctagcagatgggtttcatgtcccaagtagttccatagctacagatggtggaaatagcccctgtggcacaggactaagaatggctgcccctgagagatggtgcaggtgtggcatggattagagactgaatctagggcaccatcaagggcttaaaaacctaagattctatgggaaaatggaaatagaggttctgggtatgcttgatgggaagaaagaacccacagtgattttggggactggctgctgctatttcaggtgtctatttcaagtttgcaaggagacagaaatgcctgaaatgatactattaaaaaagaaggaagaaccaaggccatagtttagatataccccagggccaactgcccataaccatgtagtcaaaacttaagtcatcctgatttccccataatgctctaatcatgacggaaacaaaacataagctctatgaacatggttcagttgaaatcaaaacaatcgactagcgacaaatgagcttaaacaactctacttccctaaaagggatggtaatatacaacaggcaagaaaaaaaaggttaaaatactcctcctttgtgctttataatctgcgctgtggctgcttttcttgaggcttcttactactttcagtttgaagtctcccagtttgagaactgttcttagtgtgcacaataaacttttaacattttttctaagttgatctgattttatatttcttaatgctccgagcaagcacacaggaaacatagatggattttttttcccacaaaaatggaaatgtaaagaaatggtgtctatgtgccttattttctttacccagtctaccattgacgggcatttaggttgattccatgtctttgctattgtgaatagtgctgcagtgaacgtatgtgtgtgtgtctttatgatagaaggatttataatcctttggtatataccagtaatgggattgcttggtggaataatagttctatttttaggtctttgaggaagtgccacactgcattccacaatggttgaactaatttaccctcccaccagcagtgtataagcattcccttttctctgcaaccttgccagcactggttattttttgattttttaacaatagccattttgagtgatgtgagatggtatctcgttgtggctttgatttacatttctttcatgatcagtgatgctgaactttttttcatatgcttgttggctgtatgtgtgtcttcttttgaaaagtgtctgttcatgtcctttgcccatatttaatgagcttgtttttgtcttgtaaatttaagttttttataggtgctggatattagacctctgtctgatgcatagtttgcaaaaacgttctaccattctctaggttatctgtttagtttgctgatagtttcttttgctgtgcagaagctctttagtttaattagatctcatttgtcagtttttgcctttgttgcaattgcttttagcatctttgccattagatctttgcccattcctatgtccagaatgacatttcgtaggttgtcttccagggtttttatagctttgggttttacatttaagtcttaatccatcttgagttggttttcatatatggtataaggaagtaaaacagtctcaatgtcctttgcagcaacacagatggagcaggaggccattttctttagcaaactaattcaggaacagaaaaccaaataccacaagtttttatttataagtgggagttaaatgaagagaagagatggacacagacaggtaaacagcagacactggagcccaccagaaggtggagggtgggaggagaagaggatcaggaaaaataacgaatgggtattaggcttaatacctggatgatgagataatctgtacaacaaacacccatgacacaaatttacctatgtaacaaacctgcacatgtatacctgaacttaaaataaaagttaaaaaactgatatggaaatgtaattgtaaatggtaaatgcaaaataaacgtattcctgggagaatatttttccactgggcttaagtaagcaagtcatggaatacagacaattggtcttgaatgagagacgtctgttgagattgactccagaaagattttccttttctctcagataccaggattactggggtcctggtagctctggttctggaaatgcaattttgcctggaataattgacctatgcacaggagattggctttctaaattgggtgcgtgtgacaaagaggtgtggtaattttgtgagtcctgttagctgttttgattctttaaaagtaaggcccctgagagactgggcattgaattactatgacttgaaaggctttggaagctccagacccattccagagagagacaggtggttactggaggaacctcaactctacccagacagcaaatcctgccaactaagcctgcagaaaagatgatatgaaggggaagggtatttgttttgtaagtggactttgtactttgaattttaatacatggggcaagagaattttatttcaaactttagtacttttagattttcatgtctttgaacttaaacttgtaaagcaatctaatctttagacataaatttattccttggaatttaataatagcaaggaaattgtcttcaaataagaggcatctctttatagatgtttggttattggaatatcttcaagatagcgtccaatctcattgcggaatctctgacatgctacattagacagtatgcctggacataattttggacagaaaatagaataggggatacattttcagctcttcctacagaatggactcaaagctgacatatggaatgtatggttctgactcactgcagattcttctggggatgacatttaagccgcctgcccttggaacctcaaggaaacacaagtcagcagagctcagtgcagggtgtgggctcatggagatgggagcaatgctctcccaaggcaatcagcatctctggctgaccataggcttcatgtttaagcccaatgaattaagaagatgaaaaactggggagtgttagtggggctaacattaaaattaatatttttgcttcattttctcctcttttgtttgaacgtttgatataaatcttggctctctttgctcattaaaacccagtgtggtaaccttttcagagtccttaatttcctaatatgaaatgtgattcaattcaacaaacagttgttcagcacttattgtatatttctgttctgggtactaggaatatagaaataaataatattgcattagatgctgactttatttacatgtttgagtccaataatataaaagtacataaatcttaaggacagcatgaagagaaagtgatcatcctgtctgggagtttggaggtagacagctttcatcaaaaagggaatttttgagcaaaatggttaagcagagaaagcgtatttttaacagagggactggcacataattaacacatggggaaatgatgtgcatgttttatcaagatactaacatgagttgacagttcctgaggataatttctatattgtgaaataaggatggagcggaagggaccagatcataaccatctcggaagctgagatgtggacattattttatggatgaccagccttaatccagagagatttgatgaagtttacaaaatagagcagcttggccaaatgacttctccatttctttttagcttcacagtcttctgttttgtgtcttggtctcctactgtagcttgagaatacttaattctcagctattccaaatcagcaggtaccacaccgcatttggtagggttaggtttggctgcatataacagaaaaacccataataaagaataacggtagattaaacatgacagaattgtgttttcctcaggtaaaagcaattctgcggctagtctggcaacttggcaaaattgttggtaaccaggtcccttcccactcttcacttcacaagcccaggagcatgaacttgtcctcatgttctgagatggcagctgaaaccccaaataatcacgttcatgttccaggatggaaacttttgagaagatttcctagaggcacctgatacacttttacttatttctcaatggcaagaatttggacccacggtcatacctacggttggagaacagtggggcatatgattgcactgattaattttttttatcgagaaaaagtggaaaataaatattgagatagacaattagctatctctgttctatccatggaaaaatgagatatttatctatctatttaagtggaaatgaacatggtaggctttcaaagattagagaaagaatttatccccaaaattgtttttctaattctgtttcttggacatctctttttctttcaactgtagcatcgcagtccctgaatttgaaactccattcacaacatacagtatacacatcctcaaatgctgaatgcacactcagtcgtatgtgtccacagcatccttctctccctgacttctgggactttggatgaactgtgttgactgttttcacatcctttcacatttattgttcctggtataaacgaaatgccacaaatacaccatgattttatttgacactcaaaagtcaggcttttgagactcaaaaataaccttttgcttcatgtttgctgtgagagtcaaaactccattataaaactcggaagctgagcatgaactctaaatctgtgtatcgtcttttccccaaggcaacatctaaaggcctaaaagagaattgcgatgcaaaacaagaattttgagggataataaatgcattggttaataacaaaccaacccaacatacttataatagagacgataatcaatctaaatgcccaataatgaaaactagacataacattatgataaaaagtataaagtcattaaatattttgaaggattgtaaataatatcaaaacatttatattttaatgagtgaagagaacagtatataaaagtgactatgtatagagatgacaagtttagaagtatactcagaaaagtcatgaggaaaaggagcataattttagcagtgattgggtggcagactatggataattcctattttttgttttctaaattttccctctgaggaacatgaattatttttataataaagcattattaggatgcacatatatatgtgtgtgcatatatttacagtttgaaataaaaaataaagttgccatcccatacgtaatggtggataaatgactcacttctgtctgggcatgccatggactgaattttgtcctcaatggtggataaatgactcacttctgtctgggcatgttatggactgaattttgtccccatcacccccaaattcatatgttgaagccctaaccaccaatatgaatatgactatacatggagatagggcctttcaggaggtaattaaggttgaatgatgtcataagggtgtggccctaatctaataggactggtgacctcataagatgaggaagagacaccaggggcatgcatagatgaaagaccatgtgaggacacagcttgaaggtggtcatctgcaagccaaggggacagtcctcaggagaagccaaccctgcagtcacttggatcttggacttgcagcctccagaaccatgagaaaaatatgtttctgttgtttaagccactccacctgtggcattttgttttggcagctggagaagactaagtgtgttgcacttttttttttttcttttgagaaggaaaaaagccaggagagaaacttgaagtagcaaaatggggactcaggaaaaccaagggaaggaggaggatggaggcttttggccaccacacactcacttgcttggagggctagaatttgccctccatgactgcacaaacacatttaaagacatctacctttgagtgctccagatgtttgaatcagtgactgtattgctccttacttgtcccctctgcagaggaggcattcccagttgcctccaatgtgcatcctgtgacttggaccccagacttctcttccttctggctgcctgctttggatgtgtttttgcttatccctcggctttttaatgtgacaatcgactccgcatgtgtcccaggcagccgtgaggagagagaaactcgttctttccctgcaggccaaggcaaggagagaagaaagggaaatgaaccgtgttatatttctgtctgcagcatgagtccctgtcatgattttcctccaatcagggaaggttactttggcaaccgccaattaacgtccctttaaataacttcctcctggttagtgatacttcattttcataaaaccagcaagtcccgcagagatgtcttaaagtagccaaatccctttttttcccctttctcattacttaagaaacatattaaatatatatatatatttttttaccaggtcttgctctgttacccaggctggagtgcagtggtatgatcctagctcattgtaggctactgctgggctcaagtgatcctcccgcctcagcctcctgagtagctgagaccacaggccagagccaccatacccagctgagaaacatatttgaacagattacataacattttaaaatatattggcataaaagtgaaatatactagttaaagcttcatgtcattgtccttaaaaaatactaaggggaaaaagatttgtaaaatataaaaatagaggttgcatgtcaatttcaagatttcttagagcattgatgataaactttattttaatgcggtgttgatttaataatatcggtaaagtgatctctctattttacaagcatattaattgttgctgattgcaggatgactttgaaaagggaggctgggtgtggtggctcatgcctgtaatcccagcactttgggaggccgaggcgggcagatcgcctgaggtcaggagtttgagaccagcctggccaacatgccgaaactctgtctctactaaaaatacaaaaattagccaggcatggtgaattagccgggtgtggtggtggcacctgtaattccagctattcaggaggctgaggcaggagaatctcttgaacccaggaggtggagtttgcagggagccgagatcatgccacttcgttccagcctaggcaacaagagcaaaactccatctcaaaaaaaaaaaaaaacggaaaaatgatcacatttttgtgtttgaaatagcatgtacaatcactgcacttcaatggcaaggaggtagttcaacctgtgagaacacgcacacctctacttagaggctcccaaaatgatttttcacttaacaattttgtaccgacactgtgccataccaaagtactgcaaccaattacaggtatttactgcagaataccctttgcagtaaaactaaccctgaaaatgtaagaaattgtttttatgagcaatagaaatgcctattctggaagctctaagaaacattaaattttacttcaggtgtagaaagttgcctgtgaaaatatgcttcttgcaatttcagatgatacagtaattcacaggattatcaaaacaatgctgttgaacagcagtatagatttatttagttctatacgtctcacctttagacattttaagatgaagtgtttgtcctttcaattaatcaaaaatgttttcccttccacttagctaagtcgctcaggtctctagccctgtcggcattttctcccagatatttggctgagtgccatactgaagaattaggtctggtaattaaatccaatctcagcaaagtttttttttttttttttgtctgacactttatttaggttttatgcaaaatggaatcccatagggacagagaatgaacatgttgtgaagtataattgcaatgaaatatatttaacagttatttttgaagaaaacgcttagagatttcccgtgacttgaatcagcttcaatgtctttatgcaactttttccattaatgcttcccatcctttatgattagacttattcatctattttctgctggttttctacattaataagctgcttttgtcaatgattttatgtaaatcagtatgtttcccactgattcatacacacacatgtcaaaatattttaaaagcgagacatgttataggttaaaatatacaggtaaatataatatgtatgtattacatattcatgtatttttgacattctatattttgatatattcatatatcttcatatacatattgaaaagcatatcttctatagctgtgtcttaaattttcaagtattttgatctgatcactttctgcaattgacaatttaaatgttcccaaattatacaaggagaaggaaaatcaggatctaaaaatataatgagggttgctgttttggagacacctctaaggccatcttacttagtccatttcccaagtttccagctgcactgtttcatcatagaatggaatttacaaattgcctcccaatgctgtcagattctattgtttataataaattaattcttacatgcatttctaagaaaagttgtgaaaataattttctggaggtccttacatatagtgtttcccacagagaatgtgtgcgtctgttttgctggttagttggttagcatgattttgtacctagaagtacagtctttggaatgatgttccttccagtcataaagtgcctttaactgatagacagtttttcatcacaatagttataactgcatcagtaatataatgaatgaaaacaatacatacatatatacacaatgcacatatgcagatatgaatctcatgcacaaaatcaggcagttaagaaaagactgttttcattatttctgtctctgggtttaatttctgtttggggtcctcactctgctaggtaacagacagttcatcttcatgcacatagcactcttccccaccccgcctaggttgcatttatgggaggaggaagggtgtttgggagaaggcaacatggctttgcaatattcaggtactgagtggagccatatgttctgtgggtctgtgtcatttaaccacacctgcatcagctgagccattctcattcccatcagtcttgagtcattttacccaggtaattgctgtgttttcctggttccaaccataagaattctgtctctgtacagaggttgtccatgctgtccatgtggttggcttctccctggtacaatgacatcattctcttgcttgatactgcgtggatacacaggccttccatgaaaccgctaagtcctttgttccagatttgttactgccctgctgtataagtactctatgctttttgtatgtgaggttgagaaccctgggatcttgccaattttcagagttctactgggcatggggcacagatttcctctactctcagtctcccaaacatctctcccgaggtttttgtcatttctgccccctcctctctctgacttagcgtatttagtccatttgcactgctataaaggaatacctaagactggataatttataaggagaagaggtttattttggctcatggttctgcagcctgtacaagcatgtcaccaacatctgcgtggcttctggtgagggtctcaggaagcttccactcatggtggaaggcgatgggggacctggagtatcacattgtgagagagggagtgagagaacgagggaggaggtgccaggctcctttaaacaaacaggtctcctgtgaactcgtagaatgataaatcattcattaccctgaggacagcaccaagaccttcctaagggacctgccttcctaacccaaacaccccctcccactaggcccacctctaacattggggatcacatttcaaaatgagatttggaggggacaattatccaaccatatcatttagccaaagaatggaaaggctaggcctacctagaatatcctctcaagaacacgactggcatctaattgttgtatcctctttctcttgttctgtcttctttcagttcttggattttttagttagttcagctgagagtagagggttaggaattggaagatggaatagcatgaacagtgatgctgaagtgagctcatgaagggtggatatgagagtgagtggaaacttgtgattatgttggggagtgtgactggaggtcaggggtgacctggagatctgtttggagagttatggggctgggagtaagttgaagagatcaccagtagtctcgagttttcaaactatagaatttttttctttagggtaatgagaagcctttggaaattattgagcagaaagtgatataatccaataaatggtatagattttagatactttatggagttatttgataggggatcacatttcaacatgagatttggaggggacaactcaaatatgattccaagaacctaacctgagctatggtgagttatgcaggaggaaggggagttctgtcttggacatatgatgttgcagaggcgattttgagatgtaaagagaggtaaagcctagggatgtattgatgaaaataatcgattgattgtagctcaaactgtagaaatagaagagagaagaagaaagagaacaaaattcattttggaatagtgaggaacagtcagaaactggacaaagatgcaaaattagaagaatgaagacatagaaacatagaaggaggatttctaaataggagtgttatcaccagcatcagttgttgctggagaggtttccagggatatagtggtttcacagtgcacagtaatcctcccaattcaaaacacctgaaagttctataaaaaatatgaaaaaaaatatttctataatgattgtggaaattgggaaagtaaggggaatttgttgcatggtgcctttgcctgagggagttgccttgtaagaagctgttgtttcctttgtgctcaccctctctagtgacagctctaggtctggaatgggaatgcatggattgagtgtgtgtgatggaggagttggtgcctgagaaattacaaaggcaaacctaggtggagaaagctggcataagaaaagagtaacaggactttgctaaattcttatgagcaaaatctacagggaaatgaattctgaggaagctctaccaaggagggaaaagcataattatagaccaatgtatttatcaatcaatcaatcaattataaatcaacccatttatcattgtaggctcacatcccagagattctggattcaatgtactagaccaaacagcaagaaatagttctcattgttgacttgggtagttgaataaaacctaggttctacagaggtgtaaataaactttatctgtcagaaaatattcagtgtggccaggtatggtggctcacacctgtaatcccagcactttgggaggctgaggcgggtggatcacctgaggtcgggagttccagaccagcctgaccaacatggagaaaccctgtctctactaaaaatacacacaaaaaattagctgggcgtggtggctcatgcctataatcccagctactcaggaggctgaggcaggagaattgcttgaacccgggaggtggaggttgcagtgagccgagatcatgccattgcactccagcctgggcacaagagtgagactccatctcaaaaaaaacaaaacaaaatgaaactcggtgtaccatagactatgtctaccagagacagtagttcttggttggctaatcaagtgtggttcccctaactacatcctccaagaggtcttagaaggaactgtcttcaccaacgctttcacaaatatattgttgaggtgagcacctttgagatgtggtccaggggttttttctgtaggcagagatgccaatgggaagtgctgcaggggcaatggtctcataaactcaatgggaagcacccagagacccaagcaagtactagcagttatttgggagaggtaacatggtgtgcttaccttcatggtcagctggaagggtgtgatccatacagtttggaggtggataattgatcatgagttctttgattggaagctcactatagctttcttaatgaattcaaataagaaataaaaccatctctaggtgttgcaaagagtcctgacttgagcttttgtaatggagagtcattatgcctcatacagttctcagccctgagccacatcaaaaagctggagccccttgagtaaaggcaggtctgagccccctcagaaaaggcccgatagaaagtcacaaggggatactctttatatttctactggtttttccttaaaagccttcttggtagtgatttaccatggtaactgggccctgggaaaaaggaaatacctaaatattctaagggaagattttccaatggctctaatctagactaatttctgaaattccactaaggcctaccaggaggaataggtatttaaaaagccagatgataattagggtccagtttagggtaaatagggtaaataatcatgtttttgaacatggttattcattcttgtacatatgtgtacatataaatatatatgtatacataagtgtgcatattctatacaattggaatagatttcctgagtaattggcaaatatcttcataagtttcctgatctacgaaggaaggactgttacagtaggaagggccaactggaagtttaagtgcaataaaagaaacaaggcaatgctaatactcttggagttcccagatctcatctcatccccatcactagaagcagttagctttatagaatagtgcagtggacagtggaatacttaataatagtgccaatacccgattttacaaaatccagaatacactctaaactgtcaactgaaacacagtactctttcttccatactcagagatgtgcatgtccaggaataatgaattggaaatgggaattgattctctacctggtaaagtaatgacccacctataaagcttgctttctttccctgtgattctgttaatcattttagtacctcaaggagaaatgcttcttccagtggatgtactaacagttttcagaagaattggaaagtaaacttaatcattttaagccacacatgcttctgagagaagaggggaaaataagaatcatgggatgattgattctaactgtcaggaggaaatagggcctcactacccaaaagagatgagtgtagatgattccctgggcagcatcctattattactttatcaagtggtgaaaattaatgaaaaattacagctgccccctacaggccagacccaccagggctgcgatctcccagatgggaaggaaggtttgtgtcacccatgagctaaagaccccacaccggttactatgttggctgaagatgaaaggaagatgaattgtacagtagtggggagaaatcacaactatcagctacaaccccaggactcatatttccttctttaccacgttatgtatacattggtatattttgactaattttctttgtctttccttcctccctactatgccatttaaaaaatgagttttgttggttaattttacatttcaggccactggctacagaatattaaggtggaatccaacagaaatagagaggaaaataacatcactcagagctcttagactttgagctggaggcagtaactgacaaggcttagggttgccttcctttgctgggagagcttgaaaatgtcttgattgtttaaggaacgttgcatcatatgaggcataagtgtttttaagtgaagaacatatgtggatatcaggtacgaagataactggacctgtgcaggacatcagctattgttcggaaagtcaagctccaacacccttcccttccatttgtgcagagacctttaaaatgtgagtcttggtggaagggaggcctcacttcccattacagaagctgaaattgaggcaggagagtagggtctggaggcagggaaactaaggctgattcacacttacttcctagaactgaatcaaaaggaaaaccccacttctccacacccaacttacaaagggataagaggctactaactttgcaccgcctcacagatgaaaaatggaaagtacctttgattggttccctcctgcaaccaatcaggctggtcatggggcaagtcttcacttgtaactttgtaacttcagcctctgattggtcacctatcacaactaatcagactggctgtgggccactccttcatttacatagagtgtaactaagtaaccagtgggaaacctctaaaggatatttaaaccccagaaaattctgtaaccagtgctcttgagtggcttgctggagcctgctcccactctgtggagtgtacgggagtgtactttcatttcaatagctctgtgattttgttgcttcattgttttgttgctttatttgtgaatattgcccaattccttgttcaaaatatcaagaacctggatgactcaaagtcaagacactccacaggtaacaaaaaggccagacactcctttcccgtggcctctgctcctggaatatgtgtgcattgcctaggcttaaatattcaaatgttccagtggtacaaagccaggtgagaagtgcttctgggtgctagtttgagaataagtgtggaatccagcaagggcagtggctagtgtcagaatcctggaggcaagaacaggaggtgtctggtggtggtgacactgagttcttactgtcagcagtggtggtcaccagaggtggcttcctgacaaaatgtgcctggttccctgctgttcactctactctggtcctgcccattttctcagcctggattctctggcctttttgctgattgagttaatgacacaatatccttttggcaaatgccttttctgcttcattaagttagtgatatttggtctccattgcttgtaaccaagagccttgacctttacaagactgattcatggataacatttgatttccatctagggacagggaaccacaaaaaattgagagatgtataaaaaactgtgtagatttttttttttaggggtagggggcatgattgttgttttgtttactcaactgctttttttcacagaagaaactaaaaaatataaaaatggaatgacttctatcaatagaaaatacaatccttttcaggaagattaatgtttatctgcaaagaaagatattgttgaatgtctcttgtgccatctgttcccaaagttctcccttctgtctcacctccagtgtgagttctttgcctttcttttcctcatctagttttgctactggatggggctggcctgggaggaaaaggggaaggagaagtgggtgcttcaaatcctgcagggaaagtggggagagagacaaggacttcattattcagaccttttcacattgcgagagttaatcttttcctagcatatgtccggtgtcttaatatgctaaaataatgactatcaccttcttaacttcaagtcacatcctagaaggcctccattggattacttaagccttcagaggctgagcaagttgagcaagatggtcagcgtaaaaaacctgatgctgtacaaatctcggagaaagaagtataccagtctaacttgcttatccttgtttggtggttccacaaagggaacgagcaatccttgatcaaatggacaaaataccatgagtgagctactgtcagatttgctaagtacctagaatctagttcttaaaggtgtgctcggaatattttggattctgttttgattttggtgaaaatcctcataaaatctgacagattgaaagcaatgaacagctcagcttcataaaaaatcatttgcatggaactggtgaagggcaaagcattgcctggttgtcttcagctcacttccagtgccaggtgcctgggtgggcttgtttattcagaagaaatgaaacataaattggcaggatccctttaatccatttaattttctctggtgtgtacagaatggggacaggtgtgaaaagtgatctattttgttggaaaattcaaggcacatgacatctcaatgatggcaaaataagaaatagctgacatcatgtttctaaatatacaacattttgcaacagccacctggagcaaaaacagaaaggttgagaaggcagaataatgactttttgtctctggaaggcatccatgttcaacagtctgtcaggaagagagacaggtggggctggctcaccacctggggtgaaggctgctgcaggacttttattaaaattattgcacaggagtggagaagataaacactcagtgggtgcaatggaacagccggcccatatgtctggctagaactaaggtctttctctaaaataaacctacctaaggtaggaccattgtttttgtttgtttgttctgttttgttttgtttttccaaaaaaatcttgtatactagtcaaacagatcccaggacttataaatgcatttaatatgcctctatgtcttcagtaccaatgtctggagtttattatctggctttatcattgcttgaggtataataggcgaaggagaatataaattaaaattgagaatatcatcaggaggacaaggaggatattgatttaagtgtctctgtgcttttcacactgtgtcccctgtagaccctcagagttagaaggcactaaagagtgaactagtggagccctctggtatatggtaaatcaaggcccagagaggcagtgtgacttatttaaaatcacacagctagtaatgtcagagacaaaattggaaccgaagtgttctgattttcagtcctttggtctttgtaactagagaacacagcttcgtacttgtattagttttacatagctgccataacaaataaccataaatcaagtggctcaaaacaacccacatttatcctcttactgttctggagctcagagtctgcagtcattctcactgggctaaagtcaaggtgtcagcagggctggttgctcccagaagctccagggaagaatccgtgtctgtgccttttccagcttccagaggccttttgcaatcgttggttaatgatcccttcctcgtatccctccaacttcttgcttttatcatcccacctcctgactctgctgccctcctgctgccctcttccaactacccttgtgatgacattggccacagccagctaatccgggataatctcccacttccagatgcttcatttaatcacatctgcacagttcctctcatcatgtagggtgacatattcacaggttccagggagcaagacgtggacatctctgtaggccattattctgctcaccatatccctttaccttgcattatcgcctctcccattctctgaaaacaaacaatatagaaggcagaagagatttctggagcctaaaccatgtagtaacatttatgtaacattggggccattctcttcacttggcatggcagctgtgccactcagtctccctgacctctggatgagcagaagggccggtatccccactattttacagattagtaaaagcaaaacatttaagattttggttcagttagagactggttcagttagagttcttaaagcatacctgcttgtaccaagtagtatttagtagtagtcagtatttacaatagtatttcaaagtcctttggttcttaatcattttattaacgttcagacaggaggtttcatttgtttcttcaattttttttcttttatctttgtggcaagagataagagaactcttgcctaatatctacttgtttgttcgacttcatgtccctggctgtgacaaagggcagagtgtgtggtaatgaaagcttattcataatcttaaatacgatgtaagtggctgaattggaaagggagatgcccattaccaaaggcactggaggggagaaggccttattagtgctggaaggtcgtcagcgtggagagttcagacacgtctgtgctattcacatacagtgtaaactcatcactcttggaatttaattcttgagaaatgattgaaagaggtagtaaaaatatttacaacttatatgaactttaccagtctccaaatattctgaacatttggcattatattttattaaaaataaacggccaggtgcggtggctcacgcctgtaatcccagcactttgggaggccaaggcgggcggatcacctgaggtcgggagttcgagaccagcctgaccaacatggagaaaccccgtctctactaaaaatacaaaattagccgggcctggtggcacacgcctgtaataccagctactcgggaggctgaggatggagaatcgcttgaacccaggaggtggaggttgcggtgagctgagatggcaccactgtactccaggctgggcaacaagagtgaaactacctctcaataacaaacaaacaacaaaatgaaaaacaaaacagaacaaaaaaagaaagaaaccaaacccccccccccaaaatacatggtaggcactcagtaaatgtttgaatgtttgcagggtgttgaatgaatgagtgaatcattggtgattgtttctctctgaaaaataaatgaagaatgttttcatttgggcttgtatgtttcctctacattcagtgatgactgaaagagccaattaacttttaaagttgggctaaacaacctaggcctgtgactagaaagggctagatttggtttgtttaggagacaaaattgagggaaaagatttctatgaacctaatagggtcctcgagaatgtttcaaatattagcaaagaaatttatcctatcaatccaatgtctcagtgaccaactctacacctccaggcttatatacaatggggtggaggaggcattgccaagtttagagggggttgtggagcccagggacagtcattgagtcagaaccaacaaatgttcgagcaaccctcatgtcccaggcctttttaaagatattatttcatgaaattcaacaactgtgtgaaatagatgttgcacccattttacagatttagaaaagttcgaggaagattaagtgacctgataaagtggaagattaaactatttcaaagcgcctgtttttcaactccaaatactctgctgttttgacttcactgtggcttattattataccagaaatttctgttgggcaaagggacagagaagacatccatggagtgtctgagaagtgagatcataactttgatacatctttaaaacgttttagggtaacaaactgacagagagaggatatgtttaacttttggttttgcaaagggacatgaaagcaggcactctagattctggtgccttgaatcttgggtccactgtttactcatgatgagactttgaacaagacccttcaccctcttttgctccatctcctcatctttagaccaggcccctgttgttgatgatgagggtaaataggatagtctatgtgatgtgctcagttcatggctcacaggaaatgctccggtaactgcctgaaataattactttgaggcggtcaaagtcctttaaaaatgtttattcattttaatcagaggcagtcttcctttaagcatctttcctctttaaatagtctaagattctgaagttgtagattattattttggggatgaatagacttgtccatcaaaatttaatgcttttgtatataaaaattttcactcaaattctaatctctctataaaactttaatgttattgctctttctctgcaacattttcaaagcatcctactttgggaataactttaatttatgcgccatcatcctcttctggaccacacataaagagagaagttgcatgctaattatgattattccataatgaaatgagctaaataacaacatgccatcattctattctaccacacactaatcatagctcaattattaacaaactcaactgtgacagcagaggcagcgtgatggggacactggcccagcaatgccactaactagatgggtgcttctttttgtttgtttttttgttgttgttttttgggacagagtctcactctgttatccaggctggagtgcagtggtgcagtctcggctaactgcaagctccgccttccaggttccagcgattctcctgcctcagcctcctgtgtagctgggattacaggcatgcgccaccacgcctggctaattttttgtatttttattggagacggggtttcaccacattggccaagctggtctcaaacttctgacctcgggtgatccacctgccttggcctcccaaagttgtgggattaaaggcgtgagccaccatgcccggccactagctgggtgcttcctctccaaactatctgctttctccttccatctgagctctatgattggaagtaggctgtaaatccaactgagaatgattcaggccatgaggaaatatatacctggaaaatgaccctccagatggtaaacctaaataaaatcctttgctccataatggaagtagacaaggcaactggcttgtctggtttaagtgcctcacttctgtttagagccatatattcaggttgattcccttccaactatttctcctgctttgtgttaactaaccatgggaaacattgaacttggagataggatcccatttttattttaatgttatccagtgcatggagtaaggatcttgaaagtccacctgtgcttttggtattgaaaatgcaacagcggattaagatttacccggcgtcttccaaaaggccacaagatggggatgttactccatacacttagatcttttcagtcattctacaaataattattgagcacctactatgtgcctggcattgtgccacgctttggtaatacagtgatgaataaaacaaaccttgctaatggaggttatggagtctcatagagaaggcagatgtttgaaggtggatttattagcatacttactactgcgatgacaaaaatagagggggccacagggtgcatagtagggacccaaaagccagtttggggagggcctggagagaactcatggaagattccctaaaggaaacaatatgtaagctgagacctgcagaatgacgaagcattacccaggagtagctataatctaggcagaggagtggcatgcccagagacccagcagggaaagcaaacttggtcctttaaataaactgaaaaatgttaaacttttcatttaacttttcagaagcctatgagtagacaatggtaaagagttgaggctgggccaaaccaagaagggacttgaaggccacataacaatccttaggacagtggtaaggcgagtcctctttcactcacttgcctacttgaaaggtctttcttaccctcctccaaccagcatgatcccaattcacctcaggtttcaaggctcgggggccctctaggaaatgggcactgatccaccaagcctgggttaggagcctctcctgggggtgccgttgcatgttatatgttccccgtcaatcactcatggagcaactgtcacttacagacgggacgtgggctcagctgacaggtttgagtcctgctttttggctcggtggccttgggcagattcctggcatcagtttcctgaagctaatcatagcagccctctgagagggttttgtgaaacaacttgaaagtgtttagtatattgctgggcacatagtatgtgtttcataaatgttagctattgattttgattatcctaagcgttaactactgatatccgttatcctggattgcagcttcttaatcacttgtctgcttctcctattgtatccaaagattcttgaagacagggaccttattttattgtattatttcagttcccactcctaccaccatgcctggagtaaaggaagttttgatcaatagttacccaataaatgagcatactcagcatattcaaacagtttaaacaattagctcccaggtgatacagctgaagatacagctgctagagaagcgcttccgtggtctgtcctatcagggaactggcagatgggatctccctgaaggcaaaaagcacccctgactcaattttaatatcctcactttatttttcaaagtttttgttgacaatccttattttaatcaatgttcattgctttctgaatttgagtggttgtatgaaactcacttaatcttaaaaactttaactcagtgagagtattcatatttttatcttaatccattttaggtaatttagaaacgtgtttagtagtatataaattcccttttacttgaattttagaaaactgagccatagatagtttatttaaattaatataatcacttagacatttgggaacaatgtgactagcaatttattttagaatttctaacacatgagaaggtattgaactgacctccaaaaatgtgtacattttgtcgtagttgaacgagcatgggattataaaggagaggttggaatctactcttgggtttgccttaaataagctttgcagcattgggaagtcgattttcttctatgaacctctatcttatctctgaacttggccagatcgagctagatttcagctaatgttctctctgagctcccaaatcccatggtttgctctctttctgttcagatgataaaccagtgcgcttttcgcaaaaaagcctggtgtctatataaatgcagtggatgaaaagcagacactgatttcttttttcactataacacttttattgcaattttgctttcctggggaggaggcaagataacagctgaaagctactatttattgatggcttactaaatcaggctaagtgcttacatgcattatccaattggattcataggaacttcatgatataggtagtattattagcagccacatttttacctgtgagaaggctgaggttcagagaggttgagtgacttagccaaagtcacacagcattaaggagtagaggtaagctgattatgcggcccactgtcttagccattatgctgtattgactgtttcttatagagggtctactctttgtcaggctctgtggcaggcattccacagacattctttcattaaatgatcacagtgctcctatggagagaatctcattaactgcatgcattttctttgtaaaagcggtaagaaatgataggaccaaggtatattaaggagaattagagctcacaaacataaacaggaagaacctgacactttgatatggaagctgtttaaggaatatgaatgtcattctacaggctatagctttcctctgacttagactgtttgtcattataaagccagccactactttgtctgatgtttttttattctggcattaataaaaatgaaaagcttttattatgttattacatagtagtttatataataaacattgtattatgatggattataaacattttataatagattataataaaataagtttatatataatatataatatatggtgctttgaattttttaaattccgagattaaaaagaaaatgaaaaggttttattattatataatatagtttatataatatatgaatatgttgttagattataaacatttcactataatggattataataagtttatattaaatatatttctaaatatagtttattacaatattatataatataggctattatagcctctgccctcaagaaattcaggtttctactcaggactgtgagatcttgtcaagttagtaacttctctgactctgagctttccatatctacagctataccatgagtgtaattcctgcctgtagggctgttgtgattattaggggcaatatatgcatctgtaacaatgccaaaaatatataagatgctcaataagtagtaactgcagttatttttattattgttctgtattattattgttcctgatcccactagaactttttgatatcaagggacgtgtctttgtacagtgattttcagataacaagcatacaaaaatatttttaaataaaataatttgagtgatatccagtggttatacatcgttttcactgacaggactagttaggagggaccaattacagtttccacaagaacccatgagattaacgagctttggaaatgagctctggaaatggatgtgaagtgcgtgtaccttaaaggtcagaggaggagggatggtgaggatttgatgatgggctggaaatggtgaggggtggaagagggaacgattcaaggatcactgagctttccagcttgaatggttgggtcaggaaaaatgtgatgaggagcaggtatggggtagaaaggaattcgaatagttcagtttgggacatgttgagtttgaggtgtgtggtaggcagctggacacatgcatctgaagagatggaatgtagcgggtctccaaggctctgagagtgtgagagtgcacacaggatgttcagagctgttggcaggttcattcagaatagatttgctgaaaaaaactgaccaagaaattgtctataatttccataccagcttccatgagcttatctgctgcttggtttcttctgtcatctgtcaaaaccttttctttgtttattcatttttggcctttcctacttttttcaattccatgttgcattttaacattggcctttaaagcttcaagaaaaccctgtcagttcataatgtgaaaatttcaggcaagcataaaaggggatgagtgtgtgaattttcagaaggtttagaagtgatttcttagcacttatcgttatcataatcttttggtacatatgagaactctaggttgtattttagcataggtccctataaatttcttcccatcccaaatacattagacctagtttactactttgatgtgaaattcagtgctttattttcttatgtttattgtctgcagaaacacattaaaccaaaaaaatgacatatggagattaaaaactcatctgataacataaatctcagtgactagacacaatagaacaattgtattattgctatcataaatgaaattactcagtaatataaattatgaatttccttttctaatgttcttaaagattatatcatttccttgcccgtttcctgaagcaaaataggctagctaattttatcctcagtcatttccaggcaaacaactgtactacattagcaactctatgcttggatactcagctcaagacctgctctctgcctctgcaaacctttcttccattcactcccacgaagttttacaaggccaattttgaagcttcaaagtcttaggggaaaaataaaaacaaacaaaaactaaaacaaaaaacttccaagacttaaagtatcactaatacttttacaatctacttccccacagctaccaaaataaaaaagaaataaataaaaaattaaataactaacaattacatcaattatattgacttttaggaaacctctctattagattcctattgttgctggaacaaattaccaacaaacttagcggtttaaatctacatatcgcttatcttttacagttctggagtgtagaagtccgcgctgattttgagctaaaaccaaggtgttggcagggttctgttcctttttggagactctaggacagaatctgttttcttgcctttcccagcttccagagatggcctgcatttctgggctcatggccccttccatcttcagagccagccatggcttaagtctttcgcatattgcatcactctgacactaacttttcttttccccttctcttccacttataaggaaccttgtgattatattgggactgcctggatactccagaacaatctttcccattcaagatcagttgattagcaaacttgattccgtctgctgcctcaattcccctttatcgtgtaatataaaacctatttataggttctgaggattaggacatagaatctttggggcattgttattctgtctgacacacttcttaccatattaaacacatattatgacatattaatagtcaatctgatatgtttatataaaagacaacaggattctaatatagtcaaattttatgtaattgtgctgaaaagtaacctaataaatgttaagtgcagcattttggatgtaaggtgcccattgagaaatagagtactaaacttaggtgacactatggtgtgagggaggtaggaaagggtcagaaaagacgaattagtgagtcattgtgggttgctctaggcaagactattccatataactttctgagatgatgagggcgttctataactgcacagtccaataaggtaactattagctacaggctgttattgcgcctctgatatgtggctagtgcaaatggggaactgaatttttaattttatttaaattttatttaatttaaatctcaacagccacatggtgctagtggctactgtattgcacagcacaactctagaatcgagaccatggtagatcaactctgaataccaccttacattttaattctctaaatggaaaggtgtgtgtataggtgtgcacatacagatgtgcacgcattataagatgttagtggctgggcacggtggcgcacgcctgtacttgggaggcaggggtgggcagatcacaaggtcaggagttcgagaccagcctggccaatatagtgaaactccatctctactaaaaatacaaaagttagctggacgtggtggtgggcgcctgtagtcccagctactcgggaggctgaggaaggagaattgcttgaatccaggaggcagaggttgcagtgagctgagatcgtgcccttggacttcagcccaggtgacagagcaagactcagtctcaaaaacaaacaaacaaaaaaagatgttagtgataatcagaactctatgggttaatatttactttataatatatgacacttaagataactgtttaaacaaaatttagtaagatgttttatctttgttatgaaaaatgatattaacatatttttagatggaatttaatggtcattttggttcatgctgatcaaccaaagctactccctcatgggaaaataggggctaaataagagtcaataactgtttcagtttcttagggcatgagaatattcattcgttagttcagcaaacatcattggcgctctaagtccatggcattgttgtaggctctgtgatgagcaaagataaagcacagtacctacccccaggatgcttacactgcgaggagggatagagcttcatcttcctgtccatcacattcttgcatcattctggctcacctgaatgtcccaatggaccactcacttgactctcaggcctcgcaattccttgaccatctcatactcagacctttactttcagtaggatccggccagttgtctcctctcgggggctatttcgagggtctatcatcatcaagagtcactccatcttcaaatcaggatatcctgttcacaacctacaccctctcgttccctctgtccctgttcttgtaccctccatggctccagttctctcagtcccgtgctttcctctgcccatcaggctttgatggtttgtactttctttccttgcttttgtttacctcctgaccttgaacatgttcttctatctacttaaatgaccttcaactgtcacttgaatgtttatctgctcaagctaaacgcatggctaataggagcactgtggtataaagagccctgaatttggactcagaagtcctggagctcaaatctcagtttggccttttactggcttgagggtttttaaaaataagtgtaaattatttaacctgtttgaatcttagctaacttctctgcaaattggggggaactttttgttttgttttcattttttattttgaaataattttagactaccaaaaagttacgaaagtagaacagataatttctttgtatcctattctcagcttcccctgatgttagcatcttatgtaaacataatgcattatcaaaacctgaaaactggcacagtataatatagtgctatgaactaaactatacacctaattccaatttcacctgttttttatgtgcaaacatgtttgggagggggttatatagttctgtaaaactttatcacacgtgtagattcatgtaacttccaccatagtcaggacgcataactgctatggactgaatgtttgtgtcctcccaaacccaccaaatgcatctgttgaagccctaatctccagtgtgatggtgtttggagatgaggcctttgggatgtgattagattatgagggtggagccctcatgatgggattagtgcccttataagaagagacagaaaagggtttgcttcctctctctgtctgtctctatgcctgccgtgtgaggatacaaacaggaggcaggacctcacccaacagtggacctgctagctcctagatctcgaacttcccagcttccagaaatgtgagaagtaaatgtttgtggtttaagccacccaatcttttgtgtttttgttaaagcagccctaagacagcaactgttccatcaccacaaagaaactccataaaacttcttttatattcacactttcttcccaatcctgaccttgaatgaccactaatctctcatcattctaattgtgtcattttgagaatgttttataagtgggatcatacaggatatattttgatttgctcttttcacttaccaccttgcctttgagatccatccaagttgatgtttgtgtccatttttattcctttctgttgctgagtagtaccccattgtgtggatgttccagtttgtttacacattcatgctctcaaggatgtacatgtgagttacttctaacttttggcaactacataaaaagctgctgtgaatatttgtgcacaggtttgtgggcaaatgtaactttttgtttctctaaaataaatacccaggcatgtaattgatgggtcatgtgtgttataatggaagtaactgagtaacaaccaactatatatcttaaaatgaccctgcaaaaatattggaactctgtgaagtcagattaattgtattttgtagcagtccaatccaggagagaatatggacatggaaaatgaaagaaacttgaaaatgagtgtttaaaattgcataatttttgttagtttgcttttcccacttcactgaaataatgaaatatttctcacctttcctttaagggttattaaaatgccacatcaaaggcaacatgacagacccttgaggtgatggaactgttttgcatcttgattgtggtggtagctacattaacctatatataactaaaattacacacacacatacacacacacaaacactcacacctgaaacaattgggggaatctgaatgaggctgaaggatcatatcactatcaatatcctggttgtgacattgtgctatagttatgtgagatattaccattgggagaaataggtaaagggtacatggatctctgtattattttttaacagtggaatgagaagttaccattatttcaaaaataaaaagttatgtttaaaaaagctacatggacacatatgagggaacaatacacactgaggcctttcagagcgtggagagtgggaggagagagaagatcaggaaaacaacactaatgggtactaggcttaatacctgggtgatgaaataatctgtgtaacaaatccacatgacacacgtttacgtatgtaacaaacccgcacttgtacccctgaacttaaaagtaaaaaaaaaagccacctccaccatttgctttatttctggggtttgtcaccaatgtgtagcctttgaataatctctgaatattcagagtgcatatggcacagtcagaaagctcaactgtgtatcctgaaacatcatttattgagcaactacacaaatggataattagcatgatcaaaatgtactgaaccacctataacgtggaaacctgacattccaccccttgttcagctcactgttttcaaggatacacgatagcatcttaggcaaactctattctcgacctctcccattctttagatgcgtgctatagagttctacttgattgggttctgcgctgaccaaagtgtgcttgctttggagaaattttatattcacttgtctaatagctaattcttcaagttgggaaatgaggtcaggtaaacatttagccacaatcctgaattatagctatagacactgggagctgtttagaatctagcctgatttagaagagcagtctttgaaagccccagaatgaagtgacccagttattctcatttctactatgtcttcaaatgcaccgtcttctgaattgtctctgaccgtcagaaatatgctggagatgaactgtgtaagggtaccaaccctgttttgttcataaagcatttctcccagcaatccatccagctgaaccttgtaattacatccagagcccgctcaccatggcgacagcggccactctatcgaatattaaatctattgatcttgagcacagagtccatctcagttttcaaatggtccgtgcagtctctttccccagggctgaagtatatctgagcttcttatgggtttccaaaggctcatcttatctcttggcacaatatgttcttttgacttgctcgtgattttgttatttcatgtggacagatgcagaccagaggaaagaaaaagagaaaggagtccaaggaaagtatagttcttgcttttcaagatcaacttttcctatgctccgttgctctcatacccaggtcatttcctgaactcctcgacctcttagtgtgagagccaactcttttatttctctcaggcactgcaccgtgctgggaagaggcacagtgggctcctggaacaaagactgccctattgaacggagccacctttgagcctataatgaaaaatgcccacaaagttgattagtcggccttgggctgcactagtcagtttgaaacatggcagaatttaactctatgttatattatcaaactgcattctagtgtatggaattctatcatggtatcacattatattatcacatcatagaataatatcatactatgaaaatataaatatttgagacatcataggaaaaaaacttgatctaatagtcagagtaccatgaaccaattccaggctttctttaaaaaaaaaaactgcgtaattttaaggagtacaagtacggttttgttacatgcatatactgcatagtgataaagtctgggcttttactgtaaccatcacctggataatgtacattatacacattaagtaatttctcagcccttaccccctcctcccctcccagccatctaggtttcattatttaattatttgctagctgtgttgcttaactttaactccttcttggcccacctctgcaaataaaaattaagtataattatactgatctcagaggtgtcttgatagaataaaacaggatgtttagctgaagcatactactcttgagaaagtaaaaggaaaaataattatctactagaaattattaacactcaagtgcagttttagaagaaacagacaaaataaccttagtgtttgtcagaatgtttggttctggagaccaaaagtcataatccctttttaacctttaaatagtctggagtcactgtgagttgcctaccccagagctccaccagccatctttttccttctagtagacactgagtcacacaattgagattaaagatattatttacttgcttttccattctctcttgcaactagtgatggtcatatgataactgctggccaatgagacatacaggtagattttctgggtgactgccatggaggactttttctcccttaaaaaaaaaagcttaaaaaagacattcaaggagagtcttctcaactgcctgactctcttcttgtaattgcatgtggtaaacctgagacttcagaaatcgccttttgaccacagagtgataagcccaaggatagaagctgcatgttgaggacagaagtgaaatgatggaaaaagccgcgtagacatagccacatgcctgaactaccctagaaccacttttttctagattttaagaaaatgaaaccggaccagacacagtggctcacgcctgtaatcccagcactttgggaggccgaggtgggaggatcacaaggtcaggagactgagaccatccaggctaacatggcgaaaccctgtctctactaaaaatacaaaagattagccggtcgtggtggtgggcacctgtagtcccaactactcgggaggccaaggcaggagaatcgcttgaacctgggaggcggaggttgcagtgagccactgcactccagcctgggcgacagagcaagactccatctgaaaaaagaaaaaaaaaaaaaagaaaaaaaacccatcattatttcagccactttctgtagtatcctgttttcttgcatctgaaagcatccttttttttttcaattttattattattatactttaagttttagggtacatgtgcacaatgtgcaggttagttacatatgtatacatgtgccatgctggtgtgctgcacccattaactcatcatttagcattaggtatatctcctaaagctatccctcccccctccccccaccccacaacagtccccagagtgtgatgttccccttcctgtgtccatgtgttctcattgttcagttcctacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttgttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaacaggtgtgagatggtatctcattgtggttttgatttgcgtttctctgatggccagtgatggtgagcattttttcatgtgttttttggctgcataaatgtcttcttttgagaagtgtctgttcatgtcctttgcccactttttgatggtgttgtttggttttttcttgtaaatttgtttgagttcattgtagattctggatattagccctttgtcagatgagtaggttgcgaaaattttctcccattttgtaggttgcctgttcactctgatggtagtttcttttgctgtgcaggagctctttagtttaattagatgtcaattttggctttagttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccatttcttgtttttctcaggtttgtcaaagatcagatagttgtagatacgcagcattatttctgagggctctgttctgttccattgatcgacatctctgttttggtaccagtaccatgctgttttggttactgtagccttgtagtatagtttgaagtcaggtagcatgatgcctccagctttgttcttttggcttaggattgacttggtgatgcaggctcttttttggttccatatgaactttaaagtagttttttccaattctgtgaagaaagtcattggtagcttgatggggtgaaagcatcataactgatatacaaagagtttcttccactggcatgcaagttcagggggcaccattacatacaacgtgaatggtgcttcttggagttttataacacagtggccttggtttactgaactcttactcacccttcaagacttacctcacatggtgcctcttctgggaagtcctcctaaacagagtagtcactcctagttaaccacagtttcctgtaattatatattgttataaagattgtaattttataatatattgaattgcagttaaatatctatgactatttctcaagtgcggaagccgagtagccacaatgctgcgttactctatggatggatacaatgaatgatattcctgtatacaatagatgctcacaaacagtttctggaataaaataactgttagtgacaatgaaagttttgtatagtaaaaattatccagatctcatatagcagattcctggaaaatactatttttctccatatggatttagaaaaaaagatctgtgatgaaaacattcattgatagcaaatatttattttaaagaaaatcttttttttttttttttgagatggaatcttgctctttcacccaggctggagtacagtggcacaaactcagctcactgcaatgtccacctcccaggttcacgccattctcctgtctcagcctcctgagtagctgggactacaggcgcccgccaccatgcctggctaatttttgtatttttagtagagacggggtttcaccgtgttagccaggatggtctcaatctcctgaccttgtgatccagccacctcggcctcccaaagtgctgggattacaggcatgagccatcgcgcccggccctttaaagaaaatcttaaatttgtattacaagatcatactttcttcatgccaactcttacttttcctgcatttgtatctgcagctgaaagacgagactggacttagcatgataacccaaagcttcattgatccaacacatcactgaacaatgcagttatgttcactacactattcttggtaaggcaagaaataatatacagatattttgaggaacatttagaaatcataagcgttgaaccaacagggctgggctagtttttaacctttagtaagattttttagctccataactccacaggctggttgataattaaaaaatttgccaattgaaaatttagtaaacaaataccctttttaaaaatttatttttaacattctctttatagttgacacataataattgtacatgtttagagggtagtgtgatgtgtaaatgcatgtatgcattgtataatgatcaaatcagggtagttggcatttttaccacctcaaacctttattacttctttgtgctaatgactttcaaaatcctcttttctagctatcttgaaatatgcacaaattgttattagctataatcaccatactatgtaatagagcaccagaaatttttcttccttgctgactataactttgcaaccattgaccaccctctcctcctatcccaggcttcctccaatccccagcctctggtaaccactattctactctctactgctatgacagcaacctttttagatgccacatatgaatgaaaccatgcagtatttgtctgcctgtgcctggtttatttaaaatgcagtatatatacacaatataatattactaagctataaagaaggataacatcctgtcatttgtgtcaacatggatgaagctggagaacaaagacattttgttagcctactatggattagattctttttctgagtgctagggatatactggtggtcaataggttcaacggtcctgacttcatggaccctatatattttatatatgtatctgttagtacgttggtgatgatggagataatgactctttatgatcaggagcagccttacgacctcctgttaaagtctccgagggtgttgaggttcagtatgtaaactgtgtggggtgggtagggtcccagctttgacttgaggcctgcataacccttggtaatgtgtcacctcaatagaactattgtgtagcaaatgatgttaatttatgagttcagtcatttggccagagcctacaccaattttccatttgtgctgatgatctaaatttggttccatccatgcccagaagcaatatcagagctcatgtatgtgccattactaccctatatgggtagttctgccttatctgataatagcaatgttaatctgacttcattagactagaagggattatatcctagatacctcacaatggtgatttggatgccatcgtattgacccagtgtgatgaaatgagcaatcgtattgacccagtgtgatgaaatgagcaaaataattgccctaaaatggtttagcagtttcccacctctcttcggaaaatctatgaatctttggaccctcatgtttatttatcatttactatgtttgtgtcaggcattgtcctgagcttaattacatcatcccctttaagcttactacaaactcttaagataggtaatcttattgatgatgaaactgagatggtttcaccatcttattgatgatgaacattggctccaagagcttaggttacttgtccaaggtcacacagcttgtaggtgggccagctgagattcaaactaggccaatgggattccttaatccattcctattccttttataccatgctttcttctagatatatcaatatgtaaaattaacctaatttttaaaacatgcaaatgtcatagctaggagacagaatattattgggtatcaatcacatacctcatgaaataacataaactttgtgttacatataatttaattcacttacaaggtgaaaaaggttataatttccaataatttttatctttttagtccttctaggtcatcactacttaaaataactgaagactccaccacgtttagtggttgtaaaaaataagaaactaagcatttttacaatcttgcttgctaagtctaatattaaatatacaactaagagtggcaatggtatttttaagcattcattatgccctcaaaatgctggcagaaaatcatagtaggaattctaataatagaagcaactctaccaaccttggttttaatgcattctttttattcatatgcaaggttccctaaaggttttatcttgaggtgttaacagggaaatctgtcaccagtagaggactaaatgaagtcacaagtcatataacaagcagagcagacaagtaaccttcacatggatgcttaagaaaatactggcagaaaccctgatacaataaatttgcaaataacttgaagacaaaaaggtacttagtggataatgactaatgtgtcctacttaaaatcaaatccttttaagctaatctaatatggtagatcaaggagaaatgatagatgtattttatcttaattgcatcaaatcttgattatctgcatattacacccatcaatgaacaacaacaaaaaaagtgacctaagcacacagccaactggattataacaactatataatatcaaacatgtggatgaaaataccagatgctctacttctacaatgtcaaatatatatgtatagacacataacacatataatcacataaatacatcaagaatatatatatatttgcatcatataaatgtgcttaaagtcctatgtcccatatattaagaataagaatagttgtgaaaactttcagaggaatgcaaggaaaattaacgagacatcagaaaataatttctaggcacagaagttaaatatagcaggacaattcaaccaggaaaaaaaacagattagatataatttaataacattattcaactgtctctacataataccaaaataaccaaacaatttggtcagataactatccaagcaagtcaaatgaatattttaaaaatccaataactccatcatcataacagttcatatgctgtaaatgtattgatttagctttgagagatagctgagacatctgaaatacagaaatttgctgttccttagggagtgttgccttgaatgaagcaggtaagctaagcttaactaagacaaaaattagaggaaagttgaagaaaggatccaagagagaacatcaaaggcagagctccaggagccagaataagggatgtgggtccctcatatgttaatagaaggtttcatccaactgaaactggagggccttaagacttaaagaaaggcagcctcagcctgaaaacatcttatatcctttctgctccaaataaaactgtaagcattccaaagctgggtattggtgccgtctcatttctgtttccctacttcattctatctctattttctttttgatatccccatcagtctttccacttaagatttgttacctcaccttatccaaacatctgagcctataattctcaagttagtgtttttgtgtctcccaactcccagccattaccaccaatcacactttcacttatgaacattttttctttactgtcaaacctcaggcagttccaaaatagcagtgtagaagcaagatgacctcactcccccagacaaaaaccaaaaacaaatagacagcaccaagattatcaccagcaatatctcagagctcaagtacaaaaaggagacagtccctggggccacagagaaatgaaaaatctctgagaaggctgtaaggtaattgaatttctatattggtaatgccccttctgtccagcaccaagtgcacaaagtatttccctccattcacaatttctacactcaaaaaagtgagatcaaggtggacaagcaggttttccaccatcttgggagccttggcaggagaactgtccctgccttaactcatggaaagcatttcaaatgccagaagggacaatatcactgaggacaggccgagagaagggaaggaggtggaactaccatccccagccctggaaactctgatctgtaacttgaaaaagggagatgccaaatcagagtggttgttcagcagcaccacaccattggaagtacattccacaggacccctgggcatgaacccttagccagccttcccacactgccaggatatcccctttggaaccccctcttgggacaggtagcaccccaattatttactagaacctaggtgaaccttggattaaggaatcaccaagagccaaaaaggaggcaacaacctagcactgaagaatctctcagaaaatatatctaataaaaccaaaaatatctagacaaagaagactgaaataaataactaactctttaatacaaagacatacacatacattcacaagaaaaaaacaaaacaaaacagcaagcagggtactatgacctcttcaatagacagaataaggaaccagtgcctgacctcaatgagaaggcaatatgtgagctctctgaccaagaattcaaaatagcagttgtaaggaaactcagcaatctccaagataacacagaaaatcaatgcagaaatttatcagactaattttatgaagactgaaataataataataaaaaagaaacaaaaattttggaactgagaaatacatttgctgaattgaaaaatttattagaggctctcaacagcagaatggatcaagcagaagaaagaatcagtcacctcaaagacagattatttgaaaatatggttaggagagaaaaaagaaaaaagaatgaagaccatctacaggatatagaaaatgacatcaaatgaccaaatctaagaaatactgctattcaagagggagttcagcaagagcaaggagtagaaaggttattgaaaggaaaaaaacaaacaaacaaacaaaaaaccccaactttccaaagggccaagatggcagcttggaggcattgctagtatgtctcttccacttggaaagacaaaagtgtgtagaaattcacactgtgaactttttccaataagcaacacaggaacaaaccacagaccctttgaaagaagcagaaccctacacaatgagccaggtgaaaaactgtaagtccccagagtgtgagagggggataagctgcctctgggatatagacctccactgggtagcctggcaatccaggatatgggggagggccataaccctacccagtactggagctgatttagtgagtggtggggagtatatgagaaggagtggcatcaggatgtgctttgcatgcacttccagtttccagtgggaatggagggaagtcgttcctgatcttacctcacaggagacctcgtggaagtctgccagctaactcaagtgacagtcataggttgagagaagcttccaactgtgattcatgatataatctcgagtggggacaaacccttggccagaactgaggggcaagtgggaagtgtgcttcagccaagggtacaggagctggatatcccacctttgttggctgactgggaggagtgtggcctaaaagctccagttgctgtcaccactaggaaggcttatggcctggggcaattttgggttctgagcgcagattgtctggaacctagctagctgttgctagtggaacactgcaggtgttcctggataatctgggggtatcacattgcccaacttcaaattatattacaaggtgagaataatcaaaacagcatgttactgctataaaaatgagacatagaccaatggaatagaatagagaaccaagaaataaagccaaatacttacaaccaactgatctttgacaaagtattaaaaaaacataaatgggggaaaggacacctattcaatgaatggtgagaacactggataattcacacgtagaagaatgaactggacacctatctctcatcgtatacaaaaatcaactcatgatggatcaaggatttaaatgtaagacctgaaaccataaaaattctagaagaaaacctaggaaaaacacttctggggcattggcctaggcaaatgattcatgattagaaccccaaaagccaatgcaacacaaacaaaaataatgggacctaattaaactacaaagcttctgcccagtaaaataaataatcatcaaagtaaacagacaacccacagagtgggagaaaacacttacaaagtatatatctgacacaggactaatatccaaaatctataagaaactcaaatcagcaaaacaaataatcccatcaaaaagtggtcagagtacatgatagacatttctcaaaagaagatgtacaaatggccaaaaaacatataaaaatgctcaacgtcactaatcatcaggaatatggcatattaaaaccaaagtgggataccaccttactccagctagaatggccattattagaaagtcaaaaaacaatagatgttggcatggatgtggtaaaaagggaacgcttatacactgctagtgggaatgtaaattagtgtaacctctatggaaaacagtgtggatatttcttaaaggtctggatatttctctatttctaaaagtagatctaccatttgatccaggaattccacttcttgatatctatacacagggaaaaagtcgttatatcataaagacagctgcacacatatgtttacttcagcacaattcataattgcaaagacatggaaccaacctaagtgcccaccaaccaaagagtggataatgaaaatgtggtatatgcacaccatagaatactacacagccataaaaacgaacaaaaaataatgtcttttgcagcaacttggatggagctgggggccattattctaagtgaagtaactcaggaatggaaaaccaaataccatataatctcacttataatttggaactaacctatgggtatgcaaaggcatacacagtggtataatggactttggagactcagaatgggggagagtgggagtgaaaggaataaaaagctacatattgggtacaaggtacactactcaggtgacaggttcactttaatctctaacttcgccactgtacaatttgtttgcataacaaaaaaaccacttgtaccccaaaagctattgaaacaaagaaatatatatatatgtatatatataattttaaaaaaggattgattgcaaaagtttctattctaatataaaaagaaagtataaaatagtttaaaccaaaacaaaaagaaaactttccaaatcttcaaatagatgtaaatatacaggtataagaacatcagagaacaccaaatagtttcaacccaagtaagattatccccagggcatataatagttaaactctcaatgttcaaaggcaaagagaggatagtaaaagcagcaaaagaaaataagtaatttggtcaggtttggtggctcatgcctgtaatcctggcactttgggaggccaagaagggtggatcacttgaagtcaggaatttgagaccagcctggccaacatggtgaaaccctgattctgctaaaaatacaaaaagtagctaggagtggtggtccccagttacttgggaggctgaggcatgaaaatcacctgaactcaggaggcagaggttgcagtgagctgagattgcactgctgcactccagcctgggcaacagagtaagactttgtctcaaaaaaaaaaaaaaaaaaaaaaaaaaaaaaaagcaagtaacatataaagaggctctatcctctttttgtctagcaacagatttctcaatggaaactatataggccaacagggagtgaaactgcatttttaaagtgctgaatgaaaaaaacctctcatccaaaaatactgtatctagcaaagctatccttcaaatatgcaagagagataaaatcttattgagacaaaagctgggagaattcaccactagtagaactatcttaaaagaaattataagggagttcttcaacctgaaagaaaacaaaaaaattaatgtacaaaaagaaaaggaaaacaaaaataaaatttgaagatataaaacccatgggtaaaattaagtacatgtaaaaatccagaatactctaatactgtaactatagtgtgcaatccatttataactctagtttgaaactccaaagacaaatatatcaaaaacaataatagctataacaaccagttaagagatagacaatataaaaatatgtaaattgggacaagagtcaaaatgtgggggaatgaagttacattgtagatttttttttgtttctattctttgtttctattttttgtgtgatctaagataagtcatcaactctttaaaaataacttgttacatatatgaaatttttttgataagcctcatggtactcataacataaaaacctataatagagtcactaaaaataaatagcaatgaattaaaacatactgccagggaaaaaattacttaaccataaaggaaaagagtaagaaaaaaagaaaggagttagaaaacaaccagaaaataagcaataaaatggcagtagtaagttcttacttatcaatattaacacttaatgtaaatagaatgaattctccaattaaaaggcatagagtggcagaagggataaaacaagacccaactgtatgctgccttcaaaaaagtcacttcatctgtaaaggcacacatagactgaaagtgaaggaatggaagaagatattccaggcaactggaaaccaaaaaaaggcagaagtatctataatatatcagataaatagactacaaatcaaagactgtaaaaagaagcaaaggagttcactatataatgataaaggggtcaaatcaccaagaaaatacaacaattataaatatctatgtacccatcaccagagctcccaagtatatataaaaacattaacaattgcctgtatcaaaatatcttatgtaccccataaatatacatacctactatgtactcataaacattaaaactttaaaaaaacactaacagatctaaagggagaaatagactgtgatacaatagaagtaggggactttaacaccccactgtaataatgggcagatcattcagacaaaacgtttttaaaaactcaaccatcagagtttaactacacactaaacctaataggcctaactgatatttacaaaacgtttcacccaacggctgcagaatacacatcttattcatcagcacataaaatattctctggaataaaccatatctttaaccattaaataagcctcaacaaatccaaaaaagtagaaaccatttcaatcttttcagatcacaatggaataaaacaagaaatcaattaacaagaggaattttggaaactacacaaacatgtgtacattaaacaacatgctcctgaacaaccaatggctcaataaagaaattaagaaggaaatttaaaaatttattgaaacaaatgcaaatggaaataaaacataccaaaatctatgggataccgaaaaagcagtgttaagaggaaagtttatagcaatttatacctatatcaataaagtagaaagactttaaataaacaacttaatgatgtacctcaatgtactagggaggtagaacaaatcaaatctgaaattagtagatgaaaagaaattataaagattacaggagaaataaatgaagttgggactaaaaaaataacaaaaaatcaacaaaacaaaaagttggttttttgaacaatggaatcagcgaaactttagctatactaagaaaaaagagagaaaatccaggtaaataaaatcagaaatgaaaaaggagtcataaaaactgagacctcagaaatacacaaaatccttagagactgttatgctattatgagcaactgtaggccaacaaattggaaaagccggaagaaataaataaattcctgaacacatacaacctgccaagattgaaccatgaagaaattaaaaacctccacaaaccaataacaagtaatgagatcaaagctgtaataaaaagtctcccatcaaataaaagtatatgacctcatggcttcactgctggattctaccaaacatttaaagaagaactaacaccaattctactcaaactaaactcttcaaaaaaattgaagaggagaaaatactttaaactcctatggagccagcattaccctgataacaaaaccagacgaagacacaataagacaaaaaaaaaaaaaaaaaaaaaaaaagaacaaaattacaggccaatatccctgatgaacatagaggcaaaaaaattctcaacaaaatacgagcaaactgaattcagcaatacattaataagatcattcaccatgatcaagtgggattcatcccaggaatgcaaggatggttcaacatacgcaaatcagtaaatgtgatacatcatatcaacagacaaagatttaaaaaatataattatttcaatagatgctaaaaacgcatttgataaaattcaacatccttttacaataaaaagcctcatcaaactagataaagaagaaacaaacctcaaagtaataaagcctgtatatgacaaacccacagataacattttactgaatgcaaaaaattgaaggcttttcctttaagatctgcaaaaagacaaggatgcccactttcaccacttttatttaacataatgctagaagtcctggctagatcaattagacaagagaaaaaaataaagagcatcctaattgggaaaaagaagttaaattagccttgttcacagatgacatgaccttatacttagaaaaacctaaagacttcaccaaaaactgttagaactgataaataaattcagtaaagttgcaggatacaaaaccaacatacataaattagtagcatttatatatgccaatggcaaacaatctgaaaaataagtcaagaaagaaatcccatttacaatagctacaaagaatataaaacacctaggaatcaatttaattgaataagtgaaagatctatacaagaaaacctgtaaaacagtgataaaagaaatggaagagaacacaaaaaatgaaagcacattccatgttcatgggttgaaagaattaatcttgttaaaatgacaatactactcaaagaaatgtacagaatcaatgcaatccctatcaaaacgccaatgacattcttcacagaaatacaaaaagcaattataaaatgtatatgaaaccacaaaagactctgaacagctaaagcaatcccgagaaaaaagaacaaagcgggaggcattacactacttgacttcaaaatttactacaaacctatagtaaccaaatcagcatggtactggcatgaaaacagacacatagaccaatggaacagagtagagagcccagacataaatacatgcatttatagccaactagtctttgacaaagtttccaagaatgtacaatggaaaaaaggatagtctcttcaataaatggtgctgaaaaacctggttaactatctgcagaagaatgaaactagattcctatctctgtctatcaccatatagaaaaaaaaacgtattaagacctgtattaaatctaaggcctgaaattatgaaattagtagaagaaaactctggggaaacactctaagacattgatctgggcaaagattgtttgtgtaagacttcgaaagcacaggcaaccaaagcaaaaaaaggacaaatgggattacatcaagttaaaaagcttctgcacaacaaaagaaacaatcaacaaagagacaacccacagaatgggagaaaatatttgaaaactatacatctgacaaggtattaataaccagaatatagaagaagctaaaacaactgaatagcaaaaaaaaaaaaaataataaatataataatccaattgaaaatggacaaaaaatgtgattagacttgtctcagaagaagactttcaaatggtcaacaggtatatgaaaaaatgctcaacatcactaatcatcgaagaaatgcaaatcaaaatcacaatgagacattatctcacttcaattaaaatgaattttatcaaaaagacaataatggatgctggtgaggatgtggagagagggggaccccttatacgctgccggtggaaatgtaaattagtacagccactgtagaaaacaatatggaaattcgtcacaaaaataaaatagaactactatatgatataggaattcaactactgggtatgtatccacaagaaagtaaatcaacattttgaggaaatgtctgcattctcatgtttattgcaaccctatttacaataaccaaaaatggaatcaacctaagtgcccatcaatggatgaatggataaaaaaatgtggtatatatacacaatgaaatattattcagccataaaaaaataaaatcttgccattttcagcaacatggatagaactggaggtcattattttaaatgagataagccaagcacagaaagacaaatattacatgttctcactcatatatatcagctaaaaatgtgggtatcatggagatagagagtagactggcagttaccagaggctgggaagggtagagaggaaggaaggatgaagagaagttaattaattggtacaaatatatgacctgatagaaaaaataagacctagtgtttgatagatcagtagggtgactatagtttataataatctattttacgtttcacgtgagctataagggaataattcaaatgtttctagcattaagaaaagtatttaaggtgatggttatcccatgtacattgatttgatctttacatgaaagtattaaattatcatatgtaccccaaactatgtattaatatatcttttatgcataaataaaaacacataaaaataaacaagaaacaaaaaaacaaaatctcatgatcagactctttgcagcttctaaaatgtgataaattaattcatttaaagctgcttagtggaaaaaagcatgatgatttctagaagagaaatatccacttccaccctagaccctgacccctgccctgctatgggtacatttttaaaattactattctgccatcccacacataaggcaaaagctgtgatggtggaataacactgatgacggaatatcagttcaggttaaaaaaatggtgaatatatgggcaggagacagggtgacgtgggtgaagaaatatggagaatatatttggaggctgatggaatatggtgagattcataggtcctattataattagtcttcttgtttgttcaagcataacgctgaccctatctgaagccagtgtggttctatcagaagcaagtgtctgcctgccatagtttgagaatcagcaatttgaaaaggcaggatgaatgtaggtggagaaacatggggctgtctttgcaggtgacatactatgggattctcaggtctcataaggattagcatctgaaggaccatgtgaaataactagtggatcattgtccatgtcacttattaattatatggaaatcagtggtaaaaaaggatttgcatctggcagtaaagcctattgataattgttccgtattttattcaaaagcatttaatgattatagtttaataatattatactgtgtatatcagatagtttagttgcatataatgttaagcctatcagttatacttcccaagtttaccccttattcatttactcttcttaattgctgttgacactcttccccgtccaagccaacattatttttcatctgaaaggctatagtagcccctctatgtctacttttgtgaactgacagtccgttatccacagaaccaccagaggaagttttaaaagaggtaaattagatcctgtcattcccttgctccaggggtgtccagtgttttggctcccctggtccacattggaagaaaagaattgtcttgggccacacttaaaataccctaacgatagctgatgagctaaaaaaaaaaaaattgcaaaaagatcccgtaatgttttaagaaaatttatgaatttgtcttaggctgcattcaaagccatcctgggccgcatgtggcctgtgcgccaccagttggacaagcttgcaaccttactataactcccttttccaccaagaataaaatccagattcctttctgtagcctgaaaggctccacacaatccaacccctgccaagctcttgaccaaatcccggttactctctctccatcttgctcagcctactacagagaaagttctctgtcactttctcaggtctaggcaatcagagaaatagatcaaacactgatttgtagcatttgcaatttctgtggtataaatactcctagatagcaacatgatgtcactgaaggtgaatttgggtagaaatgtgcagtcacactccattataagtatttccaccatacagaaacagtaggtgtaaaaaaaatctcagaagcataggtcatagtacaatgtaatataactcgtgataagttttgagtgtgtattaccttttgttttaagtgaaatgtatttacttgtaagtttatgtaacttattttaaaataacatctgtgtttcatacctagctcatgaaactcctgaacattttacaataggtttcacaagtgggctccagcaaccactctatgtaccccagatgtcctcaatatttttccctggattcacatatttatgcataaccaagaaaatgcctctatgttttgtcccatgagatttagcccagacctttcctgcagttgtattactttccctggagccttattagttaggtttatttcattatgtcacctttctcttatgggaaatggtttggggtctgaagtccctttgtttggcccctgtgctctctttccttggtgataactctgatgctaattggttatcttccaagactgaaacagaaactcagtatctcattttgtcttccaattatgcacctgtgtccaaaattatgcaaagaaataggtatctatttcctgctgtgtcttgtaaacatcatgtttattacactaacatcgttttcttccctgaatttatgtgtgcatgcccacaaggctgtttcagtaccagcttcttttatatccctttgtttaaaatacttatttctgaaatgctatctgaatttgaacatactaaaattgtttatggtcaattttaactcttatttatttgctgtaccttagggactttgtctttctcataactgtatgcccagcctctagtacatttcctggcatgtggtagacacttagaaaatattgactaaatggatgactgcatcttcttccatgcccaaaactatatagtttctaaaaaatcagttgttctgcctgactttcctgtttttttcttcctaatggcaccactcgttttttgattgccaaagctcaaaccctgagttttcttatgagcatctttctttcactcccagttgtcaccagtcttggtagtgtcccaacatgtgttctcccttggcccctgtaaattctttttaactctgccactggcccatctcagagccttatcatcattcactaggctactgttaactctcttctaattagttttcctacctccagtctttcttcacattaatccatcttcctggtgtcagaggaaccctcccgaagcaaggccagatcatgtcacatcctttaaaatggaccagatggctctgaaagcgtcaggatagagtccagattccctcacgtgccattcaggcccttccacaatctggccttaatctgcctgcccgcccttctctcgccgcaatttcttccacatttaacatgcccacgtctcccaggtgacttcctcagaacaccgtttcctcagaaagtaatggaggttgcactgaacacattccccatggccaaataagctggggaggcaatgctggcctaaacagctggtgagacttctcagagcctaagtatgttgaaaaataagaccgaacaatatgttgtttgggatacgcatttagcaaaactgtagagaaaaacaatggaatgataaatacaaaattgaaggcagcaattatctttggtggaaaggagagagctgtgaccagagagggatatatcagtggctccaatgatgttagaaattgttctctatcttaagcaaggtactgggtatacgagtgcatgttatttgttattatgttgcttttcacattttaacatctctgaaatcaggataggcctacaatcacagatagccaggtgacaattgtgctgtagttgtctttacaactacagcacaatgatgttagaaattgttctgtatcttaagcaaggtactgggtatacgagtgcatgttatttgttattatgttgcttttcacattttaacatctctgaaatcaggataggcctacaatcacagatagccaggtgacaattgtgctgtagttgtctttaccttaaaaacatcatcgctgatttctttcacttgtgttctcttttttttttcttgcatgcatgagtgtcataaggcaaaaaatctaagcctgaaagacctcttttgttaagtataaaataaaaatctaaatggcaagaaaataattcatctatgagtttataacaatatctacattcttgttttatggaaactatagggtcttcagggctgaagcagttttcccacaacctcttcccctataatagtcaatgttcatggtacagatgattgctacaatatgaagctcagtgtcttacacctagtaagtgcactctaaatattatttattggatttccagtgactatattaatattgaactcaaatgattcactaacattcttcaccaaatctggtcattttcaaaaaataaaaaataaaaacaacaacaaaacaaacaaaccaagaacagtgattggaaagcccactttgataaatgtctgacctgataagacaatccatatctatgtgctaataggaagaagtcttaaaggcatattgatactactcttctctgaactgtttctgtgcttagttttctatgatgtgccatgtagtgaattttgtcttcacaaattacttctgtttttaacataaaaatcataatatccttgagggattgtggcttatattttagcactacttataatgctatgcatacagtgttacttaatctgttgtttgattaatgattctgtttgtgtaagtgtcacattgatcatatcctcaaaacacagttcttaggctgtaattcagctctgttcttattgccacagcatcttaaaattctacctgtgaatctaaattggaagtcattctgtagtgtgtgattcttatttatttggcttatagtaaatcaagagagattgattggtagtttaataaaccgatttataagaaagtccccagtcattgtgtccactgaccttcaaggtaagaatgttggtttgaccagttgtaggttcagtaacattggatccagctttccgggagatacccagaatctccatatgactaaatatggacttctaagattcatgtagacactacctattctgatcatcactttccatgaagacgcaagtctcaaattattattttaatagaatcagccatcatcttgcagtctgtttaactgttgacttttattttcatttgcatatattcccttttatgaaagggctactccttttccttggttcacttgtgatctttatttttttgttacatgcttttcttgctgttgaacaaggtttaaattggatcactgatctaaaatattcattttgaaaattacttcacaaaaaattaaaagattaatagttaatgctttcaactgtggtctgtagtgagggccaaatggtattaaaatttgttcttccttgtcattctgttctaaataatatctattaggatgattagtaccaaagaagcgattttgctctgttgtccaggctggagtgcagtgaagtaatcatggttcattgcagcctctgtgtcccgagttcaggtggtctttccacctcagcctccaaagtagctgagactacaaatgcatgctaccatgcgtggctaatttttaaaaatttttttatagtgatagggtctcactatgttgcccaggagttcactgggcccgaatgatcctcttgcctcagcctctcagaatgctgggattacgtacatgagccactgccactagctgtgatctgtatttttctgttgctcacataccactgtagtgctaaccatttactgagttctagttctaatcatttgtggggtagagactttgggtaatatgttctattcctaaacccttgcttttggattgtgaaaatggaagactatttagaagtggaaacaattgagttgcaatctttatacacctaaaccaggaccagaaatcctggattgctgtgtttgccatttgttcttaaaaataataaatcctagaacatattttattaccccattattacatatcaaaaattaaatcttcccaagacaaataaaataaatgaaaagttaattgtgaatgtagcttatttcaaaaattacacttaaatctatacctgaaaatacttttctttagtgaagaagacatcatttaaatgtttcataaaattttagaatgaaaaacttcttgtagatttaattcattctcattttagaagaacagaattaaaattgcctctttggttaatttaaatattgatactaatcatcctaatagatattatttagaacaaaaagacaatgaagaacaagctttaataccatttggctgtctctaaagaccacagttgaaagcaccaactattaatcttttaatttttggtacagtaattttcaaaatgaatattttagatcagtgatccaatttaaactctgttaaatagcaaggaaagcatgtaatcagaaataattcttctgtcacatttcaacattaaagtcaaggccttttacaaacctttgaaaagtatttgggaataacctcattatattttaaaaaattctttctttttttttcataggatatacatgttatatgtcacctctccctgagatcttttgtaatagaaagtcttcaatgtgttcgtaataaagaattctaggtaataaaattttattttctttttaaggatatgctgaaagtgagaaagggtattaaagtattaaactactcaaagaacaccccaaaatattttcattaataagattaataatttgcactgcatttatctgaaaaaaaacacacacacacagtgctacattaatcagtttggcagttgttttaaaaggataatgtcttctgaacaacctattagaagagagagacatgatgcagacttggaggttcagcatttggaaaccatccagagcatcacactgaggagccatagagtaggcttttgtggcatagagccctagaatttttggaaattctaacttgagtgccaaaagagctgtggttatctgtgatttcagaggcagctcactgggttctctatgatgtagaaagcttgaaccctagttctcacggagatcatcagctccacaaaattggctggagaattattattattgcagagaaggagggcaattgtcagggtttgttagtctgtattctataatagtctgtgtattggtcagggttcgccagagaaaaagaacacacaggagatacacacacacacacacacacacacacacacacacacacacacgctttaatatgaggaattgtctcaagaaatatggaggccaagaagtctcagaatctatagtttgggcaagctggatattcagaagtgaaaatggtttagatcctgtttaagtccaaaggcctgagaaccagaagagccaatgacataagttctaacctgaaagccaaaggtccaagacccaagaagagccaaagttttagtcaatgtttaaaagcagaaaaagattgatgtccaacctcaggcactcaggcaggagtttcctcttacttgtgggagggtcaacatttgttgttctcttcaggtcttcaactaattgaggcccaccacagtggggaaagccatcagctttacatagtctactgattcaaatgttaatcttatccagagtaatgttctcccaaatgtctgggtaccccaggtccactcaagttaacatataaaattaaccatcccaatctaatagcttttctcacattgcctaaaagatgttgaaactacctgtaatatacattttttttttcaggcgagatttaagagaattaaaagcagggctttatgtggaaccattaatgtttcagacttggaagagatattttaaatttctagtacaactctttcactttatcttcataaagatgactctcttggggcctctgaggtaatgagaggccaccctggtccctgacctcctgttcttagacacgggcttctcctacagtccacataacccctctcaaagccaaggaaggcattacctgaggggaggcttgttttctccttcatctgcttctgctctttattctgctcctcttcgtcatttaccctaagctcttcctcctattgttcctcttacttttctcactccttgtcttattcttcctgttacccctctctctcttctctttctccttctttacctcttcctctttcttctattcttctttctgctcttcctgctctgtcttctattttctagtgtgggataaacttaataaataggttgccctaggttgttctttcttcagcctgaaggtgaaggcgtcatctccctgtgatggctcctcttttgagccatgctcccagagacataatcaaaataagagtgtacctgaggacttggtaactgcatatgtaatgcccctttgggtgacacttgacatctcgtaggaaagattgttcagggcatttgctcagtaagattcacatttaattagcacatactatgtgttgggttctatgttaggcacttcagctcaggtaggaggaagacagaggtctgggaaggtctatcataaaaaggtagtaaccttttcagcaaaggacataaaaattgtagactagaaataatgataatgatgcttatataagtttttcaagttttgtattatctcaatgtttggcattaattaatttcatttttattattgcacttcttattgtgttattattgcatctttgactacatacattaattcacttgtttattcattcaactacttacccaattatctaacatttacttagctcctactcggttctgggcatgtattagtaaataagacagatttttctctcaaaaagagataacatagcataaggactaaaaatttggactctgaaattggatagctggtgtctgaggcccagtttttgtcactcacttagacattatcttttctaagcctaatttgctcattgtaaagtggggattattaataggactatggtgaagattgaaggcattttgggagtgcttggcacatagtaagcactcatgaatgttcatcattgttattactgacagctggctcagagatttatggaagtaaaccaacaacagagaacagtgtaacaaatgtcagtgcagggaagcacttggcccagctagagagatcaccgaaggctttctggaagacatggcacttgagtcaagaccataggcagaataggagctacctggcaaggagtctagaagaggatatttcaggcaaagaagaacagcacttaaaaacgcaataggctataagagctcgaggtaggtgtattagtctgttcttacactgctataaagaaatatgtgagactgggtaatttataaagaaaaaaggtataattgactcatggttccacaggctgtacaggaatcatgatgctggcatctgctcagcttctggggaggcctcaggaaaacttacaatcatggtggaaggcaaagggggagcagagcaggaggaagtggggcagggaggtgccacacacttttaaacaaccagatctcatgagaaccctttcatgagagcagcacgaaagggggaaatccacacccatgatccaatcacctctcaccacaccccacctccaacattggggattacaatttgacatgagatttaggtggggacacagaagcaaaccacatcacagggcttggagaagagcactgaagaagaaaggttttatttattaaacggcagaagtagactttgtaggggtcagtgtcaggacagttcaatcacccattttacagatgagaagactgaggcccagctgcctctgttgaactgaatagactaaggtcaaacagctggtgaatgagagagctcatttacaccacagcctccatcaccagtgcagagtcaagtgggagaacagcctgctgtaagtgtacatgtaggaggcaagagtttatgtagagaagtttgtgtcagcagctatgtctctccatgacttatactctttcttaactagctgtgtatttaaggttattaaagcaagtattttggggtgtattattgttagacacccgtcttaatccattttgtgttgctataacagaatacctgaggctgagtaatttataaaaaaaagaggtgtatttagcttacagttctgcaggctggaaagttcaagaagcatggcactggcacctgatcagctttcggtgagggcttttgtactgcatcagaacatggtgaagaaggacaaaggggaagcagacacatctgaagagggactgaacccaaggtgtgtcctggttttacaacaacccactcttgagggaactaatgcattcctttgagaactagtcctgtcttgccagagtaattctctcactaccacaagaacaacactaagccattcatgaaggatctgcttccatgacccaaatacctcccactaggacccacctcccaataccattatattgggaatcaaattttaacatgagctttggtgcggacgaacaaaccatatccaaactatagcaaagacattaatgcttcttcttgtcagagctcatccacacttgatactaccacttctcctcattgcaaatctaagaactatttggttgatacaaaagtaatcatggttttgccattaaaagtaatggcaaaaactgcaattacttttgcaccaacctaatatttgcaaattcttagccatgtgatctggtcaagatgaagaaagggatctgaagaattaatgatttgtaatcaagaaaaaaaagtccaaatctagatatactgttttgcaggtcccaatttctcatcattagtatttatttagtccattagttgtcattcgacaaatggagctttcattaactctgggtcctaggacctagagataccataatgaccaagatgaactgccccaccccacagtgatggtggtaatgtgacaagtaaataagtgactgcaaaatagtgtgacaaatgcaataaatgtcctaagatggacatttattctgatccagagcatcaagaagggctttctagaggcactaatttcagcattgagctttgaaatagatagaggttagaagttactgagctggaaagaactggtagttaggcaaaggaggcctggggaacatcagggcagtggcctggaggcaagaggctgtaactgaggaatcagaagagaggcagtgtggctagaatgtaggggattcattcatctctggagaggaggctggagaggtatagaagccggatatgaagggccatgtgaacctgagaaaggaattgaaagttaattctatgaacgctgtgggatcatacagtatttatgcaggggagaaaaagatcagacattggattttagaaaggtccttcctgctgcagtgctgtcacagaagagattgccataaccaagagtgggtgcaggaatatcagcttggggacttttataagggtggcctagggatgaagggaagaggaaggatgggagtggtaattagcttaataactgggtgtgtgggtggatgagagagagaaatcatagataaattgcactcaccagatgctactgaatctatctgtctctgctagtcctgttcacagaaacaggggacactgggagagggagagcctgaggatataaagaggatcagaagacaaaggagtgagtttagctttagaccatttgaatttgaaatgtttgtgggtcacccaggtgtgtctgtccagcataaagcaggccagtgaaaatatcagtgtatgtatgtaaacttaataactagttattttatgaatacactccctggataaggagatcaaattccacctaggagctgggtggtttctcagcactcaaagcagtcccaacaggctctaattgagctcagagtgcctagccaggcactgggggaacgggagaaggaggagcagagaaaaatctagatggggctgcttatgtaaggccagaattcagagagaaagccagaggcactgcggaatctcttcttcatagccatgggaataatagtaaaattgttcatgaaacaccaagttgcctgagtagtaaatgaactaattttgtgataagctcaaaggacacagaagctaaaaacatggacttttgagcagataattctggtttaaactcccatttctgtccctttctatatgaccttagggaaattactcactctctctaagcctcagtttctttatctttaaatgagatgacactacctagttagatataaaaacacctagcttattggattgctgaaggattaagtgaaatatcgtatatgaagttctggcaagtttcagtgtttgtcaatagtgagccctcaatctctggtagttactgttgctgttatgagatatcccaagaaggcaaatatccttgttgccatgtttactacagcagcagggaggaaaggagcagacagccacacccattcacatatatgtgtatagaacatgtgactatacacgtatttataataacagaagacttcattattttcttgctttaaaaccataaccatgtaattttatgaaaatatgaaagaagagtgcatcccgttgctaagtgatatgctcatgtaattactggggaaacagatggccaatcaatagtagacagctaattgccttacaaatagatttagttaaagattggaaatgatgataaaagtgtgttgtccttatgatagtgatattaaggcggttcatggtcaattataataatataaatcatattgaaaagagcatcttatttctacttttaagctaataggaagccactgctttctgtattgttgagtcaagttttggaagaaaaatggaaccactcattgtgctagacaaatgctttattctaggctactttttcttccaaggaagatgagcatttgaaaagtaattatctatccattcattctgccaaccaacatttagtgaacatccactattatactttcatgcaaactttcttcttccatactctaccttcttcctccactttgctcctaaaaagtccaaactaccagaaaaatgtagaagtgggcaccctgtgtacacacatggctgatgacaaggtaaattggaacaatattttaagaaaacagtatgcttctgtcaatcaagcacaaaagtattatgccagttggtccaggaatctcacctccttggaaactatgtggagaaaataattcagccaaagaaaaaagctgcttgtatgaagatatttattgtggaattatttataagaataaattggaaacaaattatatgtccaatgctaaataataattaagaatgacaatcccatttatgaattctacataacattatgcagctatttataatgtttacagtcttcttagaaatctgaacaaaatttatgatctcataaataaggtagtttgcaagaattcaccagttctatgtttatagctatgcaaagaataagtataaaataggaaaatgactgagaaagagcaaacaaaactgaaaataattgtgttagaagagtggaatattcttttttcagtcttcaacaactcattttgatattcttttatgatatattaaatgtgaacaccacaaagaattgttctgtatgtagtcaaaatccaagatggcaccttccaaacaccaaataaaaagccttccttgcttttagaattcaagtaatcttagagcaataaatagttgtttctccatgtcttatcttccttgttttgtactgtgagaggcatttacaagtatattgaatttctcttgcttatgaattcaactgctgctgcttttcaacaaacagccttaatcctttgtttggctgtcatagttgctactgcaggaattatgatgctgccaacagagaattcaggagataaaatgaagaggtttgtaaatgccagtacacttgcacccttttcttgatattaccaactgtacatatgtgtatatctctttctatatatttgtcctattaaactccaaccttgttcagtgcgtggaccataaggtttatttaatctgaaaacatgctttgcatgctataattattattacagaagaaaataaatgtactcactaatcagaatatccactagcaatgaagaaggaaaatgctgccgtccttgggggtagatttctgtaatgttcctcatgcccatgccagaattttgttttctttttctttcaacttcctagaccctaatttccaatgtcagaatagtttcccagtcagaattgggtaggagagatggaagtctgtgctggctgcttttataaatattatgtggttgttattttagtgtgattaaaaaagaaaacaatgactaaaattattcgtaatgattcatattaacattgtgaggcaataattatatttctatatttctatatatatatatattttgagagagagtctcactctgtcactcaggctggagtgcagcggtgcgatctcggctcattgcaacctctgcctctggggttcaagtgattctcacgcctcagcctcccaagtagttgggactataggcgcactccaccacacctagctaattttgtatttttggtagagatgggggttttgccatgttggccaggctgatctcaaactcttgacctcaggtgatccaccagcctcagccacccaaactgctgggattataggggtgagccaccatacccagctgggaataactatatttctaaatgacagagcttcattagggttagacatttgtgaggaacatgcttgcttgctggagatgcttggcttgcaggtgcctgccatttgcatgttgtatagtgcacatctgaactttggagccactcttaccatctgccataaactgaaaggtgcaatttccaaaactgttttccttaagacccaggatctgaaaaagattatttgaaaatccccttagagatggaaagaaagaaaaaaagaaagcaatggtccttttgcttgtatattattctattcaatcttcactttagataaaaatcactgtaggcctttggtgacagaaacagatgtctcaaagaggactggatcacacaaagtcagatttcacctgggtagaaagcattctgcattgacaaccatctgggtttcaactagatgaaatgtgatgatgcagaatattgtctcataatacttatggatgtttggctaatagcaccagtgatgactgaccaaggccactcacagggagcagctgcacaaatgtatgtacgtagatgtctgtgtgtctgtgtatatgtaggcatgtgtgtatatataagcatgggcatgtttatatgcatgtttatatgcatatacacataggtgtgtatgtgtgtacatatgagtgtgcatgtacatacacatatatacatgtatgcgtatgtatatgtgtgtatatatgtgtgtatgcatgtgtatgtatgtgcactaaatgtttttaattacatttgccaaatgcatttttggtttatataacttcccacatttccaaggttactgacataatttaacacccaacatatgtcagagttgttattttgacttttttaaaattaaagatgcaatttctaaatgagtgcaggagacttcagaaatattactgtgctaaatttcaagctcctgaaactttaaaactcagaaaagaagggtgagatcttggacataagctcctgttttcatttgcttaaaatgcgaatagattgcaagacatccaggatccacatttccccagtaaaggccttgagtcgtaagacactatcacaggcaaaggcagtttccctgccagccccctcatttcacagaatacaagtgtagcccttgtgtaggtaagcgagtccagagtgtcctggcttctcgtgggcctctttattgcaaacagagtagacttttaaataagccagagccttagcttccagaaagataatccgaggcatggaaaggatggttagtctgatgagctaattttaggacctggaatctcagcagcatccttttaatattgcagcacacgctgctgtttccagggcctcttcaggatctccttaaataaattaggatctaaagagccctcctgtttccttagagttaagctaatgctgccagcagtgccattttggttccttagttgctctctgtaggcctcataaagccctttctcaaccctccacatgctgggcaaagcacaacctggtggtcgtggctcagacaccatttaatttccttctcaaaccatcttgttttatgtaagttgaccttttcatgactgtaaaatttcctcattagaaaatgacaggctctctgggattgcaaacctttcctgataacactctgtataaaggtgtctgtgaaagatttttctcacttaaaaatgaaaagagacccttttgtctactccactagcagctttcagagcacacagacaatccacttgaattttgtttaaaaaaaaacaaacaaacaggaaaccttcacttgttggggcagccagtaagggggtgtcagagatgaatctgaaggatctggttttaagaaactcagaatcattatccacttcattttcagagtacccattctctgttaagtatgtaacatatgccattgctagaatttcctacagctctacaggggttcctattacagttgaggaaacttggattcagaaaggtccagaggcttgcccaaggtcattgagcaggagagtgacagagctagtgcttcaacctaggtccttgtggctctgttctttccactgcatcattctgcctctcaaggcaatacttgctcaaaaaaataaatttcagacagacatgctgcagatgccttagtttgcatggaatacacactgttaacaacagttattggattggagaattactagggtttctgacctcagcaactggagtaccttcgctacagtaccagtcctgagccaggctgctaggattcaaaccctttcatggcccctggctggctgtggcattcagggttgtcacttctctggagtgaggtctcttgagcagaaacatgagcacatgtaacataataccttcctcacagcattgttgtaaggagtaaatgagagaatgcttgcaaaatgctgttgggtaattaatacaaagtagctgttattattaccaaaatgacatagaaatgttgctgcctccctgcccataggaaaaaactgggggagcaaatcaacttgtgacttgcaagaaacctcaaataatagcaccaaataaagaaggctgatgtacacaatttgccaacagtggagggcattgcgacaaaaaccgcccgacaggaaggccgaggctgtcacatcccattactctggagctgtgacttcatgctgactcagccaaaggcaggcagtaatcacagccaagtttatatgctcagaattgatgtggccatatttccacattctcaaaagcaaagccaagagaaaacggcgatcagaaagtttttatgggcctcatcatgaaatggtgacagctccagcttattgatttgcctttagttaacctctgtaattcgaagtgatcaccctgccaaaaatgaaggtttatcaagggaatcctttttaccttttggtctttttggaacaaagaccttgtccgttcttctttattctatagagtaattgatttgggttgatggtaagtgttcagatgagatttctggaggacatttatctgagtcgtcccaaacaatcattattgtttatgttgatgatgtttttgcctcacccattcagaaatgctgcagtacattcatgggcgcagtcaaagcagtgttttcaattatctttttgtatttctaattggtagaaataaattagaagacatgtatttgactactattctgcaccagcaaatccattttttttttaatgatgctaattgtggttgtcatggaaaccctgaaagtagttaggctgaattgctcaatgtatttctttttttctctgtaagtgattatttctttggctgatattgaagttcttctagaaagctattatgcatacgctcacaagacatttactctaagttaagatgctcgataaatctgttacaccaattatatttgtactgtggttatgagaatcaatatgcttgagatgtaaactgatcacctagaaaagtgaataaaccagttggcttgtttttttattttattttcctgaaagtagtgatgtaatgcctagatgattttcaaaaatattctgcttgctttaaacttttggtattatttaatgtctgtgtgtatgcttttcaaatgtcattttgctgtaacttttctgaaaaatgtcaaaattatattgaagagtcatgtctgcttcttgttaatcctgttggcagatttcagggggaaaagagatatacatggaggatataggctgaggaagaaagcctctgagtctaaatggtcgtagataaaatactagatgcatcatttattaattgtgcatacttaacctgggttgtagtcttcacatgtaaaatgagagtcataacctcattgggttgtttaaagatgaagcgtaactatacatgtcatactgctcatatggtggcaggcatataaaagatgccctagaaattttactcttgttcctgcctaagtctccctaatcaaccttcccttctgcaccctctcacagggactcactcctgggtttctggaattatgtgtttggattgaagggagagaatgtttggctagcagaacctcaataaatttttagcatccttacagcatccccatgttatgggaaaaaagcaatgttccgggacaagcctgacctggaaagagaatcttcacaaggattaaaaaagttccatcacagtaacttccaaccaaataccctctcaagaaatttattcttccaaaacaaatatcctgttgattggatgattgagttggggtggggagagagctctttaggagcaatagtcaatagttcacccttgcatgtgtgagttttagaatttgtacaaccacactttttttttttttttttttttttttgcaacaaggtcctcactctgtctctcaggctggagtgcagtggcaggaccatggttcactgcagcctggacctcctaggctcaagtgatcctcctgccttagcctcctaagtagctgggaccacaggtgcatgccaccacacccagctaattcttaaatttttttgtagagattgagggggatgttgctatgttgcccaggctgatgtcaaactcttggcctcaaagtgatccctctaccctggcctcccaaagtgctgggattacaggtgtgagccactgcacccagccaaccaaacatttttaatgcagtaatagagctactttctcagctcattacaccggtacagaatctttcttcttgggatcatgaagtattggtagcatgtctttatcttactaaatgagtctttatcttactaaatcttccctactacatagttggttcatattatgagtcttatttattttaattaaagtgaatatagaggcaaatttatgtttccaacgtacctcgtatatgcctcagttatagcacttaccacgtggcattataattgtttgcatatattcatcccccatagattaaacaatttagagatgactgcattctctgaaaccaaacaaaactaaaatttgaaatcttgagtatcaagtaagttaggctcttcactcattcagtgattatttaatgagcttctactattttccctgtgctagactaactgttgggaattcaggagtgaatgtggcagacatgtttccttcctcattaggcaatgaggctcacatctactatggcagcggctaagtgctgtcagcagtgaacttccagctctgtagcacttagtggctccgtaagtggagcttgggactgcccaagagtcaagtaagtcttcctgaaggcaacggctttgaaggagagaactgaagacacacaacttagagggttagggagagtgttccaaaccgagggaaaaacaaatgtaaatggacacagaggtcaaaagacagtttcttgagttcttgtgcctacacgttcctagggaagggtctcaacccctgcatgaaacatacactgatgacatgaatttgctgtttttaaggaggagattgcatttgttacataaactgcagcatcagcagcttgggatctgtgtttcttaggctgaggtgacaccactgagggtccctgatggtgcagcctttcacgatgactttgcagcaacacagcaccctcccagtgcaccctggaatggagccctgggagggaacaaagacaccctctggggtttctttgagatttttgatttgcttatctcttcctccagacttcaaacacattttggtttctctaggggttgctcattcaaatgccaagtagacaaggatttgaactaattatctaattttaaataaggtgtagtagggacatatagaattaagggaattataggagacagcatggtgtttggagtccagtcagagaaatctggttttgcctcctgattccttctctcaggtctaggtaaacttcagcatgttcttcttcccatctgtcaggcagggataggaacacctgcccagagggctgctggaagatggagtgaaaatgacacttattacctgtttaaagtggtgcctggcatcatccacaagcgagaattaggaaagagagtaatctttagaagcctcagcttcattgctttttttttttttttttactgctgtattttcctttcttttttattttttaaagcagctttattggaacataatttacataccatcacatccattttgagtgtataattcaatgaattttagtatatttagagttgtgtgatcaacaccacaatctaattttaggactttcccatcatcctagaaagaaaatatttgaatttttttgtgtctatgaattctaaactatgctcaggaaatattcaatttaaggacccaagctaatcatcatgtttacttaataaccacaggttgtcatatatcatcatattgtgataattatcatcaagaatgttaactatttaagtatgttacaactttagataatttacttgttgatattattaataaatgttaaaatggtctttttttgggcaaacaacagttaatgatgactggtggtacttattcaaataaataaaaaaagtcttgccataaaacctttgggaaaaatatgttttttagtttgtgctgttatgaaaaagtagctagtcaaataatcttgaatatattaccagaaactcattggaaagggcagagttaagtagagaggccatgggattaggcacgagggctctatagagccagagttcaaacccaattcagccagttataggctgtggaatatgaaaccaaatgccttaactctctggcccacagtctcttcatttgtaaaatagaggtaatagtaggtgtctcgtagggttgcaggaattaacttatgatatatgtaaagccattagtattgcagctggcatacagtaagtgttcaataaatcactgctggaattttattgagtgtagactcccagggaattgataaaagggaccatttattaaagtttaagaacacattaggaaaagtagagaaagaggttgctttcgtcttaagtagggaatcaaaaaagcccccgctctgactggaaaatgacagtttttaaagaactaaataataataacccttgatgtgtattctttgtgacatagagatagagctattgcactgtaatctgattttgttcttttagctatgaggagaggagatgagagagaccaaagagacagccgatcttgctaggagaaaggctcctagacagacaccctgaagcctttcctttacttaggtttattgacacagggagggggtcatccatctgcagctgggcccaaaaaatgccaggaatagccacaaaaggctggagaccatgactggcagtttgaatgtcatccttgctcctggctgtagtgtggctggtgcatagttgggggtgaggatattaacacgaaaactagtggattcagaacaagtgggatggcctggttcccaggggtcttcaggccacatggtcacttgcaggattgaatgaagaggtgatattgactagggctgatgccctgtgattctggggattttgaacatagggcttgaataacaactcaaattatagatggggttgtaaatgggaaagacaaccacaggaggaggtgaggcaggctgatgcaatgacgagaggccaggaaccagggtctgtggatagctggctctatcactcctagttggtattcacatccttttaaaatctgaaggtgctttaatctttcctggcccattctacaccaaggagagctttctaagccccaaggtgtcccaggctgccagagaaagtttagttccatgtgtctgtggtacacattaggaaaagtagagaaagtcacttgtgggactccttggttttccttcgggttagagctggagttatctctgaaggcttgatggaagctgatttcccaagatccaaaagctttctttgtcagggctggcaccagggctcagcgctttcttagacttctggttcagccctgacaaggttttgaaaatcaaattaaaaagagactaaatataacttgtagaaaacctaggaggaagtgtgcttacagacctaaactctaaaagatgcaatcaagtcctctgaaaaccagataattgactttaaaagacaagtgtagatgtattaggtggaagcatattagttcacttattctttttttcacttatttatttttatacaaacatcaccggttttctatgaatggaaggtggcaaattatctgtgtaagaagattcaggtataatcttccttctcaatgagtttctgttcttgatcagggttggcaaactatgcctggcaggtcaaatcctacctgctgactgtgtttgtaaattgagctttactggaaaacagccatgcccatttacttaccgctattatagctgttttcctgctataatgacaaagtagagtagttgtaataggtatggtatagcttgcaaggcctgaaacatttactgtttggccctatatataaaaagtttgcttcatcagcaagatgaacagataaagaaatgattatatatatatatgtaaatatatatacacaccatcatttattgatattatatatcaatgtgtgtgtatatatatatattatatatatatgtataccatcattgtgtgtatgtgtgtgtgtgtgtgtgtgtgtatatatatatatatatcagggcctggtgattgaggggaaaatggggagatgttgttcagagagtacaaacttttatttataagttttgtagatctaatatatagaatggtgactatagttaacaatactgtattgtatacttaaaatttgctaagaaattagatcttaaatgttcccaccaaaagacaaaagacaaaaaaataactaggtgagatgatagatgtgttaactaacttaatcatgggtgaggtgataaatgtgttaactaacttaattgtggtaatcatttcactatatatatacatatatatagtgtacatatatatatacacatatatagtgtactatatacacgcatatatagtgtactatatacacgcatatatagtgtacatatatacatgcatatatagtgtactatatacatacacatatagtgtactatatacatacacatatagtgtactatatacatacacatatagtgtactatatacatacacatatagtgtactatatacatacacatatagtgtactatatacatacacatatagtgtactatatacatacacatatagtgtactatatacatacacatatagtgtactatatacatacatatatagtgtactatatacatacatatagtgtactatatacatacatagtgtactatatacatacatagtgtactatatacatacatacatagtgtactatatacatacatacatagtgtactatatacatacatacatagtgtactatatacatacatacatagtgtactatatacatacatacatagtgtactatatacatacatacatagtgtactatatacatacatatatagtgtactatatacatacatatatagtgtactatatacatacatatatatgtatatgtatatagtgaaatgattaccacaattaagttagtgtgtatgtatatatacacacacacacacacacatatacatatatatttatgtatgtcagtagggtggaaatagaaaatgatgatgtggcattttaggccaagaaagagactatggaatgaaccccccgaccaaccaccaccacatatctcctgaaatcctgaagtgacatgagactgcagagtgtctgacattgttgtatcaatatcaaataagaatgtaaagactaatctctaagccaaaggttttatttgggaatacacaaatgatagaattgcaatttgggatgtccaacaatgatagactggattaggaaaatgtggcacatatacaccatggaatactatgcagccataaaaaatgatgagttcatgtcctttgttgggacatggatgaaattggaaatcatcattctcagtaaactatcacaggaacaaaaaaccagacaccgcatattctcactcataggtgggaattgaacaatgagaacacatggacacaggaaggggaacatcacactctggggactgttgtggggtggggggaggggggagggatagcactgggagatatacctaatgctacatgacgagttagtgggtgcagcgcaccagcatggcacatgtatacatatgtaactaacctgcacattgtgcacatgtaccctaaaacttaaagtataataataataaataaataaattaaaaaaaaataccctagcacacattcgtcataacaaatgtcggttgtaattggaaatccacattaaatttgaatattccccaatagtttaaaaagtaattataaatattcttatctagctacatgtatttgtttatgtattagcccattcccagcagattttatttcattctttcacagtaaacaaattcagggaatttttactgtaagttttactttagttcaaattcagtaagttttactgtagttttcatgttaatggtttatatgggttaaaacttgtaccctcattcttaattttgtggtactctatagtcaccatatgaaagaaataaagttacttttggggaaattacttgaataaggtcaaatgagatctgcaactgtgggatacacttttgtcaacattttaaaaggccaaccaggctttggtcattgtacattgatatggtataggcctatgctttgattatattcatttcaaagctctgtattaattaggaaataatggctcattctgagaggaaatgattatatttgattttgagaattttgcatttgagctgataaaatgagatacaccagaaaaaagtgaaaacatgaaaattaagcttcagtgaaagtgaagtataggaaagttttaaatattttgataatagattatatatcatatcaatatattatatattcctccctgacctcattcttgaaatctcacccaatccttgaccttccctggcaaagatcaaaattgagaaaaagatcgggagtggcgtaagtctcaggaataaaataagagggcacctgatgttcacattgcttggtaatgaaaaataataaaggctttttaaagcagttaaaaaaaaaaaaaagatttgcaatttggggcacatgcccagacctggatggcctctcataagtcctaagaccaaagggaaagttagggttttattgggggaaagagggggttatgcaagttgttttgaaagaaaattcattggttctggtgatgtcttccaggagctggtgagctctgattggtgagtggtggcattgctaggtaaaacttgtcatcttaaagtcacagcaggctgttttcttggaaggggcttgcacaacagtggatctggtgagtgtttttgtttaagaggccaactctccttgtgctgttgtccatgtgtgactcatgtagcaattaaggcttggaaaagtttcttgtagcagtttttgttattgggccagccctgtgtgagagccctcccatcatggccctggctccattttgccagagtttgacacgagtgactctattttgattctgacaactttcacagctgcaactcttgtaaattcagaaggggctgagggtgagctatggaactggagaggcctggtgtgtgggtgacttctgtggtcctgcctggaacaaaggccactgagtgagaaataggttgatttacatcagcagtgggtggccctataataccaaggaggagtttcagatgagaaagaccaatatgacagtagaatagaagctctagggacttaattcagcagtaagaatagcagctaacattctcataacatctaccatgggcaaggcactgttaacatctaataactcatttagtcttccaaacagccctgtaaggtgggtgacaattattatcatctccatttgacagagggtgaatctgaagaaagagaagtaaaataatttgttcaaatttccaccgcagtgaagtgactgctggtatttgaatgcaggcagtgtcaggatcgtgggcttacctagtattcccaaccacttctctcaggaaaggggtgaggagacaagattgagtaggtatccaagaaagactgagtcaatcatgaaagtgactcagtagcagaaatgacaacttgagatgcaagtactacgcaaaaatagggacatacacttatgtatttacgcagttatatccatggttgtaaaggttgatacctgctacaaatgtgagtcctaaattttccaatcaagttgtatagtgatggcaggattgctcacctctcataaaccagaagtcagaggcttagagagagttcactcggaggaaataccatgctctgagcttgatattcacgggtatacacaaattgggcatgttgaggtgagttaaatatgctgcttgttaaattaaaggtgttcaccgtgccttattacattgatcagctcaccttgcctcttcccaactctaactttagaagaggctgcataggtggatgtgtgctagattactgaatatactttctctggtgtttgctttacatcttatccacatacttaatacaagtccaatagcagcttgcctgtgtttaaacctgtacagtgttgatcagttgcacgccattcagtgaactaggcaggtatatgtctgttacagcaaatactgcgtttgaatgaagagaaccaatgtctggggggggaagtgaaaactatctgaaatgggttagttgccctagaaaatagaattgggattctttgtagaagaatatgcccacctttggccctgatctgggattccatttaaaacaatttttttctacagtattatgccaaaaagtttcaaaatctatttggcctttgcccattctaaaatggacaaataatttttttcttttttttccagattttatttgaaaccatagattaaaaggatttaaaggagggctacctagttgttcgtaaaatatgttactaccttttacctttttgatactgtaaatttaccacgaaaggtaaaggaagtctgacagacattcccagtcatgaggaaattatcctagagagttgatgaggtggcaagagaagaagacattgctatcatggctcacagaatattgccagagtagttgatgtatcttcttttccaaccacagccagtacacttgtgggctttaaaaaaatttaattgtaggtaatagaagagttttgccatctaaatacatcgctgacttcatattgcaagtcaatggaaaaactatactttctttatagagatttaattaacactaaatttaatggaataattgtgttgataaagcttactaaaggttattgagatttatagatattaagaaagatcatacaacttcatatagctcccaaatatttcaaatgtgatattcatgtaatgtccttaggaatttctttttctggtaaatgtcatgtcattttaattcattacaaaatattttgaaatatggaaaaattttaaacttacctataattttctctataaatgaacagtgctaacattttggtagatgcatgtttattatattttatacagttgaactcataatatattttcaattcaatattctgcattttcataagtaattttctgaactttcccctatattattataatttgacaattggattatttccaatttatgctattagaaataaagttaaggtaaacatttttatgaatctttgtgtgtatttctgttcatctctttagaacagagacccggaataaattctcgagtcagaaagattaagcattttaaagttcttaatgtagcttgccaactttccttttgaatatttgtgataatttgatacttatatttttagcattgagtgttactgtttttcctaatctctgactatttaataaatactgaattgtatagctttatttttcttttattactaaagagacttaattctttcatctattagctaattcatctatcagcttgtattagggttctctagaggaacagaactaataagatagatgtatatatgaaggggagcttattaaggagtattgactcacatgatcacaaggtgaagtcccgcaataggccgtctgcaagttgaggagcaaggaagccagttgaagtcccaaaacctcaaaagtagggaagctgacagtgcagccttcagtctgtggccaaaggcctgaaagcccctcagaaaccactggtgtgactccaagagtccaaatgctgaagaacctaaagtctgatatttgagggcaaggagcatctagcacaggagaaagatggaggctggaagactcagcaattctgctctctccaacttcttctgcctgctttatactagccaggctggcagctgattagatggtgcccacccagattgaggatgggtctgtctctctgagtccactgactcaaatgttaatctcctttggcaacaccctcgcggacacacccaggaataatactttgcatccttcaatccaatcaagttgacactcagtattaaccatcacatagctcttttaatctcctcttctgtgaattgtcaactcctgaccttcaaacactttcctgttgatgatctggaagttttcttactaattatatgtatcgatgtaacgtactaatggtgataaaatgaacagcttggggcaaaatttagggatagataaacctcaagcttgttataatcagtatgatccctgcctttctctcttcctttagttcttttggaaaatggtcaccatcatttggtataatctatcatttcttaatatatttctaaggcatctaggtgatatattacattctctccctttttcttagagttttttttagtgacagcttatgattggggcaaatttagagttgaagtgtttcaatgtgtctttacatgatatgtaggacttagatgctattaatgttctcacctttgatttatggatcctggatcttggacatattgaattgtagaaaatttcccagaaagcaacatagtgagaatatccagatcaaaatagaattttcaagagctgatgttacatgctgctcacgatggcaatgaaagtacagttgaaccaagaagtcatggatttagttgtaatgtggatggtagttcgtttcatctaaaccagtggttctcagactttagcacacaacagcattgcctagaggggctgttaaacacaggagcgggtccccaccctggagtttttgtttctgtataggtctggtgtggataccgtgatgctgatgcttttggtctggggacaacaccttgagaccactgatctaagccatctgggggctgagtgtgagacaagatattacctttttccatggtgtagactcatatcatgagatgtgtaaattctaaaatcttgcgaacaggagaccaaaattactgtcacagtgtgggggtccaacaaagatataatgttacctccagggggtgccatttccttgtgaatgactgccttagaagttgtgtataaggtacatgaccatacagaggccctgaagtctggtagtggaaatacattttcctttgtgatatctgatgttacttttaaacatggaaagtcctcctccctttcctctaagagtctcctacctgcaatctaaagatcaaatttatagtcacctacgtttgctttttttaatgaattctttttaacaccttcattataaagtcaaattctgttcatgtattctgtgaggtgatgattaaaacagcatattattttcctaagtgacaattttctccatactttttgaatatacatttgtttttcattcactgatggtggaatctttctcgtatgttgtgtgtgtgtgtttgtattctgagactatttatattgcctttgttgtgctagttcattaattctacaaatgcttactatgttccaagcactgcagagatatcagtatgaatgaaacagtcatgaataaaacacatgtggactctgccagcatgaaatttaccatctcaatagtctgttccattgttcatctgtctattctagctcaagcatcacattagttttaattgtcgtagctaaagaacacattttaatctgctgtagagaaattattccttaatgccattaaaaaagttagtaatttttgtctatttattcttcttaatataccttggaataattttttcagaaattcaaaaaggggaagaaaactctttgtgactttcattggaattgtcttgcagtatattttgggaagaattgatatcttttataaaacagttttccctcccaaaccatttttgtatgcctttatttattgggatcttctttcatatctctgtattataaaataacatgcaagtactaaaatgtgttagtctgctgaattttttggaatgctttttatcagcaatatgagaaattccatgaaactgtagaactgggcccacaaggaaggaatgaggcttgaggttatcaaacagagaagggaaagtacagagaaagaattactctaaagcaaaaacagtaggaaaatttttatgttatcaagatagtcatgtaaaataatgcatggtccacatgcataaaccacatccaatgctagtctatgtattttttcttgaaatgtctgtttctcttgcaaagtatattgccatataagttttaaacagtgaggacatcagtctctgagcaatattcctgacattgtgacaacaacgactggcttttgctgtacatgtttgcaaacattggttgagacttgtaggctgacagcctaaatggacaatatgtccataatctgcatgccaactggcacatgctgataacatctgacaggccactcttgtcaaagcttttgaacacctaataaatacaattataccccctttaccctttgaaaaatctgagatactggtttttccctttgagttacagatggtgatatcataagagctttgagacagctgctcagcctcattgatgcaaatgcttatggcaaacaatacattcttcagatctgtggtcgtctttcttttttcttttcctgcttgctaatgccgagctgatgatgcagaatatggacctcagttgcaattttagtattagaggtcagaaaacacatagagatctgggtgaacaaagaatgtgcaataaccacattttacctgtcctacattgtttgggaatgagctcctattgtgttaaaatgaactgctggtcagtgctgtggaaacaatttatcccaagaacttattattggcttagtgattgttttttgttatcatgggttctatagccactgctatgattgggttagatgctcatttcctttaactgtgatgttttaagaaaccctagcttaggtgaatataattgttaccatttataatagtaggttagattctcatcttctctgtctccgtgtaacaaagataataaatcgagatgataaaatttaataatgtacaaagtatttcattgttagtgatgcattttcaaatgatgacctgtgaaattgaaaataagaagggagaaactttttttcccctctcctattaaggatcactgaccggcttggaaaaaaaaaatcccaagtcatgtaaaaggaaaataatttgtttgcatttatatttttattaagagagagaaatataaacaactaaagatattcttttaaagttaaaatttggggttttaaagtttcattggctaactacgttaaattaagagaaatatgtaatttaatgtgagagtaacaggagactgcaggattgggggagggagatgaatggtatgggggagggcgagactggcagacagagactgcagggaaactagaggagagaggagaaggtggtggggaaaaaaagggaaatgaaagaaaggaaagagaaattaaatgtttaataatagagccaaaggacaaagaaaagagcatgtaggaggatggcgtgagctcaggagtttgagcttgagctcaggagtatgtcagcctgggcaacatagcaagacttcatctctactaaaagaaaaaaaaaaaatctgggtgcaatggtgagcacttacagttccagctacttgggagtctgaggtgggaggatggcttgattcttggaggttgagtctgcagtgagatgagattgtgccactgcactccagcctgggtgacaaagtgagaccctgtctcaaaaatgaaaacaaaaacaaaaaacaataattgatagaaggaaggtgataagggcacatgatgagacagtaagagggagaaggaagcaactgcaactggaactaaaaagagaaatgcttagagggctttccaagctctgagatgactgtgtgtcttggcttgggttcctatcttgtttccctggatgtccgaatcagttactaccagatcctctgacagcccagcctgggagtctcttctttctatagctggtgtcccagattcccagttgcttattactataaccttggtctttatggtcaatgctgaccccacctggactcggcagccaccagtcttgcctcttgcctagccctgattttgtgtttcattttctgtcattgggtctatctggtttttgttttgttttgttttcctatgccaagcatctgtctttggtaatctccctactacttttttctttctaaatgcaaggtattccctttctcctataagcgtctcttctgagcctgggaacctttgactgcagcccaagccccatgtcctatatccagtgctctcatgatgggaaccatcagcctggatggccgaatccccccattcctgatggtctgctcacattgtgatgcaccctgctgaacctgtcatgaagactgcctgaaactctacattatggatattttggctgacttccttgtttggaaagtcttatttggttaccagataactggatcatgtcaaggtccaaaaatatgtcaatttttcctttgaaatgttataatatattattttctgccttgagattttttttttcaaatgtcaagggggcagggacaatgttttaaataaactttccattgagattctggaaatgattatgaggaaacaactgaggttttagaaatgtaactggaaaatgtaaaaatgccatcaacttcctagttattcccaaaagtctctttgacattgaaatgatgccaaaaatatatcatgtttgttctttgagaaattagagctctctcattccataatgcaaaaaagttgtacttgcaaataatatcccaagctgcttgctagagattggatgaaattaaatagctgctgatctgaagtcatttcatgtctgacttgtgagtacaagtgttgggcacaattgaagttttctttctaattaaaaattaggctttttttctttcataatcaacttactgtctgtagtggttcacataattgctggtagcagcactttccattgatcctaatttgtggaaggttgtaagatgagagaacttagattttcaccataattcacctttaaataaaaaagaggtaatataaaaccttgtttggtttgtttctgaaacttttgttcctttgctcatcctgtcactcatgagcatgttctgattgactttgtgggaagaggacacagcattagcatttcacctggtctgttaggaacaaacaaaaaaaccaaccaatcaacaatgtcttaagaatacttgacaaaacttaaatctatggctgaatctacataattatgttagaatgacctggtaggggaaaatgtgctgggcctaaagtgttgtttcacagctcaagctgctgcatgaacagcatgggcaggtcccctgaatgacatgctgggagctatgtatggctccgggtccactgagctggtctcatcttccccttatgagagcgatggtatgacaggtgcagtgtgtgcacttgtatgggatgacgggttggggtgactgcaggtgaaggaggcaggaagaagcagaaagccttggtcttatgcatactgcccccaaggtgtggaagccacaggtggtcattattatgaaatctgggaagtgtaatcactgggcagatcataataacaggtaacccaggtggcaggtgagggttactatcaggtgggcacagtggctttgggagacaagaccgttaacccctagattggacttagaggagatcctaggggtggatttgtatggagtaattttcctagactaaattactatttagttataaccatggatgctattatgggttgaattttgtaccccccaaaatacataaaagttgcaaaccccagtacctgtgaatgtgactttatctggaaataaggtccttgaagatgaaattagttaaggtgaggctattaggataggacctaatccaatatgactgaaaaaaggggaaaatttgtccatagagttggaagcacacacagggaaaacagcacgtgaggataaaagcagagactggggtgatgcatctgcaagccccaaagaatataaaagattgctagcaaattaccagaagccaggagagagccctggaacagatttcccctcaaagtccttaaaaggaagcaatcctgccgacatcttgatctcggacttccttcagaactgtgaggcagtaaacttcagttattgtgagccattcaatttctggtacagttatggcacccataaagaatgaatacaggtgctagaggattggaggtttggttaacagaaaatattagtactagaagaaaccctagaaattgtataattgacataggaaacactactgtactgtatacttaaaatttcctaagagatagatcctaaatgttctcaccacaaaaaatcaagagcagcagcaaaactatgtgatgactatgttaattatcttgattgtgatgataacttcatggtgtatatgtatactaaatcatcaggttgtacatcttaaatacagtcatgtaccatgtaatgtttcagatacgcgagggatcagatatgtgagagtcgccccataagattacaataccatatgttcaccttaccttttctatgttcagatatgtttagatatacaaatacttaccattctgttacaattgccgataacattcagtacagtgacatgctgtacaggcttgtagcctaggagcaaaaggttaggtgtgtagtaagctataccatctaggtttatgtaagtacactctacaatgtttgtaaaatgatgaaatagcctaatattgcatttctcagaatgtatctctgtcattaagagatgcatgacttatatatacaattttttaaaaaattgtgtagttgagacctcttatattaccaatgaattactgaggcctagaaaggtcaaatgaattaattgcttgaggtcacctagctagcatgtggcaagtctgagactaaagcctctgtcttttgactcttggtctgtgcttttcctgtacttttttgctcctgtgcacaattaccatgtagcatgcgcatagaaacacagattagaaatacacagaagataatcacataacttagaaatgagttttgaaaaggtgtagccggactccttatctaaaattaatctaactgaaattgtattttagattaactttgctacttgaaaaatgctaagtggctgcctgagagcaatgaaatttcttcctctaatgtgctcctcagggcaggtagcccttatcattgttttccaaaccactagccattaacatttgtggggtgcctgtggagtatctggctctcctagtgtctcagctctctgtacagtcagaggggtggcagctttctgcccttggtcacaagacaatgccccattgtgcttgcttatccagaagatcaatcaggaagagaagcacgccatgggctgaactgcagtttctgttacctgacttagtttagatgtatttctcctctccctcaaatccctcccactaagtccaaggatgtttgcaaatgtcctaaggaatattctagtagctaggatctggcattttcacagccacagctcaagataaagtccaactgcaaaaaaaaaaaaaaaaaaaaaaaagtaagagttgaaaatgaaaatgacttcaaagcaatgaaatataaagtaattgcaagtttgcaaattaactatgttggcatattcttcacttcctcaaggaaatatgctctatcccgtttttaaaaatcataaatatattttttaactttttattggagtttgacacacattcagaaaagtataaaaatcataataatcaaccggataatttttcacaaagtaaaaaccatgaagaagcaacagattaagaagcatatcatcatttcccagggataaccaccattctgatttttaacactatggtgttaaaaatccatttatttggtctgttttggaaacttatacaagtggaatcatacagtatgtactattttgcttctgtttttctcaacattgtgtcatatatttgtgatttcttcattctcattgctaaatagtatgccattgtatgaatatatcacaattcactacatttcagtttttttttgctattacaatcagtgctactatcaacatttttgtacatatcctttggtggacaaatgtatgcatttctgttgagtgcttctgaagagtggaaagctgggtcattggggatgcatgtgttcaactctggtagctacaacaaaacagttttccaaagtgattatacaaatttacactccaactggcagtgtaataagctcttcaatctttcaggtttttgccaacaattgggatttttcagttagtttctttttaaccactctggtgtgtgtgtagtggtatcatattaatggttttgatatgctaattataatgatgattaataaaattgagcatcttctcatgtatgtattgattctgtagatcctcaacatgaagggcatgctaaggtgttttgcctatttttctgtagggattttaccattataatattaatttgtagttttaaaatatatgaatatatattttgtggcttgttttttcacttggttaatcacatattttgatgaacaaatatttttaatttaaatatagtccaatttatccatcccacctgagtctgtgctaatgagatgactcaaggtagaaagaccaagttgacatgagagttggaactttcaggcccttccaccaccctctgggaagagtggaggggagggagctggagattgggctcagtaaaaactcttgacagtgaggctcagagagcttccaggtgggtgaacacaccaaggtgctcggaaggtggtgcacccaagagggtaaggaggctctctctgtgtgactccctcgctctgtatcttgccatgtgcattgcttccatttggttcttcctgcattgtatcctttataataaaccagtaaatgtaagtttaaaagtgtaaataagtaagttctgtgagcagctctagcaaagtattaaacccgaggaggggtggtggaaacacttgctttacagctgattcatcagaagtacaggtggctcagggcttgaaactggtgtcggaagcgggaacagtcttgtcctgtcgagctccttactttatggagtctgtactaactctgggtagatagtgtcagaattggattgaagttttggacacccagctagtatctagagaatcagagaataggttgttggtgtcagagaaaacaccccagagaaccaaattgtcataattttctcttgtctttttaatatttgtaagatctgagagggtgcttcttttgtatatttctgttatcagcaatttatgttcactctatttttttctgatccatcttcgtaaaagtttatccattttattaatactttgataaaaaactttcatgttactgattttctgtattgaataactggattttattccattaatttttattcctaatttattgttttcttcctactgccttactttttattatgggggagagttaatttgttgaatttttatctaaattcctaaattgaattcttacatcattaattttgaacctttcttctgttttaatatgttaatcaaatgttataattttttttctaagtatgacttcaactgccctccacaaattttattatatctgatatttactatcaggttcaaaaattatttgttttttcattgcaacttattcttgatccatggaacaatttaagattatgttgcctcattgccagacacatggggatgatttcatcagagaatattctctggatagttttggttcttcaaaaatttgctttatagcccagcatgttgctaattttggtaaatgttacatgtgcgtgtgaaaagcatgcatattctccagttgatgtgcatagtagtctgtatataccaagtgtgtcaagtatgttcatcatgctgttgtcatagccattatcttactataatgtttctgttgaagtcatcaaatatttttatgtttttatttcaatttctattaccttgtctgtcatatcttattttattgttatttaatgcttaccctgacttaccgtagtctaataaaattactttcatcaattctctgatcatgctgaaaccttacaatagtttagaaaccttataatagtttagaaaccttacaatagtttaaccccattcatctacattctgcctctcacattattgccatcatatatttttattacgttatgaactctgtagcacgttactattattgttttgtatagccaactttaatttatatttatccacatatttacaactttctgctgagacagccaaatgcctgggcagataaaaatgggtccccagagaatctccgacccaacccacaagtgtttacatcagatgcttttgtgcagatgaggaaacctgcccagggttttgtcagggcatgcccacagtggatgggagctggacatgcgtactgagggaagtggatggagctatggggaattcctgccttaagcaggggaggaggctgttctcttcagcaggggtagtaacctgggaatcagtctgtgaggaggcgggcctgttagcaggactccgtctcactttcctgagagattttttttttttcctttttgcccaatacattcctctctaatcacccttcaatgtgtctgcgcacctaatcctttctggtcatatgacaagaacctggttttttctacaacactgccaccctttattccttcttgcattttgtgtttctgtttaggaatattctcctttagcctaaggaatttcctttagtaattattttaggaaagtctgatggtggtgaattttcttaatttgtatttgtctgcagcatattcattttacctttgtttctgaaggttattttcaattgctatattattctagtttggcactttgtttttggcaccataaatatatacttttattgtcttttaactgccattgtttctgtcaataaaccagcccaatcttgttttctttcttcgaagctgcctgttttctttggctatctttaagatttttctatctttggtgtttaacagtttgcaattatgtgactaagtgtagatttaaggttttttttttcttcttagtgtttatgaaacttcttgaatgtatgggttgagagcctccatccgattttgaagattataggcaaacatctcttcaatattgcttccacctcattctttgtgttatcaattgaggacactgatcatgtgtattttagaatttttaaatatctcccatacataacttatgttgttttatacattttaaaatgtttttatcctttaatttgcatattttctatcttcctgttcagtaatatcatttgttcaggggagcccaatctaatgatctgttgaattgtcaattttagataaaatttctatttgatttttaaaatattgtctactttttctctaaaattctcttatctttttttgtacattaattatagctgttttaaagtgtgtgtttgataaatctaatgcctgcatcacttgttggtttgtttctgtatcctattttatattcttaataatgcttcttggtatgcattgtaatttttttgccttttatttttgttttttagtaactaatattagcaacaataatgactaatggcctgaagactgaaggtattattttattttattaatttttatttttaattcttacgagtacataatggttgtctatatttacggggtacatgcgatgctttgatacaggcatacaatgtataataatcaaatcagggtaattggggtatccattgcctcaagcctttatcatttctttgtgttaggaacattccatactttttaatttaatgctaaggtacattatgcacttagagtttcaacatcaatggcagtgggctcatccatatttcacatactcttcttaattgtttcacccttttttacagacttcctgtgatgtctgattaaactcttgtagttttataccataataagtttataaacaatacaggagcagaataaatatcagcaccattattgttgttttggggtacatggtactaattcatagatcctcctgctatttgaatgatagggtaattaacatcttattttttttttatcacgttagctgtatacttgtagtcaatttatgtagtgagtagattgaattggaatgccaatggttctaaattccctggagaaaatcttgagaagtctggtgcccacctttagcagttggcctgttccaatgacatgaaaccttgactgctaaggtgccataaagcagagctgtttctgccttggtgaatggagtgaggcataggaaacaccttcagagtggctcccatcaataatcattggagaatttcataattttgattgtcaaggtcaatatgtggttgtttccataattttagtcaaggcctttaacaaaaaatagcatgtgaactagtatgtttattaatgacatttcataatttactttagcattcatttttcattgatgggcagggataagccctgccttagattctgcaagtttctgaggcatcttgcctcagaaatagacctagggtctctattttaagcatattacatatgttaacttcttttaacttcataacacggcataaggtatgtactatttttatttctagcctacaggaaatagaagcctgtactagttttctgttgctgcttaatagattaccacaaacttactgacttaaaacatcatacatattttctatctcacatttacatggtcaggagtctgagcatgccctacctacatggtttttgcaaggtttcacaaagctgtctagaagtgaagattaggaatgtttccagcacaaagacatgatgaatatttgaggtgaaggatatcctaattaccacgatttgatcattatgtattgtgtgcatgtgttcaaatatcacatgcaccctataaatatgtacaattaatacgtatcagtcaaaaataaaagatgttggatggggctgaaattccatcttaggcttgtagtcctcttccaagttcacatggctgttggcagaatttattctcttgaatctgtagaactcatggggggcttgcttcttttttgaggccagaaggagattctcttattttgattaaagtcaactgattagaactttaatgatatctgaataatcccttgacttttaccatattgtattggttagaagcaaattcgcaggttctattgggcagaagcaagctttcaaggggaggtaaacatacaagggcatgagtcattggctgtcaatttagggtatgtcttttacaaagccccccaaaattaattgacctgcttctagtcagtattggtagagggtaagatttgactccaagctgcttggccctagagcataagcactttgttgcttactttctcagggttatccattctcatacactgcagcctgagaaaggattgataggaatttgtttgcagacattcaagatcatgtattttgtgtatttgtgtcctctattcatttggttgttatgaactctctatataaactacccttctactttctgtgacaagtgacatcctttttcttgtgcaattaaaagtgctaaatttatttcaatccaaaacacatcctttgcaaatccctacatttgtaatattgaacaaagtgagcagctatgccatttaagtaacaattccttccaacgctgctcattatatgtgtgaaatttaaatctttgatcaatgagtgatgacgatgagtgtgctgttgataatgctctgagagcatctacttttaggtgaaggaaagaatgcaaggatgtggaacccatttagtcacacatatgtttaagccctagaaactgttggttatgtggttcatttgcgatcaccatcctctattctgcttgttttaaacacgggatgaaaatctttcaacacaagaattttgtgaagtcacagactgacccttgaaaaataccagtaatcagccatttaaaaatacatttaaatcattttgtttgagttcaaggtgcaggaatcttcagttttgcgactaaagttagcacttgagaatggaattgtattgccccacccacacgcacacactcaaatttccacatattcctttctttttgccaagagatgagaagatattgccctggatattcaaggaaacagtgggggcaaatgcaacagcaacagtccatgattggtacaagaaacttcagattaaccccttggaaacaaccagaagacttaactcagcatctcagaaagatcaaaatcattgtcatagagccaaagggctcccaggcataacacatttttgtttttgttgttattcctctcatcttgagtttctgagacctatttcctcctcagatcccggctaatctgttagccttgtcagctcttgccctgtggatcagactcctcccatttctctgccttgttgattaacatcctgctttctgatcccagctcatctctatggcctttgcctcatattctttcatactattatttccattttaaccattatattctaattctgtagtgtgattgggaaaaccattggcaagaaagatacaaaaatagagccctagggttaaggttatgtccttatgattttccatattcatatagtacttagcacttcatacatgttaactcatgagacttcaaaatatccttacgagggattctgattcttagatacagtttgcaaattaaggaagataaatatatatagaaaaaaacacaatagtaacaaacttgacaggagaggattaacttctgggagcacaaagtggagttcttggcctgagcccacagctccaggaaacttcaatgaactgaaaatggcctgtctgggtaacgaggctctgtacatctctcttcaccctaaagttgagtcagtgaggcattatgatgtttttaatttctcaagtgatattaaaatacagacccacagaccccatctgttctcttggaagcagagagattggcaaatgataacactacatgcctttagggatatacgctgcctgataatcaccatgtggtttcaactagttcacgctcagatgaacctgatatgaatttagaaagggcaaacactcctaatgagatggtatattcttgacttactattttaaacagcaccttcttcctactacctgcaaacaccacatttgtatccctttctaaggcgggacatcttggagtcatctttgtttcctctttccatttatcttctatatatccagatggagaatcttatggtttctttgtgatatgccttttgctttctgatcttactgccatcacttgagttcaaaccttcagtatctcatctggagcgctgctctgtcggcctaggaaatggctctgactctggttctctccacttggataatctcatgttgcctggggaatgtttctaaaatggccaataggagaatccctgtctgtagagtacaattgctgtgtttgccttcccagtagcactttcccattattcttttaataacaccccacattttaagaagcgacttattacagcactgttttttccttccatcgttatcaaataaatgttcctgtgatccaaaccagctcaaccattgtcaagacacatgactcaggcagtctaattggaatgtgccctgggattactgggattgctgtatacattggtatacagcagtagtttccagacttttttctttcagaaactctttttactcttaaaagttattgaggactcccaagagcttttgttaatgtggcttctatctgtacatttccatattataaattaaaaatgataaatacatttattatttcatttaaatacaaaatagtaaaccctttacatgttaacgtaaataaaatacttttaagcatataacttttctaaaatgaaaatattttgtgagaaaaatggcatagttttatatttttgtaaatctctttaataattaccctaataaacaaatctactgcacatgcagttcataaaatatgttgctacggatgaagtgtatgaagaaaatctggcctcacagatgtgtagttggaaaagggagaatcattttaatagtctttatagatattatggatattattctttgagactatactaaaacttgacaagtggcagtttcctaaaggttagttgcaatgtgaaatctgaaaccatgtcggtgagctttttgtacgcagctataataaaatctgttggcagtttgtacagatcttttacatgttcatgatttcatttggaaatgcactgattatttggaaagtatacgttcatcaagatatgcatatctgctaaatgatgacatgtgttcattttatgatgtcttaaaccacatttagtaacatcaccagtgacctcatctgaaaattgggataccatcaagcttataatgcaacatacatgttgatatggtttggctctgtgtccccacccaaatctcactttgaattgtaataatccccaaatgtcaatgtgtcaagggtaggaccaggtggaggtaattggaccatgggggtgatttcccctatgctgttctcatgataatgagtgagtctcatgagatctgatggttttataagcatctggcattttcccctgcttgcacttattctcctgctgccctgtgaagaggtgccttctctcatgattgtaagtttcctgaggcctcctcagccatgcgaaactataagtcaattaaaccccttttctttataaattacccagtctctagcagttctttatagcagcgtgagaatggactaatacagtaaattggtactgagagtggggtgctgctataatgatactcaaaaatgttgaagcgactctggaactgggcaacaggcagaaattggaacagtttagaaggctcagaagaagacaggaaaatgtaggaaagttcagaacttcctagcttggaggactcagaagacaggaagatgtgagaaagtttggaacttcctagagacttgttgaatggctttggtcaaaatgctgatagtgatatggacaatgaagtccaggctgaggtggtctcaaaaggtgatgaggaacctcttgggaactggagcataggtgactcgtgctatgctttagcaaagacactggtggcattttggccctgtcctagagatctgtggaactttgaacttgagaaggatgatttagggtatctagcagaagaaatttctaagtggcaaagcattcaagaggaagcagagcataaatgtttggaaaatgtgcagcctggcgatgtgatagaaaagaaaaccccattttcttgggagaaattcaagtttgctgcagaaattcgcataagtaatgaggagtgaaatgttaatcaccaagacaatggggaaaatgtctccagggcatgttagagaccttcatggcagccccttccatcacagaccgagacctaagaggtaaaaatggttttgtgggctgagcccagggaccccctgctccatgcagccttgggacatggtgccctgtgtcccagctgcttcagctctagctgtggctaaaggggccaaggtacagctcaggccattgcttcagagggttcaagctttaagccttggtggcttacctgtggtgttaggcctgtgggtgcacagaagtcaagaattgaggctggagaacctctgcctagatttcggagaatgtatggaaacgcttggatgttcaggcacaagtttgcttcatgggtggaaacttcatggagaacctccactagggcagtgtggaaagtaaatgtgcggttggattcccccaaagtccccactagggcactgcctcgtggagctgtgagaagagggccactgccctccagaccccagaattatcaatccaccaacagcttgccctgcatgcctggaaaagcctcagacactcaatgccagtctgtgaattcagccaggagaggggctgtaccctgcaaagccacaagggtggagctgcccaaggccatgggagcctacctcttgcatcagcatgacctggacgtgagacatggagttaaaggaaatcattttgaaactttaaggtttaatgactaccctattggattttggacttgcatggggtctgtagcccctttgttctggtcaatttctcccatttggaatgggtgtatttactcagtgcctgtacccccattgcatctaggaagtaattaacttgcttgtgattttgcaggctcataggcagaagcaacttgtgttgtctcagataagactttggacttggacttttgggttaatgctggagtgagttaagactttgggggactgttggaaggacatgattgtgttttgaaatgtgagtacatgagatttgggagggtcaggggtggaatgatatggttcatctctgtgtccccatccaaatctcacctttccccacgtgtcaagtgtgggaacaggtagaggtaattggagcatgggggcagtttcccccatgctgccctcatgataatgagtgaatctcacaagatctgatggttttataagtgcctggcattttcccccacttgcactcattctctctcctgtcaccctgtgaagaagtgccttttgccataattgtaagtttcctgaggccttctcagtgatgcggaactgtgagtcaattaaacctcttttctttataaattacccagtctcaggcagttctttatagcagcctaagaacagactaatacacgttttccaaaatcagcaattagaaagctaaaaatttatcatttacgttaagcaccgtactcaattctgaataacaatagtttatgtattggttattctttcaaattaaaatagtattccatgcaaatgtggctcacaactcaaacatttggctgagtgcttttcctcatgacatgattgtactgtggtgtgcagtagaagtcctttaggtgcacgtgatgattaattttatgtgtcaacttgattaggccgcagagtgcccaaatatttggtcaaatattattctgggtttttctgtgagggtgtttctggataaaattaacatttgaataggtagactgaataaagcagattgtcttccctaatggggttgagcctcatccaataaattgaagacttgaatagaacaaaaagactgacctttccaggtaagagagaatttctcttacctgacagccttcaaattgagacataagcttttttcctgcctttaaactcaagctaaaatattggcttatcctgggtctcaagcctgctggccttgggattgaaactaaaccaggagctttcctgggtctccagcttctgactgcagatcgtgggacttgcctgtctctctctgctttctctctctctttctccctctctctctctctcgctctacacacacacacacacacacacacacacacacaccccgttatggtttggtttctctggagaaacctagtacagtgcacttcccatttaattccatagaatattaaaaattcatgtactttgagtttagatttgataaaattaataacttttactgtttcttcagggatgttcttaaataaaagtggtttttaaaatttttactgtaactgtgtagcagtaaagaataaaatgactgctagtacaattttggtgcctctggctaaggaactagcagttttagctaacattgattttgcactattagtaaaaatatcgatataatgaaaaaggaaaaaagtctttgtattattataaaaatagtgttgacctgtggatccctaaaagggttttagagactctctaggggtctgcaaaccatatttagaaaaccagtggaataaagaaatactcctttcaccaaaatttctaagtttctaacttgataatttgggcttgccccagccatgttccctggcaacatggaagaaagcgtctgtagttaggaaagaatgaggccaacacacaggtcaactgagctgagagaagaagagatagctctgataacatctttttctgtcttggatttagccttgcctgaagcaagatctggactttttgcttaacagagccaatgtattctctctctcttctctttctctctctctctctctttgaacctaatccagtgttaggtttcttctccttgtagccaaaatgtttctataagatggtcccatctcattcacccaatttcctcctctaatttggtattcaccataagctcttccaaggtttccacccacatgtttactcttcccttcacttattcctcatgtggttcttcctctccatgccatacaacttctacctgtggctgccaaagttcttgaagacttccctgatgtctccagcccactctgatggctcttttttttttttttttttttttttggaaatctgtcatactgttatcaatagaaaagtttttggtggtaaatcactctctggttttcttttctaatgggttttggtcttgtcattctaactagaatgttagtttcttaatggaagaggtcacatttaagtgctctttgcatatcactgggtatactataagtacatttttttttttttttttgagacagagtctcgctctgttgcccaggctggagtgcagtggcgcgatctcgggtcactgcaacctctgcctcctggttcaagcgattcccctgcctcagcctcccgagtagctgggaatacaggtgcatgccaccacgcctggctaattttttgtattttcagtagagacggggtttcaccgtgtgagccaggatggtctccatctctggacctcatgatccgctggccttggcctttcaaaagtgctggtattacaggcatgagccaccacacccagctgtaaataactttttttttttaaacccaggggattttgtttttctcacatttcttagaaaaattttttccttagttgactaaatggagaaattacctttcgaaagctatccacaggcagccttctggaataaaggaaaggtttagagtaaatcatctaatagaactactggcaaatctctatggtttcaaactcatacaggtgtttaatataataacaagttgacaagtcaaagataataatagctgctatttactaagtgacttctatgtgataagcagtagcttagattctttgcatgaattatctttaatttccacaataatcatgaaagggaaatattattatcattatcttatagctgaggaatttgatccggagagcttaaataactattccaagttggcatagcttatcaattggaagtcaagattcacaaagtcattggctttaaggcatgtaatagttccatttacatatgttgtaaacactcccaagaataacattggattcaattgaacattcatttgttgaatgcctactaatgtaaagcactgtacttggtgccacaagagattctgaaatgagaaaagagctcatggtttagcttgtttatgtctggagaatatttttctcagcaagcagtcaatagacttgaacacgtaagtgcacaatcctcattaaaatatggtaaccagctcccaagaagcagaagggaatgacatgtgccttgaggattcatttttattgaaaaatcatctagaagcagtactctttaaatctctttctgaattgatcttgaagactactgataatggaagcaactgcagagaaagaataccagaaccatataatgtgtagaaggaacacatactttggaatctgaaataggaatttttggaaagtgggaaaaagttcaatttattagactatatcttagccagttctgaatctcaggttttcatctgcagatgctgtaatatctgtcgcacaggaatgttgagctgattaagtaagtaggaataaagaatgctgttcacatacagagttggtgctaagtagaaatcccactactttccctggtgatctcttcaaatcaccctcttaacaaccacaaccttggatatgagaaatgaatgttttggtcctagttgaaagggagatgatggcccttttctccagcctccaataaaaactcaagaacaacctgtgtggcattcttgcttgggccactccttgaaaatcatgagggacaggatttcactcctcccaaagtatcctcctaggcaaattcttagaaaggtttttttttcctatcacaatttaattcctatcagaatatctttgtaatttccagcccttggttgcagatctgttcgcagaagctacctagaagatatttcattcctttgtatggggagacattcaaatatttgaaatcacaaatctgctcttataaaaaattggctaagtaaattcttctttgactgtgtagaataaacatgcatacagttgtctttgaagtcgttagctcacattgaaaagaaaaagtttagaagaaattaaatatataattttgggggaaaatttatctataattttagctcatagtttacaattcctatatgactgtttggaaggtatttattttagaatggatggatgttccgtattaacctgtaggaagggtttgtgaatattctgttgctctgaattattagcggtctagatctaggctggactttgagaaatatgaaataaaaaaatacctctttggagtgtggtgttgctctttaaaaaaaaaaaaaaaaaaaagcccagtgaataaaaggaaaacccagtcatttctcctggaagcctttcaatagtgactcaatggcaatgttgtggttgaaattgttgctcctagataatgagaaaagttaaagccatcttctcaacagtgagtagaaaaatcttttaaattttagagatgtcataaatatagtcttaagaaaactattgggaaaacagtttcttgttttatttgcttatttcctaaggaacaaaaatgattgccattttacaactttatccctataaagttgtagccttcatgatgacataattcccaaagtcagctagaattccgagaatcaaagaagaaactgaaatctaattacagagaacaaatgcaacaggccagttatatttccagacgtttttggtttgcccagttccctaatttttcatacttctctttagtctgttcattttttgcttaaaaattgaatggaattttgatgcgacattttagaataaattttaaagaagcataaaactaaaaacctacttggagaattatgaatgttaggtaacatatacagtgttaagcagagttttactaattggagaattttacttgttcccttttaagtttaaaagataggtgttgcataactctgaaaatctgggatgatgagaagacctcaggcatgttctacaaacaagattttaaaggaatgtcaagtatggtgctaagaaaatagtttaaaatttgtaatttcctttcacctagctcccaatccagaaaataattgaccaaaaaaattgatagcaaccttgtaaagagttaaggtaaaaaagaataacctctcattatctttgtttctcaagcaaaatatacattttagtaaacagattttgggggaaaagaatggaatagctacatttacatgacatcaatagagggcacaattattagagtttcataagtgtagctaaggaaaaagatcacaattcacaaatataaatttttgtcattttgagaacatagaagacccctgagtgatggtcatttcatcaaatgtccatgagctttatattccaggcaacagaggtcttcctttacagtgcttggactatgataatcctactatgatttgaggttaatcaggccattatgtgcaaaatttgaggatagggccaacttatcgcaatctacttccattttcatgaagcctgtcttagttcgttcaggcagttatgacagaatacaatagtctgggtagtttaaacaacaaacatttatttctcacagtccggaggctggaagtccaagattaagggtgctggcagatcaggtgtctgctgaggacccacctcctggtttgtagacagccatcttctggttgtgtcctcacaaggcagagattagagagcaagctcaggtctctgaattcccttataaaatcactaatctcctcacgagggctccatcctcatgacctaattacttcccagagacctcatctccaaataccaacacactggggataaaggcttcaacatatgaattttaggggaacacaaaccttcagtccacagcaaagcccattgcttactgttgcctcttttcaaaattcagcactaagcttaatattgatgtctctccagcaaacattttacttcagttgagactcaaaccatttgaatggggctcagcaatttggtttggctatttctcatgcagcctctctacatggccgtgtgtgtggcaaaaactctaaatcttatggtgctaatttccccttcagtgtctagaaatggtttcagaaagaatgatgacatcactgagctaccaagacggaaaaattatagggttaatgaacaagagtgaagaaggagaaatgaagccttctcagaagcaagctacaggaagattaatgtgtgaaattctacaaactaaccaagtttaaggaagcagttgcaagagataaatgatggaggacttgtaaaaaaaggtttaactctgcttaacaacgatatttgtgggtattttttttccttatgctactagtacaagctacaagtgaaagagtagaatgaaaacagctaaaaaaaatttgctacagtgcaactagctgtcaggtaggaagagtatatctacatgataaacaggcgcttacctgaaggaggggcgtgaaagggaaataaatcttttattcaccttgactataaacctaatcctgatctcactccctcctgactagtccttaaccctgcctctcaaaaacactgattttgctcaacataagtgttgtccagtaagttttaaaaatatcaaattagctggccaatttaaacataagaaagtgattgaacttaaacatgaatgtacttcaagcagtagcttaaagtatattctatggctaatttgggttttcctcaagaaataggtttcacagccaaataacttcatgatgctgggctaaaccagttaaaaaatttgccccacacaccacccagatgtctcaggggcttcaggaggcgcatgtgcaggccacgtgcaggagaatgcagcatgtcctaaacaactttctatcactgccccaacttttccaaatgttgaagaaggagcctaatctataaagtgttggttaataatgcatctctcaaaatataaataaattatagcattcttcaaatagaaaaaattaacaaagtttaacaactgtatcattcaccaaatatctactatttctcctcttctttaatctatttgtttgcattcaactctttaaataaatgcagacctctctgccagtgtccaccaatgtgttaaaaatccccctctatcttgcctcctcttggaaagacacagagaggacacaaaataaagagaaaagattaaagtgtattttcctttcttgcactgaggttaattaaaaatacatcagaaatattgaaacataaaaatcagaacattggattggaaattagtggttggatttctaggaagggtaggttaaagtcctaagtattagtttaatctgagacgtaatcacagcagtgatttctgggcccacgttggtataagatatttcctgatggcagcttgtgaatacagatgaacacagcaaattgtacatcatctcaggaatactgaagcccaaactaataaatttccctaaactctgctaaactagaaacatatgctacaggagatgttctaacctacaaataaaatacattatctcataccaaaaagtatttccatatgcccaaaccttaaatgcatgactgttatgtagttcagggattttgtttcttagaacttctgtatcaagaacacataaagaagagtgtggagtcccaggaggctcttcccactcttagctgtgtgaagctgggtaaagcactagatgtctagtgaggctgtttttgattgtttgtaaaacaggaaaataatccctgctttaagtatccacacatatgtcctgataatcaaatgagaaaatttagaacctaataaatagtaaagttgtatatgtgtgttagttgcgaataggatataatcttgtacatctctcttttttcctttccttctgtctatatgtttaggtctatgcagagatctaatatctgtctgtatatatctatttatcttctccatcatcatctcatcatttatcatctaacatttatctacctactatctattatctatcatctatctatccatgatcatcgtcaactattatctatttatctactgatctatatttaaacatgtccttttgttatgcttctgtatatatacaactgtattggtgacttttttacaggtttcaaagatgactataaatgtgtaggttatttatttctttctcttaatattctgaagcatcccaaagactacgtcaaaaaattatggtgaaaagctgaagatagtaatttatttgcgtcaattttcccagaacctcattggatgatcaagcctgcatttcttttcttctttattgttataaagtattagttattccagagaggagaaaaacataattggattatttaggacctatattttgtaatgtcacctaattttataatataacaggtaccattatggcaatgcaaaataaaacatgggatgaagttgctcaggatgcagagcagtgtggttggtgtgcattttgccctgttccgtaccacttatgactactgaatattctacaaatgtgcagagaaatgggcgacatttgttttggagtaacctggaaggatgaggcccaattctgcttgctctaaaggatgaatagttcttttgaaagccaagtacataactgtgaggcccggaagctctaagttcacttagacaaacatgtcactgtgatggctgatctttagcacaagcgcaagcccactgcattgattggcccagaacccaatgtagtcaaacgtgaaggtcttctgtacaccgtggatggtggggagaggagggcaatccctcaaagcctggagtctttctccagtcttgccagtctcccaggctggccaggtggcagctggtctgcctgcttctctttctttttacaggttgttcctgaacttttactattgtaccatactctgctgtaggaaattaggaatacaatggtgaaccaggcagatgctgcacctgtctttataaatcttatatcctagtagagacgagagttttaaaaaaatcatactaacaaaattagactccaaattattataaatgccaagaaggaaattaatagactgaaagaacaaataaaaagcaggtggttccatggatagcgagatcagagagggactctttgaggaggtgacagtgaagttaagacatcaaagtaggtctcagattaaatgccagagcatgaagaagtttctgctggaagagggtgattgaacatcgcaagtaaaagaaacgtcaagtacaaaggccttgaggtgggaatgggccaggccgtttggagtgtaatggcagggtcccgtctagggagtacagctgtagcttttgaattgtcatagacccatgccccaggagcagtgaggagaacaagtgattggggatttctggaggtatttgcactttgctcctgttcttataatcaagtgaagcttttcaaactgagatggatgtgtttcagtattttcacaactgacatgtttgtaccagatcaaactggatgagtgttacccctgagaggtggagtttttctgaacatactttggaaacgtactctatgcaacagcatagagacggaaaacagaaggcgtttttcagaaataggaaataatcttgtttactatagggagagtgtgggatgatgtctggagtttcaggtaaggcttgatgtggcttctgggaagactgtggaaagctctgaatgtcaagtatgtttttaatccaccataatgttgacaccagccacttgaccttacttgcagagatgaataccatgagcatcctggctgccctctgcatcttggctgccctacccccatgattacctggcacttcccatttgcctccatgatctaggacatgcctggtattgcagagggcctccaaggccatactggcattcattatgactagttggtatttattcattactggttattaaatattttaaatgtcacttatattagttccacagaactattattttaaaaaattctgcatttaaatagctttggagatacaagaaagacataagattctgtgtctccagacatgcttgagagcctctttcaccccagttgctgctcagggacctagagatccacagagtgccctttggtaacactcctgatctgcttcagtgactttatttaaatgtctcttgtgttaaattcctcccacatgtaagccacctccaccctgtggtctctgctctccttctaaaacacaactatgattaggttatttccctgcttacaaactcgataacttctcatacctgcagaatacaggccaaactccttattaagggcttccaagactctttgcaaatggttacctctccacacgtcaacacctgttattcccagttcttccctcaaggcccctgtgacctagacacaaatgacgattttgaacacagcaaagacttcatagctcctggcttcctcttgattcccttgccatagacccctgatcttgcagaccccagcataaattgcattcttcctatgaaatcattctcaatctcctcactcccagtgagtctccccactctcagctctcatggcaatttgtttacatccagaacatttatctcaggcccagttgtacttatttattgttagccttgtccattttggtctccaccagacagtgatctctggcactacatggtcttcatctcctaatgacccaccctgccccttcctctaccaccaaggtatggctttataccttgcacccatttcctgttttttgtcaacctaggctaactgtgtcaggccattcttgcactgctatagagaaattcctgagactgggtagtttataaagaaaagaggtctaattggctcatggttctgcaggctgtacaggaagcatagcgccggcatcactcagcttctggggacagctcaggaaggttttactcatcgcagaaagcaaagtgggagcttgtaggtcacatagtgaaagcaggagcaagagagagtgtcaggggaggtgccacacacttttcaatgaccagctcccatgtgaactcactgttgtgaggacaccaccgagggaatggtgctaaaccattcatgagaaatccacccccatgatccagtcacctcccaccaggccccacgtctaatactagggattacatttcaacatgggatctgggtggagacaaatagacaaactatatcagtaaccaaaaaacaaacaaaacaaaacaaccaaaaaacaaaaatcaagtgatggtattgaaagggcactcaatcagaagatctggtcttcaggccggtctctgaacctgaacagatatatggccttgggcacactccataagatcaggggctctggtaccttaaaggataaacgaagagtcttgcccgagtctagcttctccgcagaaacttgagcccatgcctgaccttatctgtataaaaatgcactgtaattattttttaaatttgcattgttaggcccatctgacacacagccagtgttaacctaccttccttctactgtcagtgaattctccacctacaaggactgggcatccttcatctaagatttctggtcatgttgggtcaatatcaaaggtgttttgggcagttcttcttgtaggttaactgtcaggacctcactggaaaatcagtacacagaaggagaatgacaaatagccctgggaggtgcaggctccccttctcccactgcctcaattcacacacccttatttctcacctagggcaccccagcagactggcctcctgcactcatgccccagatggagacccaggtgaccctgaacatgcaaatgtgatcattattgcctgcctgaaatctgccaatgatctctggtgcttttggggccacgtttaaatcatgatctgatccccccctcttgttctatggtcactccattattcacttcttattgcagtccctacatcactagccattccctatcaacttagggtggtccagtgaaatccaggacacccaattaagtttgaatctcagataaatcacaaataatggtttagtataagtatgttccaaatattaaatgggaggtatttatacttacagtaaaacattatttgttgtctatatgaaactcaaattttactgagtgtcctggatttttatttgctacatctggccaccccgcctattacacacatggtctcaaagacccctgcttgctcccctgctgtcatttcttccacggccacatttttctccctctcctcctacttcacatctgtgcatcattcagaactccttccatttcctcgtcaaagcctccattacttccaatctaatttgaatgcttctctatgttaccctgggcctatgtctagtaatttatttatacaaacctactgtaattatttatttgtatttttctctgactcactgaacatttcctgagggcaggaatcatggcctcttcttttatctattcctagaaacagaaatagaataacagaatggctggcacatcatagctgttcaatattgttgtttgatgaatcaaatgatgtcatttactagcttttgaaagcacacaaagaaaaacatatgggcagaggcctaggtttccagggtaaaggagaagaagataccagacatcaaagctgctaactcatttctggatggccatatttatgagacaattaaggggactgcagttaggaggcaggctgcagatacaagaggaacactcaagacagcacagtcagaaagcccatggccagatatcagtaactgagaacatagagaccagagattggaaatagtgctttggaagccttgcatctcagtaaccccatggaagaataagccttaggataatgtgaatttgacagtaaagattgatgacctggctgacaaataaaggctataccgtgaaatcttttcctctgtaagaattttagcaaaagagaaggaatgggaccatctggccacaactgtcttaaagaaactgatctcatcagcaatggtccccagaggagtcatgaacagtggcttgggagtgtcaggcaagcccttcttctggctgtacaaagtgatggtgtggccagtgcaggcagcaagagcttgcagaggcaggtggtaactttcctgttttctctgtaggatccttttcccaaacttcctctcctttctctagactgttcatgccacttcaaatcctaatttgagaattagccagagctatgaggggggatatgtaaaggaagatttgatggatctgccaaagaaaggagatcaaaaacacaggccattaacctgtcggtgcctcagggtcccagctcatcctgtctccttcacttcttcagcagaagctttcccccatttttctgttctttactctcctcttgcttcttatcaacctaacccccagccccacaccccaagtgaatggcttttggcttaatgaatgtttactaatggataagctactgtcctacactttcagaataaatgttgagagtctgacaaatagtcacagcttttacaatatacttctggggcatatcctaaggaaccaatcagaggccaaatatttatgttcactgatgtgcattacaatattacaatctgagatgctcatgcaacaaaatactatccaaccatcagaataacattttctgggaatatttaataacagagggaaatgcttgtgattgccatcatgaaaatcaaaataaaagattctaagttccaaatagtgttatgtatgtatgtatgtatagatacatacataagacacaatgaagcattgaggttagaggcatgaggcttggagttagactcttttagtggcacttttactgttttttagttgagattctctgaaaattcactgggcatcaggatgtcattataaaatcagaggaatagaatttgtctaatagaacatttttgtgaatttatatgagagaccctttgtcaaatgactactctagtcctacccacagcaggaattcaataaatggtatatacatatataaatttaaaatattactacccaaaatatatgaaagtcttattaccacaggttaccactaagtagtggtattacaggtttttcaatttattctccatgtttctttatttttaagttatgtatagtaagtatatattacttttacaattataattaaaatattataagtaaattgacataaagtttgcaacagctgagatatttattttgttttcgtttttattttcttttcttgctagagacaagataaaaagatctagggctattgccaacaacatgccaaggtcaaataggagactctgtgtgacctaatatttcctggcagacatgaaggctcaggatggctcttgcctacttaagcaaaaccttaattcagaaaacaggtctgtaggaacagtttgtgttatatttataaaacttaaaactacctaaacagtaagatactgtagttgctgagaatcacgctctgcagtgaggacaccaaattaattatcgttgatgaaaggctgtgttagtgagagcaaaacttagagactccagacacacctttccctactcacatgcctgattacaaacctcgagatgctctatagagcagtgtgcatttacttagggacattttaattttgtttgatatttcctccatcctctgtttctataatggacttctgggcttccctgacttgtctctgttcttctgtgttcatgtctctctgtggaatgacagttaatgaagagaaagtgaacgtgttatcacggccaacactgagattgcaggaggaaagatatgaaagccacaggaaagatatgaaagcctcaccaaagaggaaataaaccacctaaaataaaaggcaattttgtttgtgaaatgtgaaaaatgtgataatctactttatttatgatggactacatgttaaagtgtggggtgatgaaaagagccaccttctgtcctctgccctccgccttcaagctggtcttgaccatcattgtcgtccttcaaatgatgaaatcgctgcagtaacttcagggctgtttgctctgctgctgacctcactgtacacaaattagcccttcttctgaggctcaactatgctatgtccattaccctagttactgctcacaatctacataatgtgacagatcatgaaacatgaactagtaaaatgtgtatttataaaggaggcaataccgttattgttttcagaggaaatgacagtatgtctagagagctcatgaaaaatagaagagatagaaaatgggtattccaaagcctagactttttaaaagcaattatcaatcataagctataatgaaaagaatgtgattcacaacagtggttcttctgtgagccagatgggtgtggattccattcagaagtagtgcatagtccccaagcttgcacctcacttgagccctggatccccaaatcattctgtttttgtccagagtttcacaaggttgattttgaaaatgttcccaccagctctggctatgggaatcacagtgggaaataaacgccatagcatcttccccatcatccccgtctcctcctgagacaaaacacattttcccctaaatgctaactgggctgtctgcctccagcatagacaatcttttacatttttaccacaaagtagttttagctgcctggaccacatcaccaattgaatagtatgatgttctgggtaagggcagaatagtgggttgaatggtgacccccaaaaatataggtctatgtccacttctctagaaactctgaatgtcacttcatttggaaaaaggatatttgcaaatataactaagttaaaggtcttcagataagatcaccctggcttatacaggtggtctctatgtccaacataatgtgttattttaagaaacacaaagaggacagacaacgaggagggagtgtaaacctggaggcagagattagagtgatgtggccacaagccaagggatgccacagaagttggaaaagttggaagagacaagaaacaatctcccctagagtctctgggggaaagtctggccctgttgacaccttgaatttgaacttctggtctctagaattatgagtcaatttctcttgttttaaggcatctagtttaagataatttgtcaaagctacttcaggaaactcagagaagcaggttctagagttagcaaatgaggactatagtcccaaattcgatatgaccttgggcaagttgataaacctctacagtcatctgtaaggtggggatgataaaaataatacagtcatgagctattcggtcaatgacaaggtagtcctatgagattctaatactgtatttttattgcacctttttatgtttagatacacaaataccattgccaagagtattcagtacagtaacatactgtacaggtttgtagcctaggagctataccaaataaatagtacaggtgtgtagtaggctatcctatgtagctttgtgtaagtacacccaagaaagttcacacaaggacaaaatccccttacagtgcatttttcagaaagtatctctatcatgaagcaatgtaagactgtatgttcctcacacgggtattgtgagatttaaataagatgtctatatattattgttattgcatttttataatgaaaaggccaaggaaaggggtttgcctgaagaagggaagacagtcctctaaaggtgtattggatcaccacctcttatcagatagaaactatcttcagcatttaaacagtggttctgttttagagtgtacctagcacattttgaaataccctagagtctgttttctctaagcacctggacagggctttgcaggtgtccttgacatatgccctcagcttgacccattgagtggacctagtttgaccaccatctcttatattccgcatgctctttaatgacattgaatatttacttgtctttgccttattttcttaattcattcgtagcttgctcctgagccttaaattactttgaagtgtattacacatcctttgtatcctctatggaatctcattcatagtagggtctgtgataaacaattgattggatagtgaatatctcttacaggcatgtaaggaggaatcaagaagctgtgacatattctgaggacctccaaagaacaacttgctactgactggacttctctcatcttttagcatgtgaagttttgcaaatataatccactttgctctgaatgtcctgacacctgcttcagagctcaagattcagactccagcctgaatgttatttcctgagaaaatccctccctgacccactgtgctggttaggtccacctgctaatcacatccacaaaaccctctgcttctccttcaaaacactcatctcctctgtaatgatcagatgaactcatgtctttctcagaggacaataaatttgatgaatggggaccatggaagtttatttccatctgtatccctacatctaactcatctgctggtacctatttgtcatgtatttaataagtacaactacctatgccaccctgcaataaaatgatattgttactttctcttcttta

SEQ ID NO: 549 - DNA, 1701 bp, Homo sapiens
gggacgggggcggagcctctggcgatgacaacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtggtcagcttggggggctgggcggctgaggcggggggcgagagcggctaggagggcccgggcccggcgtggggaaggggccgggtggcggcgggtcctctctagcgttccgctgcagcagcccccactcttcccaccccggccgtctgcaggtttgcggggccaagtgttgcggcgacgcacctcacgtcgagaatcgggaggaggagactgcaaggataggcccaggtcagtgcgagggacggtggtggggagggggtcagaacatgaggaaagcccagtctgagaccccaatccgtgccttcacccccacacttagcaatcccccacccccaccccttcttcgtcctccattttggtgcctgcagaggcctggagatggatctgcagagaagatggtgggctttgcgggagagaagggcacagactggctcccctcgcccccccgagggtacatggggcctctctggtggaaaaaaaatgaaatttaaaaaaggcctttgaaatccagggctctgaattttgaaaggtgggtagtcgggcctctgtcctcggtgctgatcagttcaccaagaattgagtccattttctctctgtctcctaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagca

SEQ ID NO: 550 - DNA, 324172 bp, Homo sapiens
ctttccctgtgtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgaggtgagcatctcctcgcccgtcctcctcttatagtcatctcagcttgctgatcgattcggggacccgggaggagggctgcgtgacgtgggcgtgcttatagataaatccgggaaaaccgccccaaacaatcagcccccttccccccatccctgctcctgggccagcggggtgtccgcacccatctaccatcccctcctccccctcggtggggaactgcactccacagtgtcgccccctccctgggtttgtcccattccctgccgggttccccgccccgcggggtgtcgtggccctggagctccggcgccaaggggggctcttgggggacgcacggctggagcccggctcgctttggagctgcgcggtgtagccgctgtcatgtgccgggttccgacctgggaggaggaaaagagcgagcgcgattcctctcccttttgttttgaagcccgcatttgctgcatcgagcagttggtttagtatcagccaaacttgcagctgttcagaccgcgctccgccgaggtagggagcccgtctcggggtggcgtttgggggccgggggctgcggcactcggggctgcgggagggaccccgagagtgtgtcgccacgccgcccctcccttccccggtgactgattgtgtctgtggcagcgggcgtgtgtgagtgtgcgcgcccgtccccgcgggctcggggatgtctgtggatggctgtcgtctagacagggcgcagccccctccctgcgtccccggtgagcccgcgggccgcggggggagcgggggatgggagcagaggaagaaaccaaatcggtggacccgttgcggtctcccctttggttattcccaacggttgtggttctgttggctttttttattattcctgtcgctgcggtgcaatcgggcctggggaatagatacgcccggcggagaggggttcacttgacaggctctgaaaagccacctctgggtggcgagtgacccgagaggccgtggggtgggctccggctcgggttcatcaggacgacgagcaggtaactgtcccgggcgccggtcatgggggagggcgggcgggggggcgatggcttgggctgcggcgaaggtctggggcctcggagggccgcgtgccggtgcctggatgtggccggagggggcgtccgggacaccgcgcgcctgagccgagtgtttctctattgatggtaaaagacaatcgggaggggggtggtccgagcccgttatctgggcggcgttggctctgtttggttccgcggagttttcagggttggggctggggggtgtgagcaccgcggggtgtgcggcgtgtagaggggagggctgactggcggcgccgcgtgcgtctccaccccgaggagtgaggcgtcgcctcccccgcccggctgtttgtgtgtacacacggctccggtgtgtgtggggggcggggaccgcagaccgcggcgtagtggggacaagcgtgggccccgatcctccgcgcgacctgtcccgccagccccctccttgtctaagtcggggtcgtgtgtccccgcgcgcgcgcgcccgagttacttggagaggggaccgtgcggctgtgggccggggaagaccgtagggtcgcgtgtgctggtcttcggtgcaggagtcccaggtccgctgtgcggccggagtcacacagcccctccctccgcgtccgcgacgccccgtgacccggcagactgggggtccacccggcggcgcggggggttggtttggctgcgccgcccccagtccacgctggggtgaccccgcaccgaggcgttctatgggtgtgcgtgcccgcgctcgccgccgctgccttcgcagaccggggagagagtcagcgactgccaaccgcagccccggctcttcagtctggggacagtgggagcccaagcccagcgcgccccagcccggcccaggccgccgcccgcccggcgctgtgtctctgcggcccgaggattatcccccagtccaggggcccgcgcgaccaaggaggaagccgctggagccgccggctcggccgcggctagagcctccgtagggcgaaagtgacacagcgcgagagagcgccgccgctgctggagccagggccgagaggaaggagccgcccagagcgcagggaggggccgccggctgtccgttcccagttcctcctgcccagggcccgatctgggctgaaaacctcaggaatccaggctcctagcaggctcgggctgcgcgaggagatggcctggctttcaagaaaacccaattatacgtgaacagaatgcaccgaacagacgctagaggatggccaggacacgctcaggttgtctggggaaactcctgagtgtttgacacaggattcgatttacacacagatcacctcatctgtgtcaagtatctgtcctggataatggatgctcagaggcagcaattttgtaacacattctagggcacagtgtcatcagtgattaacagcttgctagaataataatatgtttgtatgaccttacagggcaggttttcttcccccagaacctcccccctcccccgccagatatcatagcatttattaagagggtcctgtgaggtaggagagtattagccccattttacggatgaacacactgaggctcaaaaatgtggcttgcataaggcctctgggtgggggaagggccacattcccccttttctcagcttatggcatttaattaatagtggccactttttttctgagtatggattcttgacacctcaggaaatactgaagctaaaaaatagagtatattatgctgacacatattctttctcaaaacactcttgatttgttaaccattcctaatgagagcagccactaaagaacggaagtctgcattgctgttattaccacgcatttaataatttgctgttggtgaatggatagcagctgtgatacatccagtttctaccagaatcatatgtgcatataataaatgtatatggtatgcctgttcatgtaacacttacctgtgtttgtatggctgtgttcattgagtctttattgaattcaaggagcaaagaacttatacatgcctgcatggatttctcagaattcatgcatgtgaaggctgtcagacagcctggagggttattaagtttagccaactaatcaattaattaaccattcactcaatatgtactgggcacctacatgtttgtgtatctagaagtgcatacaaagaaaacttaacaaatgttaattaagtccagcaaatgtttatgaagcaccagcctcacttaggccagatactctgcttctctacaaagatagtagagcagagatagttaagttgcaatgcaataacacagcctacaggagggaacaaatcataaatattttagagcagtcaccctggaacttagtttcacatatgttggtttcaaggggcccaagatgccagttcttattctagagcaaatgcagaaggaagcgatggggaaaaaacaccttgatagccttgttaccctgaacttcaggctgtttgcaacctcccgggagggcccagaggtatgttcttctgtggaagttaggcagctgatggaaattaccctgaagccaaccaacaggtttctggcgacacggagctaaggagatgttctccgtggtcccgccccagctcagatgtgctgtgactcagggacaggctgtggctttggtcaaggtctcactcaggccctgcctgggtgtaggagtttctgccttacaggtctgtgtaggtgtgttaatacaagtctgctttttatctaatcccaaactcaccgtctggtcccagatattgtcctctaatttcatttctgttttgggctccattgcccttgttttaaggttatgttgtttgcagctcaggtcatgaaggaggaggcaggagatgggtggttaggttggagagagaatcctgagcccagatagagaacaggaggtacaaacatgcaggcaaattgcagtttctgagaattctccacacgtggtggcatttctgcataacttacctgataacacagccccatttgatgtccttggcttggcagggggagggggcgtctacctctgggcctcactgctgactcaccggcaccctgagctcagctgcttcctttcaggtttgggttttcttttgcccctgcctcccgctgtgtgcggtttaatttagaaccttgctataatggtggccttctccctgtgttagcaccgtgctctcagcatgcctctgactttggaattaaggccagagctgtggttcacaacggggtgagaacagacacatccttggatctccggcacccagagctggggaggactttgaagatgatctgatcttcacgtgaagacctgaagcctagggaagtggaatgacttgcctaaggtcatggtgagcccttagcagagtgggtaaaaaatcctggaatttgagatttcatccaatcttctttctatgtaccgtaatgctttctggaaaaaagttaggttcttcccaaagagtgagaactctttatcttcttctctcctgtcttctggttctgggaagggctctgaaattcatttgacttctctttccttcacaactggcccttcctgccttatcttcatctttggcattcatgagcaaatgaaggtctgtatttgggaaatatagggtgtcttggtgtcctacagtgctcttaagcttggtctgtggctttctggccctgaggcagggtcctcaggaaccttttggaagtgtttgcaaagctgggatgcgtgtgtacttttctaggaagagaatctacagatttcatttgattctcaactgactcaagtaaggacaaaactactggtagggagaaggacagaaaggttggatagtggttggttgacactggggctactttaatacgctgcacttgatttggctttacagtttgcaaactatttcacacaaattatcccatctgccttttataataggtggttatcgttatcagcctgtgaggcagttgttgttatacccattttgcagagcaggaagctgagccttcatggttagtggcatgcccaagtcacgagtaagcagtagagcagggatatgaaccctgacttcagacttcaggtccagtgctcagggctgaggtggcttgctgtctgacatcattatgatgaacagaaagccttgaacttcccagagcttcttaatgcctactgttcactcatattcggccacagagccagacccaaatgctcacttacccaaggggtaggggagataaagtatgggaggcagttaccatagcaacgatctgtagagtggagccagtttgggatggtttcatggatgaggtgaatttgggagtaggcctgggtaatggtggaggaggttttaggctggggcaatggcccaaaaatggttagggggcaactaggtgcttggggtgggtagaacagacctaagaggtttacttgatcatcctgcagtcggtgcgagcttcacagtagttgtcgggctgcttttctatgcctgtctttgtgctaggccctggggctatgacagtgaacaggtacagccccctgccttcaagcagccagctttctagtgggagagacagatgcataaacagttccattcaacgtcatgtgggaagtctaggtagagagaagcccaaggcccttacagcggcacagacaaggggcagccacctgctccggcctcagatgtcagggagggcttcctaaaggagacggctcaggagctgaatcttaatggatgaaaaggaactggccaggaaaggagatgggagacgggcattcagggagaaggcatggcgtgcgcagggtgtggaggcatgaggctgcctgggtgtaggaaggaaccgcaagcagtgaggtcaaatgcaaaggcggagatgcagacagcgctcagagtggaggagctttgtaagcctggtttcagaccttggcttttagcctgcaggtaaggcatagaggaaggactttaatcagagaggtgtacagccttgcttggatcggaagggaacaggactgggagccaggcggccatgggactggtgaggcagtaacaggctctccacggcatccaggtcatagggggtgagacctggaacaagggccatgcatctaaggatggaccaaaggtcatacattaaaattagttgggagtaaagtccgcagtgattacttagacttgggggataagggaatcatctcagtggctcccaggtttgtggcctcactgactagatggacggcagctcttaactcaggtgcgaacttctggttgctggagcagggtctgctggggttggggtgggagggaagatcatggtgagttcagtgctccggtattgaattggaattgctggtaggatagtggggtggtgctgccctacagacaatgcactgtgcaagctagaggctgcagaagtgtgtgcccaagctgagccctgggagcggggaagcattggccactgagcgtaaccacggtgagggctgctgtagacaatgagagcagacctcttcctcccattgtcagataatcctttgtcatgccggccgctgtcgtcagggaagccaggcggggatgctgtgtcatgctggaggcccagctggcagaatccagcgacagccaagagcgtgtttcagctggaagcattagagtgagttaggggagaggcatttcgctttttaacatccacagtgagcagagccctgtcccagccccttggagtgtacagagtggggaagccctggaacctgcttccaggagcaggtagttttgttggggagagaagatatgaacatatgaagccactaaaaagctgtaacaaccccagggaagagtggaatgcaacttaaatagagtgttgcagatccctctcttcctgccatacttcatttttatagagctgatgtgttttaggcaaacgtccagtctttgcatgtttgaattctcagaaccgacaatagtgcctggcacattgtaagtgtgtgttcagtctatgtttgtggatctgcagggatgtacccagagttagtcgtctggggtgggaggtcagtcagggaaggtttccataagcacgtccaaaaggggcatcccaagactgatttagaatacttttagtaccacagtggagtaaaaatcttgaaaaccttccaatgacagagcacctagaaaggctgtgtaagctgtagctagcgtcctttcaaagaagagctaagctcatggaatgtaagggaaatccccagggatctcaggcagtgtggacggtgagctccagctgaggctcgtctaggcctgggggttgggagaggtgttgaggggtgcttcctggcctcaaagcccaagggtttgagtcgtgactgcatctcctccgagactagagatgataccaggaatcaagagccctgcctaaaacaggacctggtaaaagtttgcatgctgggagaaaggatggactagacagcagcccgtccgcatgggggatggaaagtgggtgtgctgctttttgtcttgacctggatgtgaggtggagaaaaatcttccctagaaatgtgagacctcaggcctgttagagctttgaatgtccactacacatgtggtccaggaggccctcaagagagaaattagcatgtaaagacttgggggccagtgtcttcctgactgtgagctctagggcatcaggggcctggggagagtctggggctctttgccctttgctgacttaaatctccaccttgggagatgctttgcgatcagggcagggtaagtgagggaggagagagaagagaaagggcagaggtgcccctcggtaggaaccttttaaaagggccttggagacagctgcacaactcggggaggcatgtgcaggatggcagagaaggacagttccatccaagccttcatctcttaggaaaaaacttcagatgagccccgtctaggaagcccagaacattctccctactgcatactcaggtcaggttcttacagataaggtttctttccagggtccccttaagggtgccctgtgcagattgcagttgctactggtcctctagactgggcactacattgtcttcccatgctcagagtctttagttcctacagtttcaaactcaggagacatcttagaggtcatctggtcaaccctccacctggtgtgggaatcctgactgcagcagcgcttggttccaatgtgcttgctgcttgtggccgggagtttattgccttggaggcagcgccttcccttatgttatagctggaaaggccttgtactgagctctggccaccctcctcgctggccattttcacccatggcccctgcagctgttgtgagagatggtttctagacctttcaccatcctgcttgcttctgctggaagggcctccatttgtcaagctgagattctgtgagaatccagccaacttctgtcctaacttacttcacacagaggcagcttttgaagatagatgtgagggtagctgagccggctgcataggcgcagtctgtgatgggggagttctgagaagctttggctcggtgcttttcggatgatcatgagagaggcagcagcacctgctgcaagttccttcctccgacgcccagaatacatttcagcttataagtaagtaacttgggaatcccatgcagggagctgtgtggaatttattgagtgcagggagtttattgagtgcctgttaaatgccaggcacaatgctgggcgctctctgtgtgcctcgctaaatgaaagtaacctctctgagggagacagagaggcagagatatggtaatgcctaactgtagttatgacaattgagccctgaagggattcagaaagaatgtgtgtggttccatccagagtgggtggagctgacacattccccatgctgttcccttatagggccttcccctggggtaggcagtatcatgatctcaccagtagctgggaacacacaggcctgtcccacactcttggggcatttgctgagatacttacacgtttgaaccatgagatcaagaaagtgacctgctagagaattcacatcttggcatgtcaccaaacaggctggtgtttacaagcaaagtattttttacagcatgcggtttatctgtctccggtatctacctacagtaccctgggcactctcaggaagcaaaatgtctttctgttcctccatctccttgatgcttggcatctgtgtgggtcacatattcagcagattgggtaataaagagcatgcgttgcctttgcagcaaggttgcatcagatggctggacgtgcctggatgtgctctgccactggcatgaaggaccctgtgcagacaaggccaatagtgaaggtcagggattccgagaaagcacccagtttctcctcttctccctctaaaaatggtttcttctgcccacattctattgatttgccttaatccttttagctgttaacctttgcctcagtttagtggacacacatggtatctgcagtgggtctggctctaggagtgaggtgagatgaattgaggtaagcctggcagggtccctgctgcccatctgcccatcttgctggggaagacagaatagccttgcgctagtgtaaggtggtaagtatggggtcaggagaatgaaaagggtgccaaggcagccagaagtcggatgactgtgaattttttttttttccaatggataatcatgctgggacacagatataaactgaggttgtcctgggtaggtgagggcttatggacacatgggccagggagggcgtatgcatgtgggtcatacctgacactattatcagacactgttatcagtcatttatactgcagggtgcacataggggtgatgggggaggtgctcgtgcacaagaggaattggcagctgtttccttcctttgcttagaggacgtaggggaaagcattatctgtggggactgaactcagaattcagatggggctcagtttacagccacagggttctatcttatatctcaccatgatctcagtttggggattggggtggaagtatggacagatgaaaaccatcgggcttgtgggatgttattggctacaggtaaaagaacagtgtactaacgatggctttaaaaacaaggtgtttcaactcagccagaagtctaaaggtaggagctctagggttggttcattcagggagtcagcgatcatttcaaggactctgtctaacctaggctgccatcttcagcacattggcctttgttctcaggccagtccccttatggtcatagcatggctgccactgctccgggcatcatgttctcacataactgcgtccaaaggcaggcaggaaggttagattctccttgtctgtcttaatttgtcaggaagggaagcctttcccagaattcccctgctgaagattctatcaaggctccttgaagagaaacgggtcagtacccatgcctccgctccagtggaggaggagaaagcaagtccctggtgctttcgcctcatctagagcaagaggcaagctgtgtttgcaaggaagtggggaagggagcaatggttggctaagcaaagaggaacatttacttcaccaagtttcaagatgtttttatttattgggggggagttagtgaattagctttacttttttttatatctcaatattgttgaggtttttgtttgtttgtttgtttttttaaaatctcaccccctagttctggcaaccaccaacctggtttatatcactataggtttgccatttctggtaattattacttcttaagccacaggtaatgctggtgcataggatcccaggtgttccatggatgccttttttgtggtcccaggacatgggttctgtggtctgttctcccagcagctcctccactttcccgacactggggccaggtggagaaccccagtaggcagaattgtccagagggagggagcatatgtcactggtggcctaggcagcaggactggaaaggcctgagggcctgaggctccagtgggttggtagaggatggcagtcacctttgcaggcagctgtgggttggggagaggaattggtgctcagctgtggcctgcacattctgcagaatgagttctgttgtccctgctgattgggaagcctggccccagggaatgcagggtgtgggaagatggtggtggatgccaccttcccctccccaaaccactatcccctctatacatacacatgcaaacagcccaggccgtggggctgaccatgcaagctaagagacaaatctgtcccctctgggctcctctccactctgctcagggtgtcactgtgtcctcctccccctcttcccacagcacagtctgtgggttgctagagcacttagcacttcccatcactccctgcctcctcatcattccttggatacttgcctatctgtcccctgggatcatgagcaccttgctactgtcctgggagtcatcagggcatttcctatagggctagggtggtgccggccacagggtccatgcttcatggaaaaaaaagtatttttaaggcaagatacatatttctagaaagggacttgttcatttggttatctgtccagattccaaaccagttccgtgtggcactgcacagtgccctggacgagaacttacggatctctacatgttttcctccctaagaggaagaaaggtaatcaactatcctgttctgggctgaattgtgtcctctcaaaattcatatgctgaagtcctaactccagcgcctcagaactggattggtggccaggcctttaaagaggtaattaaggtaaaatgagatcatgagagtgggccctaatctagtatgactggtgtccttaaaagaagaagaggacacagataagacacagatggggtcaacagtgtgaggatgcaacgagaaggcagccatctgcaagtcaagacggaggccttggaagaagccagccctgccaacaccttgatcttggacttccagtctccagaataaatacatttctgctgatgaagccacccagtctatggtggcctgctatggcagccctagcaaatgaatatggaaggattctcccctgcagcttgtggagggagtgtggccctgctcacaccttggttttggacttctagcccccagaattatgagatcatacatttctgttgctttcagccacctgatttgtggtcctctgttatggcagccatggatactaatacacatgcattgtgtgttatgcttgtgtttaggacttcaccccctaagtgtatttcatctttcagctctgagtgtagttgttattcttctcttttgcagatacacctgaaaagttagcattcctcctgaggtcacacagggaagccaggctagaaacccaggcctgtgtggactctggcctgcaagctgttgcatttgggcagtggggagatgtctgtaaacgcagggattgaacaggtggtctttctcctgaaacctgggtgatccaataataactttctttttcttttttttttttggagacggagtcttactctgtcacccaggctggagtgtagtggcgcgatgtcggctcactgcaagctccgcctcctgggttcacgccattctcctgcctcagcctcccgagtagctgggactacaggcgcccgccaccacgcccagctaattattttttttgtatttttagtagagacggggtttcactgtgtcagccaggatggtctctatctcctgacctcgtgatccgcccgcctaggcctcccaaagtgctgggattacaggcgtgagccaccgtgcctggcctaataataactttcaaagcctaacagttgctaagtattgtggtgtcatagtaagcactttgcatgtgctgtcttcattagccattacagcttctgtttcatagatgagaaaatgagggcacttcttccaacggggacatttaagcaagaaaagccagtgacttggccaaagttgcataccaggcttgccagtgagaagacaaactgaggacgggttctctgaactgtgccctcttggctctctagaaagaactgtgtggaaatttctggattcctgtgtcttagtccatttgggctgctatagcaaaataccatagactgagtagcttatgaacaggagaaacttatttcttgggctaggaagttcaagatcaaggtgccagcagattcagtgtctggtgaaggctcaatttttcatagattgcaccgtctcactgcttcttttcatgatggaatgggtgaggacgttctctggggtgtcctttatgagggcactaacctcattcatgaggctctgccctcatgacctaattgcctcctgaaggccccacctcctaataccatcgagtcagtggttagatttctaacttgtgaattttggggggatacattcagacagtagcggaggttgagtgttttaccccaggccacacagctaagaagtggcataaccagttttgctcaagctttgcctgtcacacacagggattggcaggttcccctgtagtcccctgatgttctgaaaaggtcactggtcttagattggccacctgtgatctggctgctctcagggaagtcacttcacatctgggtgctttgtcctcggtgacctcagggcttggacgatataatactaaagtctctgatcctctcattctgaggttcccagtgcccatccttctataatacagggattaggagggagaatccctgagatgtttttgacatttgcctacacctgagggaacagttgcacatcttcctgatacggccagttggaagtgtggtttggccattcattccttccctacaaaattacctctttgcacaaggtagaaatgatccccaccttgtgccaggtttgttctaggcttttgatggtgtgggctttgagtgacgtccacaaaagcgtgtggggagagggttgctggtgaagtgatgtcactgtgatttcctcctctaggtgaaacaaaaacgtggttgcctgcagcctcattcgcaccagagagaagccagccacgggcgtggcaagccttggaggcccaagttgagccaaagacctctgtgtctttccctccatcctgtttccgtttgcctttaggcccaggtggctggcagatgacggtgaggagcgggtgatggggtaattcccggaatgcagactgtaaccagggcagtcagaacaaggattgttaacctgcagccgcccagctcctggctcatcccacgaggcgttcgtgattttactcacctcattagaaaagtttacttaatgtatctgtcgtagattttagaactggaaaagaggttgagtgactttctttttctttttctttttccttttttttttttttgagacaagtctcgctctgccgcccaggctggagtgcagtggcgtgatctcagctcactgcaagctccgcctcccgggttcatgctattctcctgcctcagcctcccgagtagctggggctacaggtgcccgccaccatgcccggctaattttttgtatttttttttttagtagagacagggtttccctgtgttagccaggatggtcttaatctcctgacctcgtaatctgcctgcctcggcctcccaaagtgctgggattacaggcatgagccacaaagttcctgattctctgcggcccactcatgacctcagagctccagactcccaagctccctgacaccagtatttgggtggatgggaagaggcctgcagattgcagtgggtgaagaggctgtgcacacccagctgctgtggtggagtggctgtccgccagtgtgaccagctaagttgtcttctcatttcttgctgttgttggtgccaccaggggtccttacccctggcattgttgtgaggtgcctagggagctggcagggctagtgcacttcttccaatgggaacatttaagcaagagaaaccagtgacttggccaagttcgcataccaggcttgccagtgagaagacaaactgaggactggttctctgaactgtgccctcttgcctctctagaatgaactgtgtggaaatttctgggttcctgtgtctccctcaggaactggctccaggctgcccctgtacccagcggcccttgtctgtctcctcccaggccgaggcaggcactgcgatggaggcaccctcttcactgtgtttgccagtgcactgcagtggagaggttatgcctttgtagggttgtggggatagggctgaaagccccctgaaggcaggatccacgatggaggagcattatcgtactctggtgggctgggaacatggcccctttcccaagttctcctctctgtcagcctaacaccagcttttcggagagaaagaatcttccaggtttcctgagatttgcctgaggtccctgaggctctccttcccacttcaatctagaagatgggagaggctctaaatgacttaatcacagatctgaaagcccagaaggacctgagagaggcttggcctcctgcaggcatctgccttgtagcctcccgggaattggaagcttacagctttgcagcccaggccattacttggcagcccgggcctaaagacattatcttagaccaaggtgtgcctcccagtagccctggctgtgatctgagaggcacacagaacgcatatcccattctccttccagggtgaccaagtattcagagtgccaaatcttcttttggaggtaagctctcttcccttaaggtttctctggataaggtgtccaaacctctcctggcttcccttctctgtacatctcttttatcaatgcttctcctaaaatggggacacggaatggaatacggtgttcgaggtgtgacctgagtggtgcaggaatcatgctgctgtcacctccctccatctggacactatatttctgttaatgtagcccatgactgtgtaatttttcttcatgggcagcttctagatatggggattcccattccttcacagctcctgccaaaataatctgtggcaaagatctgtttccccagcctggactgttcacagccctgatgagtagcccaggccacctcatctgagtcccctttgagtggcccagggagctaaggtcaagggtgttcagaagctggtgagattattgaggcctgacccactttgcagaggaaggctggagctttctgcccaaagtgactgtgatggggattggggtggatgggcttccaggcctggagaaggtggggatgtttcatgcaggctcctacccctgaaaatctggccacccactcaccactgggaaccagctcctgtgtcttagcactgccacctccccctgggcctgccagcctctggcttcatttcttttttgctcaggaagcagagataaggtttggtgctcacctttgcccagttgcatagagaccctgtgacatggacatattggatgacttccctggctgagccatggaggaaactgtgtttcaactgaagacattcttgtggtgtctgcccccagggaagtctcttggtatgtgtgtgtgacacagggctcagtttggggcactgggcatggggaatagggggcaaaggaaaggaagactcaactgtgctttcagggagccttcagccagcaggagagagaaaccctgagcatgctggctgatgggaaatgtgtatcaaaagtttccttttgccaggaggaggcaggcaggactttcagctccccaagtctgggccatttctggaagcatgagggtttggagcttgtctttttattctaaacattgagcctgcagttttaactcctgggctgcccgttggtcttgtctgtcctgagctgcctgcacatcgatctgatcgtgaagggtgggtggtgagtgctccggatcgtctcagcagcatctctgccttagatggattctcagctgcccatctggaaggtcaggatgccaataggtgggggcatcactgtggagtggtagcgaagaattccagttttgaggctcacgagcttccaggattccaggcttggctctgcataaagctcactacagaatcttaaactctttgtgacttggtttcctcaccttgcctttgatagtggagttggaaagccccaatgcaaggggaggtgatggtctgctcaggcaccccgccccaagaatagagatgtcagtgattcacaggtgcacagagaacaagctgggacatcctcaaagtacacactctggagtgctgagaactggcttgttacccactcagctgctcactggcattgtgtttgtttgtttttttgagatggagtctcaccctgttgcccaggctggagtgcagtggcgcagtctcagctcactgcaacctcttcgtcccaggttcaagcgattcttgtgcttcagcctcctgagtagctgagattacaggcacgcaccaccacacctggctaatttttgtatttttggtagagatggggtttcaccatgttggccaggctggtcttgaaatcttgacctcaggtgatccacctgccttggcctcccaaagtgctgagattacaggtgtgaacctccatgtccagcctgctcactggcattgtgaccttaggagagttaattttctaaagctctgcttctccagctatgagattggcataacagtgtctacttcataaggctgctgttagaatgagaactaatatatgttatacacttagcccagtgcttggcatggagctgagtctctggaaaggatggctgttcttatgatcataggcaaatacagtgtggtcagaagagtccagcagggactgaaggaggggtggggctgtaaaagcagatgggattgcagaggaggggagattgtggcctgggggtagggacaggaggatggtggggaagagatagagaactgcagaaacagtaccttgaaggccccctgcaaaacttgtttggagacctggaaattcacaggtgtcagtcacccttgggctacagagggggctggaactcaggctggtcatgaaccattttgtgcccccattgtcccagccagagcttttggatgagggataggcacgtgaccagagccaggccaaccaggaaccttccctggagttttctgaatggaagctgggagagaaagtccttttcttcttgagggcatggcatgaaagaagcctggcagctttggccacatccactgccgtggagagacctgtcctggggagacagcacagcactagcagctgaagagaagcagagctggaaacttaagagaaccaatacctctgctcgatttgtcttcctctggcttggtgctgaatttgttagtttctatagtctctgtattagtccgtacaggctgccataatgaaactccacagactgggtggcttaaacaacagacattttatttcttcacagttctggaggctggaagtccaagatcacagtgctggtaaattcagtttctggtgagggctctcttcctgccttgcagacagctgccctcttgctgggtcccacacggtctctcctctgtgtttgtgcacatgggaagagacagctgtctggtgtctgttcttataaggacaccgcttctatcctaatcagaccccacccttaggaccacacttaccctttatgacctccttaaaggccctgtttccaaacatatttatgctggggattagggattcaatatgtaaattttgggaggacataattcagtctgtaacacttctctattcagtagattccctttctttttcttttcttttcttctcttttcttttgagatggagtttcactcttgttgctcaggctggagtatattccctttctgtgccttaaggaatggcattcataccactggtagaacacacaatgattttcagttagatacttatggactggtacaaaatataagccatgtattcatctatgtgtgcattaaagaatgacaaacacaactagtacatagaatttgtgatgttcacaagtgaagggagtattcagtattgctctgcaggaggctgagtttaataaaaagtcagtacaaggtcaatagtaatgttacagttggtacacgggtatgacagaaaactccaaggtagtgaattctgggtaatgttgcatgaactagtttgggttgggtttgtgtcacttggcactggtagagttttgaataatacatgttcaatttcagcctaaggctacctcttttcatgtaacaaatatgggttcctaaatgtttatttacataaaacctttatacatataattgtaatttcgagtcacaaaaagtggtcagcacctaaagacaactgtagtaaatatttttgtaaagaatccttttttatagtatctggtttgtttcaaatgcatctgttttgcaaatttagattcttaaacagcaacttgttatctaggattttggtcatcagaaacttctcagctggcacctgaaaaacatcagcacagtgacagttgatatatttaattgttcaaatgatcatcttagcatcaaacatgctgcaataaaaagtgttctctttgacatccattctccaaccaataataaatacacttattcaaaagttaagtaaggggtgtatttgagagctaacccatcctggtaaactcatactggaaaacctgataagcgtttgcagatctttttcagaatctgtaagagttatgttgtaggagagataatcacctgtagcactggactcagcatttttagactagaatatcctctcccgtcttgttgagtgatggtgatcatattttctgaatcaaaaatcaggatgagtatttggatatttgaaatcagaacttctcctaactatcatcttttatctagatggggactctggagtctcattgtcaaatttgtttatgtgctcatacaaattttaaaaaagtttgttgttgtttttttttttacttaaaaaattggccctaccttcagaccatcctgagacttatttcctcatcctagttttccccgaatatcttagctcgtttattaatatgatagaatgttaaatgaggtctgtagtcctaccaccccccccaatcctaacaaacaaaagaatattttctaatgttacctgtggaagcagatagcttggtgggctgaataaatgattagaatttaagagcctagttttaggtattctagttactgtaggctgtgtgaaaaaccaccccaaaacttagtggcttaaacagcaataatcctttgtcctgctcatgagtctgtaatttgggcagggctcaagagctacagtttgcatctattccacatggcatcagctgggctgcaatcagagctggaagatccacttccaaaatggcacattctcatggctggcaagttgtgctggctgttggttcttctccatgcaggtttctccacaaggctgcttgggcttcctcaaagcatggtggctgggtttgaaaagttaatcccaatgtagagtggagtaatagacattggagactgtgaaaggtgggaaggtgagaggcgggtgaagatcaaaaaacgacctgttgggtacagtgttcactattcaggcatgagtacactaaaagcccagacttaaccactatgcaatatatgcatgtaggaaacctgcacatgtaccccctaaataaatacaaataaaccaaacaaaataattatatattatgaccaagtggagtttatcccaagaatatgaaaaaaaccaaaccacaaaagtgaatggcccaagaaacaggaaggagagacggctaatttcttaagggctggcatagaaatgccagttatctaacagtctctggagtgtcacttccatatactactggtcaagcagtcacagagtccagattcaagacggtggggacacagaccctacttcttgttaggaggaatttcatagaatttggaggctattttttttttttttttttgagacagagtctcgctctgttgcccaggccggagtgaagtggtgtgatctcggctcactgcaagctcgcctcccaggttcacgccattctcctgcctcagcctctggagtagctgggactacaggcacccaccaccacacccggctaattttttgtatttttagtagagatggggtttcactgtgttaggcaggatggtctcgatctcctgaccttgtgatctgcccacctcggcctcccaaagtgctgggattacaggcgtgagccaccacgcccggcttggaggctgttttaaccataacaactggtctcacaaaaaggaatatccttccttctttttctttgagacagaatcttgttctgatgcccaggctggagtacagtggtgtgacctcagctcactgcaacctccgcctcttggcctcaagccatcctccctcctcagcctcctgaggagctgggtcttcaggctcacaccactgtaccccacaaaatttgttgtattttttgtagagacagggttccaccacgttgcccaggctggtcacgatctcctaggctccagtgatcctcccaccttggcctcccaaagtgctgggattctagggatgaaccactgcccggcctatccttccttattacagaccttccctgaggtttagattcatcttctacttgcagtcttttgtggaggagtgaaaaagaaatgtttggctgggtgcagtggctcacgcctgtaatcctagcactttgggaagctaaggcaggcagatcacttgaggtcaggagttcgagaccagcctggccaacatggccaaaccccatctctactaaaaatacaaaaattagccgggtgtggtagcacatgctagtaatcccagctacatgggaggctgaggcaggaaatcacttgaacctggcgtgtggaggttgcagtgagccaagattgtgccactgcatttcagcttgggcgacagtgagactctgtctcaaaaaaaaaaaaaaaaaaaaggagtgtttataaaaacttgcttgtatcatttgagctcagttatagttagtaaatgttttgcttgaagccccttttatatgctaattctttaaaagtggctaataatttaaaagtggctcccccttgtcctgggcatatagtggagctttatttcttcagccattcccagaaattgctgagactgggaagtgcaggctcttggctttgcagcaacggagtctttcgcagcaagaccatccacagttaagacccttctcagagaaactccactgtggcaagaccctgtgctggctgctgggggctgcagagatggatcaggggacactccatccctgtgccccactttcaggaagcccaaagtatcactgatggaaagcaatggcctcagtgtcactttttctcagggtgtccttgtcccctggcagaacacagtggaagtgtgtctatattctgaatgaactgttgactacttctcttttccttcctggggcacttgattttagaaagtgccctggtctaggaggaccaagacctggcttccagctgtgtcagataattacccccactctatttttctcatcggtaaaatagggaatttggtctaggctgggggttggcaaactacaacttgcagactaactccagcccaatgcctgtttttctaaatgaaagttttactggaacacagtcatgcctgtttcttcacgtacatctacggttgcttttggctggttacaaaaaaaagaacatatggctcacaaggcctaacatatttactgtctggccatttacagaaaacacttgctcacccctgatctaaaacaatggttttcaacttcattttagccatactgttttttttctggaaacaactcttctttatttttaacaataaaagcaattctcacagcacttggcatgtgcctggcactgtaccaagtgctttaaaactgttaacttactgcttaatccttatgaaaacattatgagatgagcagtagtatcatcacccacattttagagaggagaaaactgaggcagagttaacagagaggttaagtaacttgcctcaggtcacacagctactaagtggcaaaggcaaaatttgaattcaggagtcctgctctagagtttgccttcttatccactgggccatgctgcctctcactggtggccttatataaaaactgggtggagcaggccccactaactagaactgatgtggcatggtcagcatctcccccttgcctgttgactcttctttctgcagccccccgggatctcagggccatctctggcaacctctggaggctataacatctggcaaattaggcttctaagcttggagaggggacatcagtttgttttggttgctacaagaggaattgatcctggttgttgggaacttatgcaggccaagaactgtagaaagcactgttctctgggactgaggactccagacaaatagactcatttttatcgagcatgatcataattatgcctgataaaaatgagtgctagagacttaggtccacatttcaaaaccgtaactgaaaggaagacatatttcaatagttgccatgccccacacaaatatgaaaaccagtaatctattggaaccagttccctgggccagagtgatttgccttagactcttgtcataaaaatcagcaaaggagactgcacactgaaatgacacttcacactgaaaagatattgacgctgaaaggagattcacgctgaatgtcaccttccctgcttcctcctgcaaatgaccccacatagcctggggggcatttaggagctttagcatagcacccgcctcttgggcaggtgggagcctggggctgcagaccggccctttcttaggatgctccctgtttgcagattagtgacttgattggcccctcctccacccccaccattcccataagggactggttagtctgcagggatgacacccagcctcctccacccttggggatgtaaactgtactaggagcaggaaaggctggggtgactcactttcctgccagtgaaaagctgacctcaatcttggtagtggtttgaaggtgacttttgtattcatctctctgggatcttgggagacagtttcaactatggtatctactcagtttccctatgggaccccactctggcctgcagctcctctgccctgtacagaagggtctcctgttctaaggttttttttgttttgttttgttttgttttttggacagattcttactctgtcacccaggctggagtgcagtggcgcgatcttgactcactgcaacctccacctcctgggttcaagcaattctcctgcctcagtctcctgaatagctgggattataggtgcacaccaccacacctggctaatttttgtattttcagtagagacagggtttggccatgttggccaggctggtcttgaactcctaacttcaggtgatctgcctgcctcagccttccaaagtgctgggattacaggcgtgagccaccgtgcctggccctgttctaaggtttttgctgtctctgttttctccttggttggcctgtgcctgacacagtaagatttgggacccctgagattgagtggggtggggtcttcccaggtgcttccctcttgcttgtggtctctggccctgttccccgccccagccatcagcaccagtcccctaccccctcaaaaggctcaaagacttcctgagaacccggaatctcagtttcatctctgctggagatttttgatctgggggaaaggctgctctctatatggctgctttcagaccacacttggctctcccttggtttagccaaattggggttttcctcattttcaggagccagcttttctgaagtgttccttcctggcagctgcattccccatggtcctgtctatcttaggggcaaggacttaggcatcgggtgtcctagaggctagaagattgttctacagagaaaagtggttttgtggccgtaggtggtacccagacgtgttgcctgccacctgggtgcaagcaggaccggacctctgtgggtggtggagggagcttcccatgtgtggatggaggccttgctggggaagggtagatgagtacagctccgtgtcacagcccggggacagccccacctgctgcaggcggccttcgctaggcctctgtgaaggtccccaaagcctggctctcctgtggcttatcctgggagaatatttgccctctttcatctaatagttaactattgacagaacattaggtacttgaataaaatgaagctgtttagtttggggagatattttggaaaacagaagcttagttctcattgaggttaccttcttggtgtaggtggttgtgtaggtttttgttttgttttgttttgagacagggtcttgttctgtcacccaggcaggagtgcagtggtgcgaacacagcttactgcagcctcgacttcctggggtcaagtaatacttccacctcagcctcccgaggagctgggaccacaggcgcacaccaccatacccagctaattttatttttttgtagagatggggggtctcaccttgttccctaggctggtcttgaacccctgggccccagcaatcctcctgcctcagcctcccaaagtggtgggattacagatgtgagccaccaagcctggtcggcttgttttaaacaacttaatgttattgaaaatatgatgccaccctgatattgagataaattttaagggaagaatcacctctttctcattacttgaatactgtgttaatttttgcatattaagtcaatttcctcctttaatggcaattggttgatccatggtcatgttaaataattttgcatatttaattaactcgggtcttgatttgtctccggtcctgtttattactgatgtcaccgtctgtgtgtgtcttgtgatgtggagactttgcaagctgttttccacggagtccaagccccacagccctgctgtggcactgccttcatcagtgacgcgttcttggcggagaggatctagttgtagtttgtgcttcctggctgtcaagggccttgccttcccttctacaggaaacagctgagaaatcgctggtgtgctgtagccttaaataacagcacctgccactcagttgtgttgtctttcatgagttttccaagtgctctcctgccttggggcatgtgggaaggaaggtattatcatttccgttttacaaagatcccccgagagactgcaagtctcttggattttgctgctgacaccaggacaggaggtcacatcctctgaccctccatcttatgttctttccagcagccccagaaccagccatggaaaccaggggcagggcctctgtgctttagttccctgatctgtaaaataagggatcataatagtacctattttgtagggtcactatgaagtttagatgagctgccacatgcctgggacagtgcctggcacacaaccatgcaagctctcaggagggtagtgccccgtacctccaatcttgttatgtgggggacagacagatcatctggcttgggcgccccaccctgccatgcagataaatccatgcccagataacggtcatgtgggatgggaaggtggggctctagcgtgtgccttcttgctgtcctgtgctaggcatcttggggtccggcctcctgaacttgtgccctttcctttgccagagtgagttgcccaagaggctgagggtgggcatgaggctgcttacaaagctgagctgatgatagtttgcagggcacagcacccttcactcagggatgctggcatactctgtgggcttcttaacaggcaacaagttctgccagcccattgtacagtccccggctggctgcagtgtctgggcattctgcttctcagccttgccccactcactactttctcagtgagtgtcagtgagtaaacacgcacgcaaaagaataaaaccatcaacaagagaaagtgtggtgtgtaagggaaagggagtcattcattcattcattcattcagccagtgttgactacagtgtgccaagtcctgttctagctgctggggtgcagtggcgatcagggcaggccctgccctcatggagcttacagacaagaccatgacacaggtgcatgctatgaaaatgagtgagtgggacatactgggcctccccaaagttggtggggaagagagagaaggtaaaacccaaaataggttctgtgactggccagcacctcaggggaggcctttcgaggggcaagggtggagattttcatggctaagtcctgttgtctaggggggattgcccttacagggggtctgcatgacattagtcatgaatccaaggtcctgtggtggcatcagggctggcaccaaccacagcttgctgccgatgtccctcccatgctctgggtacctgtcatatttgacacctctgttgcagaggtgacagctagaaaagcatccattgcctttggggtgggggttcccatttgttgtctcatgggaaggaagggatgctttggaaaggctgtggaaacccctttgggctctgggtggataacatgagtggggccattggaaggggtaaagaatgctgagtcatgtctaaatgacagcacttcctgggcactcctacatgacttgcaataccccacaggcagggcccttcatctcagcctgtctaacagactgtggatttggattttcattcaaccattaaatttttaaaaaattctgtgaagctaatagtcaaagggttagtagtctcatttattcaccagatatttttcagcaacaacttatgtacctggcttttttctaggagttggggatatagcaggtgaacagaagagacaataaatcttgccctcatagtctagccttatgatagcagaagtctttctttaaagaaagatccctggaatctttaaatattaactcctggagttcacgtaggcatcgtgacagaggcacagggacagtggggttagctgggatgtccagggacagaaggaaacagaagcagtgtcactggtgaccagtcagatgggtggacgtccagcaccctcatgatgtggcagaagtcagggaagaacgatattctgtttaaaaagttgagcttataaatagccatattggaacatgtttattatgttgaggaggtaacttatacttgactggtcttctaatagagcagcaaatgtcattgagtattttctttgtgcctgggtacatggtgcccatggaaagatgtgttctttgccccagggacgacgatagttgagtaattagcaaataaaacaagggcaagtctattgagagccactttctatggcagggcctgagatcactatggaaataactcagtaagagcagtcagagaaggcttcctggaggaggtgtctccatgctagtcagaaagaagtggggaacgtgttctcagggagttagtaacaggggagcatggcttgtgctcatgggacagagtgactgctctgtcacagtggggttggcaatgaggggctagaggttagagggcaggggacagtggagaccagtggggggcttgacacactctgcagctgtgagccattgaaggttttgcagcagagcagtaccctggtgctggttgtacttagggtgtcagcgaggtggagcgagctgggagggcaggtatagcaagtgatgctggagagaacagctgaatgtggctctagagaaacaggctcctgcctggcaagtcacagggttgtgaataaatcactcatgctttctgagcctcagttcacctcatctacaaaatgaaaataagatttcaaatcctatttcatagattctttgtgagtcttaactttaagaatatatgtgacaatgctttaggaaaaaaaaaagtaaagtgtaaattcaagaaaaatctcagctgttggtgtcaggatccccttctcacattggcttcctgtacctatgagatagcaaaaagtaggggagaaatctcatattcctgtgagtacatgacattatcgaaacaccagaggaccagggaggatggtcagtgagctcacaagcattgatgtctgccatttgcatttaatcctcccagcagccccatgaggtggggaaacattgggaatcggagatgaacagctgcggcccccacccaaggtcacttagctagttggtgagacagggccctgacaggcactccttctgtagtagtgtgcctgggctgccatgacaaaatcccacaaactgggtggcttaaacaatgaacatttattttctcataattctggaagttggatgtccaagatcaaggtgtcagcagggttggtgtaatagtccatttttatatcactatgaagaaatacctgagactgggcaatttgtaaaaaaaaaaaaaaaaaaaaaaaaaaaaaaaaaaagaggtttaatggactcacagttccacatgtctggggaggcctcacaatcgtggcagaaggcaaaggatgagcaaaggcacatcttacatggcggcaggcaaaagagtgtgtgcagaggaactgccctttataaaaccatcagatctcgtgagacttattcactgtcacaagaatagcacaggaaaaacccacccccacgattcaattatctcccaccaggagggtccctcccatgacaagtggggattgtgggagcttcaattgaagatgagatttgggtggggacatagccaacccagatcagttgctctcttctgaggcctctctccttggcctgctgatggtcaccttcttgcagtgccctcatgtgatttttcctctggctctgtctgtgtcccagcctcctcctctcataaggacaccattcaaactgaattagggtccactgacatgacctcattttaccttaattaccactctaaagtcttttcttcagatgcagtcatgttctgaagtactgagggttagggcttcaacttacgaatttggtgagttcacagttcagcctgtaacacatttcttcaggatttccagagcgtgcacagttttgagcagaaaaacgcactgctggaggaaaaggagagaactggaaaattccagcaagctgtcatagacttgatctgggggaggtggggccccactgagaaagatgacaaggtgaacaaagatcagcaagtgattcggtgcacccagcaaacttagaatagatttacttcaagaaattcataaatgaaaaaaaaacaaaaaaacaaaaaaaaaacttgggtttcaaaaaatttctattaacttgctttataaaaagatttcataacagggttcctttaaatacccagccgcaccagtatacttaacaagtgatttgatttaataccatgtgattaaagtactacgtttgcagagcctagccattaaaagcaggacagacaacctgtaattaaaattttgctgaaccctcctcctccaaagaccagttcagttcgcagaggttgatggtgaaagcagccgaggcacttcaactttgctccccagtgtctttgctctaggtcagtgtgcacagggatgagaccagtcttgggggtgtcagcaccagcccctggccccctgcctggggctggcatacccctcctgctgtcctaggacacagcattggcttcgatctattccagcagcaatcttaccttgtccttctttatctctgtttctagggccagtgacattggtctcctcagttaggggcaggcagacatagacaaatgaatagtgacttttgtccgaacttcatgttagcaatttcaacctgcaaacattttacctccctcaccagagctgcaaacacgtggccacgttgattggtttacttccagtcctccctgtgagtggaagagcagagatccaaaccccttgtaaaaagaggtagacaataaccactcccagagctgtggagaggctgaatgggcagaatgtgtataatcagaaaagcacacatgaggctggttcatttgcagagaagcaggtcatgattctcagcgggtaaaagccaacagtgattaggaggaagaactcttgtcatctgggaccgaggaaatggggctttaataaagccagttgctgtttgggtgccagagtctgagtcctgtccttccatcatcagtacttattaagaacctactgcatgccaggaactgtgctatatattgagggcactaacagtccctctggtcagagagagccttctagcatggaagccttagtccctgccctggcgtgacgcacaggctaacggaggagacagacatccacgcacacactgaggctgccagaaaaagagaatcacagggcactggggagtccctggggggtggggggagcagtggtgcctggggaatcaggaaaggtttcttagggaagtgatgattgagtaagttgagaacaaaatcaaaagtcgaaggggagttactgtggccaagaggtgggagaggcgtgcttaaggcagacggaactttatatgcagaggcctggaggtgagagagtgagtgcagggggtaggggtgactcaggttatagggacccagactttgaggagggtggagggaggtgagggacagggctggagagtggagcggggaccagagtgagaaggccacatgtgtggagatgagggatccagaccttgtcccaggattttcttttggtgtgttgaaaatgttctggagctggatagaggtgctggctgcacaacagtgcgaatgtactaaatgccagtggattgtatactttaagatgcctaaagtagttaatttcatgttacatgaatttcactttaataattaaaaagaaagatatgatctgcaaagtatggaagtattgttttcaccctgtccccacctacccccttccgtcttgccttatgccctcctggaggtaacagtttgggtttgtttttgtttgtttgtttgtttgtttgtttgcccaggctggagtgcagtggtatgatactggctcactgcaacctctgcctcccaggttcaagcaattctcctgcctcagcctcctgagtagctgggattacaggcaggcgccaccacgcccggctaatttttgtatttttggtagagatgggggtttcaccgtgttggtcaggctggtctcaaacccctgacctcgtgatccaccctcctcggcctcccaaagtgttgggattacaggcgtgagccaccacactcggccaggtagcacttttaaaaatattttgtttcccctttcagtgtttcttcatgcatgacaaggaatatattcttattctttcttatatcaaaggtgccattctgaaaatgctattttgtaccttgcttttttcatctaagagaatattccatcagtgtcttccatgccagcacatagtgatcctccttatttttttcctgggtatataatattctatagtatggctataccatgctttattcatccaccccctatttctggatgtttgggtggttcccagtcttttgcttggacactgtatactgtgtagtcaaaggcaaatcactcttggctcctggcctcagggagcctggattagtcagggtctccagagaaacagaaccatgagagagagagagaaagagatttggagaaattggctcatgtgattgtgagagctggcaagtctgagatctgtagggcaggctggcagcctgggaattcaagtaaaagttgatattgcagtcttaaatccaaaatctgcaaggcagcagactggaaactcaggcagaatttttatgttgtagtcttaagccagaattatttcttccttctctttctccttctccttccccctcaccgttcctcctcctcctcctcctccttctcctccttcccctccctcctttctccttcctctttcttccttcctccttccttcctttcttcttgaaacctcagtctttgctcgtggggccttcaactgattggaggaggcccaccaacattacagatggtactctgttttcctcaaaatcaatttattataaatgttaatcacatctgaaaaataccttcaaagcaacatctagatgagtgtttgagcaagcagctgggcaccatagcctccccaagtcaatacgtagaattaaccatcacagatccaagaaggatgagggtaaaaagaccctgggaatgcagaggagaggagcctgggttgcctgtgtggctatcggaggtaaagatgagtcctctctttttataactgaggaaactccggctcagagaggtaaattaaattgcccaagattacacagctagtaggagctagaagcagaatctggcctgggctagtccagtacaaaactcacatcctaaccccatgggagttaatgctgcttcatacgtggggtgtgtgtcatcctggaggagaaatttgatctggccccggaagaagaaggtgttgatgaggtagataaagaagagtgattggaagctggatgcagtggctcacacctgtaatcccagcactttgggagggtgaggcgggtggattgcttgaccccaggagttcgagaccagcttgggcaacatgaagaaaccccaactcttcaaaaaatacaaaacctagccaggccactaccattagtgtgtgcctgtagtcctagctactcaggaggccgaggtgggaggattaattgagcccaggaggttgaggctgcagtgagtcatgatcataccactgtactccagcctgggcaaaagagcaagaccctgtcttaaaaaaacaagcaaaaagaagggcaattggcattttcagctcagagaactggctgtgcaaaggccagtgcgggaagtgagccgtctcggaggtagccaacatgtggctgaagcagtctttaaggacaagagcccttgcgtctggatcaggaaggctgccctggactgcactaagaggcatttgggcttcatttcagggcctaaagtcacaaaacggcagcctccagccaggtctggctcagcccacagagctgctggggtcagagcagctttaaaacactacgtgcagggcttggaaggccagcagagcacgggacatccctgtgtttcatgacctccccctccccatttattccagtcacctgcctggccctgtgtcctccatgtgacccaggccaggggtctccaaaatggcttactttgcaggaaaagacaaatgtgtacacttggctcattgtctgtttatttttgtacatgtgtaatgttgcactgatgtacagtgtgtacattttaaaaacataccaacaaagaaatttaacaagataagtttcaaaaagtaagcattctaatattttctttctatgacccagtgatcactcaggcaccccacttttgaatccctctaattagatgatggggagttaatgaaggcaggtttctgtgacaaaagctccaggtggtttctgtgacaaaagctccaggttgacacatggtggcagggcggagcttgagaggggtgtggttaggtcaggtcagcggacaagggccatatccagccacccacgctggccattcgcagtgtgccatcactgtgcggggacgggaaggcagcacactgcactgtgaatgtgcaagtatatctgaggacatcctgctcaccatgcctctggccgcctctgtatcaggtgctgtcctgggccctctgacacccctggtggctggtgtcattacccagggggaaggcagtcgcatccccagcagtgcttggccatacaggtcaccttccacggagtggagtctggtgtcaccgggcaccctcaggtctgatttgcagtcatctcaccaggtctcacctcctctcagcaagacctcccctcacctcttctttcctgaaactgtcttccagctcctccttcctgccggggcggcttcctgctgtcactctgaagagggagggtctctgttcctgccgctcttcagttcagacagatgccagctgcccggagttgcacccatttggggataaatttatttttctttccaagtggctttgtggtgaatgggcttaaataattccctgactatcctgtttaaatttgctccctctcccccagttctttgcctcctctgttttatttttctccatagcctgcattatcctgtgcataaaaacgagtgcataatattgcattaaaaaaggaaacaaaattaatgtcttaaaacgaccatccttttattatttgctcagagttctgcactttgggcaggagttttagggggtagagagtgggctgggaaaaggtcagggcatctctgttccttgtggttcagcccagggccgcttgggaccctccattcttctctgcgtggtgtctgtgtgtggttagcttgggcctcctttcagcatggtgttgttggctttattgaaaggtgactggcttccctcagaacagaaaagcaaaagctgctagacccggagtcacttgcgctacgtttctgagcatccagccacacactgggaagtgtggcgactatctcgtcccctaggagtgtggtgtgaaatgctgggacactcgatcaatgttagctctttcattagacacagccctggactgtcagagacccagctcttgaggtaggtgacttcctgtgtgacctggcccaagactcactccctctctgaatctttaaaatggggagaatagaaatatgggctagccacatgtctacctcaaggggctgcttggagggccaaatgagataaagagtaatagtgatgacaggtgttgggaactgggtatgaccaggttttcagaattttgctccttggagctcccagttccagacacagggagccccgcctctgccaggactcctgggggcagggtccagggtgcaggggaaaggtcccagcttccccttttgaggtggccaagcaggccgccgtcaggtcagcacgtaggccttgagtccagccacttttgttgagtgtttaaaatttaccagggactttacatcttttacatcttttctcatgtaccctcaaaacagttctgtaatgcaggtgatgctttgccccccgacagctgttctatggcaacacggccgagtaacagaaccagaactccatcttcaacccactgggatccagaccccgtgcctttttcccacaaagctggccagtgacagagactcttggcaaaataccagaattttccttactgtgaacactgccgactttaattagattaattttcgattttcttttgccttcaggggtttaaagctgacccagctggattacagcagcgcactgtgagtggaacagagttgcggtgtcaggacctccaagccctgcaacccccagcacaggctttatttatctatgcacccccattgagaggctccctcaccctctgaggggatggaaggtccgtggagatgcagctttgctctcccgggagggtctctgccctcaggctcagaccggggccgtcctaaagcctccctgccccggatgccttttgatgaaggctgctttgtgcacacacatgtgctgggctgtggccgcaaccccaagccctagttatccacagtaaacacagaacagcaaccaccccgtgcagccttctctctccaaggtaaactgttggagtaagggcttttgcctggacgaaggcctagtcaatgagagtgctttgctgactctaactcttgcttttcaccctggggagccaaccacaaacatttgtggagacccacacatgccaggcagggcctgtgctgcagaaacgtgcactgtggaacaatcggcctcagagagccgccgaagaacaatgcaggcttgtggattgtccctcccggtcctcgggcagcggcgcctgtgtacagagcacccaggtgtgcccccttgccctggcccgagaggcgccgaggatggggcctgtgttttgggggtgtatggtcacttgcactgaggctgcccggggcagggttgacctttggaagatcaaatatgtggccttctgggctttgcccaggccagctgctgacccaagggaggaacactcagtgtcgcgtgatgtgttcccctgtcctctggcctggccattgtcattgcaaagctgaagagatagaagaatttgcggtagctggggaagggaggcggggtactggtgccagtgaagtcccttcttgagatggccttttggttcatctgcggaccttgctgtctgcccatttaggcgctgccctcaccctgggtcccacttgccactctgctcacgttgagagtcctctttctatgcggttctctgcttcagccaacacaaacagcagaaataagccgggagaagccacctctgaatggaggttctttttccagattcgctgtgccagccggggcgtaaccgtttaattgctgacactaagtctctccgtaataccaaatgaaacaaggttccatggtgccctgagtacaggatttgagtatgacactaagaaagcagagaataaaaggacgcagggaggattcggtctgctcaaatgcacttttaaaattctcctatttacaccgtaattccctattctcctccattaacttgttttggtggtttagggcttgtcttttgtgtggttttggttttctgggcttcgccactgaggagagaacattctagaagggtgaaattgttaattattcttaaaactttgagagctgcttatgtggaatatgtcctatgagagcaccttgatattgcaagtcgtggcctccattcccctgggatgatctgcggggacagggtctgcccagagccctggtgtcagggtgtgatactgactgagtttcacaggctggcctgggggagccaggacttgaggttggagacgtgaggagaaaatcacaaacagaaattgtggctctagacaaatgctgcctcatccacctgaggcggggagtttgggtagattggaatctgacctgtgtttccgccccaggaccaggtggtagcaacggtatttaggtttttaaggtgggtgatgtcaaaagccatgtccagaagaaaatagtcttgttggccctattctttcaccctaagagatttaatccagagacggtgtgtaggatcctgctgctgagatgcgccgttccttccccggcttctctcacacctggacttcccttctgccatattttgtttgtctttggccaggacactgaaggatagtgccatagcccctgcgtggccctcatcttcagctctttctctagtacctattttagataaaagcttttttgagataaaaaattcatataacataacattcacccttttgaagtggattttttttgtcttcttgtttcttttgtttgtttgtttgagatagtctcgctttgtcacccaggctggagtgcagtagtgcaatcatggcttactgcagcctctatctcccaggatgaagcaatcctcttgcctcagcctcccaagtaactgggaccacaggtacacaccaccatgcctggctaatttttttgtagtttttgtagagaaggcatttcaccatgttgcccagtctggcctcgaactcctgggctcaagtgatccgcccatctgggcctcccagagtgctgggattacaggtatgagccactatgtccagcctaaagtggatggttttaaatatattgacgatgttgtgcaaccctcaacactatctaaccccaggacatttcctcaccttttacgcccattaccataactctcatttttccccagcttcctcagccctaggcaaccacttatgtgctttctctatagatttgtctattctggacattttataaacatggagttatacaatatgttctcttttgtaactggcttctttcacttagtgtaatagtttcaaggttcatccatgttgtggcatatctcagctcttcattttttttttatcactgagtaatgttccattaggtggttactctacattttatgtattcctttgtcaatggatggagctttgggggttgtttccatattttggctattatgaataatgctgctctgaatgttcaagtacaggtctttgtgtggatgtatgtttctaattctcttgggtatatacctaggattggaattgctgggtggtatagtgactctatattaaccttttgaagaacgccaggttgtatttcaaaatggctgcaccactttacaatcgctttagcaatgcttgagggttccagtttctctacatcctcaccaacacttgttattatgtctttttgattatagtcatcctagtgggtgtaaagtggtatctcattgtggttttgatttgcatttccctgatgactaatgacgttgaacatcttttcatgtgctttttagtgttaaaagctcaggtttagatgtttatccaagtgtatatctttggaaaaatgtctatcaattgtttgcccaacttttagtttggttatttgtctttttattgttgaattgtaagagttcttcgtatactctaaatactagacccttaccagaatttgcaaatattttctcccattccgtgcattgtctttttacttgatgatttgctttgaagcatacatatttttaattttggtgaagtgcaatttatctcttttacttactgtttcattggtgtgcttttggtgtcatatccaagaaattgttggctattccaaggtcacaacaatttacttttgttttcttctaagaggttcatggttgtacaacgctctgacatttaggtctgtggtgcagtttgagttaatttttgtatatgttgtgagctagaggttcagcttcattgttttgtttcattttgttagagacagtgtctcactctgtcacccaggcaggagtgcagtggtatactcatagcttattattattattattattttgacatggggtcttgctctcttgcccaggctggagtgcagtggtgcagccttggctcactgcaacctccgcctcccaggttcaagtgattctcccaaattcaagtgattctcctgcctgagcctcctgagtagctgggactacagtgcatgctaccatgcctggctaatttttgtatttttagtagagaaggggtttctccatgttggccaggctggtctcgcactcctgacctcaagtgacctgcctgcctcggcttcccaaagtgctgggatgacaggtgtgagccactgtgcctggccatctttactgttttacatgtagatacccagttgtctcagcaatatttgttgaaaatgttttttccattgaattgccttttgtttttcttatatgcctctttcctactaaaaagtaacttagttctctccttttcttccccccaagcccacacacacacatctgctagcctgcctcaaagtaccaggcatccctgctgctctaggaaggcctgcattgccagcccagaaccttgaccctaactcccaggtccctttctcagatggatcttggtgtacccaggtctctttgtgtctttattagtctctctggatgctagcattcatctgcttcagggaaagggaatgaaggaggagctgcatgggatcaaaaaaccccacattagtgtgtgtgtatattttttcatgcctatatttctgactcccaaatcaggtgtaaactttcctagtcatgaccctcttggagaccctcatccattcgtacaaaaaatgttcacaagttagataattaaatgaaggaactacgatgtctctgatggacaagtgattcactcaagtggtactccatccatccatccgtccgttcatctgtccatcaatcagtctgtccacccattcatctactgagaaataaaagagctggttgcttggtccctgtctgccggctgggtcagagttctgctacaggtttgtatgttgttagaggctcaggttagctgcccatccaagtggaagccaatttaccagaaagccagagtctgtggttactgtggctgtcgtcacgggtagagtgcttggtgcgggtcactggcactgaggcctttttagtgagtgggtcccctcaggagggtcaatgacacatctccaatcagcaaacaagagttagagcagagggatagtgtagcctcagggccccttcctccgttccaagatatctctgtctagatactgcgcattagaatttagtactgaagaatgaaggtggaggctggggaaacattctaactctcgggggccctgtgccaaccacccgccttcagtggtaacatccttgtcacctttgtttccatcacacctcacctgtgttgctttctacacatcctgaagtttaacttaacctggacacctttgggccccatgacccattggtgggagcaccacactactacttagaaagtggggtttttgactgtggaccaccgttcgggaccctctctgactgggactgtcattcccctgtttaccggaccgtcgtctttctgggtactctgtcctgcctgtcccagtgtgcagggctcctcctcccatcctgaggagttctttcttggaattttggctcccccgccctgcagcttggtttccactcccacctcaaggattagagttctgacctgaacctcagaggaggacaagtcccctgcctggcaggatgtggattcaccagggccgggggcacgggattggatatcaactattccactagctgcaggcatcgcggccccacccagctgacactgctttcgcatgtattgctttccagagatgagagcattctgcagtactgcccgggggctgtcttctctccatttagcaatgcgatgccacaattttgctgtgccattacacatttttccttcagcgtcattccagcatcagctctctaatatccctttttatagattttccatttcacagtgagagaaggtgagacagcaaatactgttttcgcaaatgcaggggctgatgactgagtttgatgtttttttttgtttttgtttttttttgggttttttttgttgttgttgttagattcctgagacgtaccacgtcccagcatgaattgtgtaacttatctgccctgtgtcgaaaattagactttgctcctgtattttcagaaataattcttgacaccctcttaggttttcaggctgtgttttggctctgccctcatcttatctctgggttccaagagcttttttcccatttctctttttttccatggcccatgcctgagttgggttggcaggttctcctcttcttgctgtgtccctgcagagtctctttctggcactgccttaaccactgcacttcatctgaggggagagagaggaagagccacttggctagggaagcgagtgctttctctgctggtaaagatgtctgggagaagggtccccccacccctgtccagtgtgccccaggggtcgggcagccagtgaccccttccacctcatttctttctttttgttgcctgcacaggactggagagctagcatgagtatctgtcctgcaagagcttattaagccctgcttatacacgtggcaccagggaggtgttattatcggtcatagcaaggcagggagggacagcagacgggaaggagttaaagttctccacaaggaaaagtgtgattaagtggcaaagggaatggtttggaaataagtgctgggggctttcaggggaaggggaggtcatatgggccaaagcggggcagaccttctgtctgaggagagtgagtagacccagaaggatgatgggtttggagttgggtggagagggacccttattggacagggaggatgtcactgtattctccctgagggacctcctgtgcgatttggtgtctgaggggccgtctgtttcaagaagtgggaggcgtggtggggtgtgggggctgggtaccctgagagtgtggtgctgtaatcaccctctggccagcaaggaagcatggcaagacttggccgagacagctgccagtgtcagaggaagggtcctgggccggagagtagaggcttggcaaggcggcagggggcaggaggcatgagaagctggcttccatggggcagggcagggaggtcatggaccacgcatggtgtggacacacccgtgggaacagagaagaaggggagagggagacattttcataaaaggtccctcagggcctaaagacaggcttctggggataaaggaggtgcctgggaatggggttgattctgtctggctttctgggggcctcatgcacatgagggcgtctttgttgcctgcataggaccacgtcatgccctcctgcctcagggtcccctctgtgtttcacgtgggctcctgaggcacattgcactgcactgaccttccccctatgtgctgtggtgcctgggcccagagacggctgtgaccttcctggcttccctgctagcataggttagtggtggtgcagaggtggtggtgggagtgcttgcggtagtagtagtggtggtggtaataacggggttagagctgctgctctgcgctaataaacgttttattacctctagttcgtttagtccttagaacaaccctgtggggttggccggtcatacagataaggaaactgaggcatagagacttcagcaattgcctgaagtgccacatctagtgaggggcagagcctggactgaacccccagcacatggctccagactccatgctcctgggcactcttcctcctcagcagagcaggccagcactgcagaatcgctttcatcatgccatttagaaatgggcagctgagggtcagcacctctggtatgcccagggtgtgccccacctctctgccccatgtctgctgtggtggaggggagggaggaggatgatgggggagtgcccagatgggaactgctggccttcagggggccagctgggccattggactggacaaagcctgagcacagccccagttgcacctggtgtgacccccacacatgacctggccatggggaaatctggccctgtctgggtggggccaacagtgctttggccctaagagtcttaggcttcccaaagagtgaggaaggacaaggaggcagagcaggggaaaggaattcacagttcgtgaaattagatgctgcagaaaatgttaatgaatgccctgttatcttaattttctcagagtgtgaagtgtttaggcatcatgaggatgagagtgttaccaaacccaggagagctttgagttcaggtcgcattattcttagatttgtagtttggtggggaaaggagtcggactatttttagagggcgccgatctcggtttgtaattaacagacagtgtgccctcctgctatgcactctcctcactcacactttgctgtaattagtgttttaatcatcttctacaagatcctcaggtccgcaagggcctgcaacatgcctgtcttcttcactaccccgtcctccatgctgggcatatgagcagggagggaggatcgattccaccatgagggcttgtaggaggtgccaacaactgggcagtcgaccagtgggaagttgagcaggtggcaggggcagcctgaactgagcatggatggacagaaggtatgtcatgtctggggaaagcaagtgccaaggatcctgggatgaagttggggaatgatgggaagaagcaggacaggaagtgccttgaatattaagtcactcacttctcttgtgtttagggagacagggctgaaaacacatactttgtagaaagaacaggaacggtttcatgattcttgtcttttatcagacagggcctctataacccttacagcacctttgtgagaatcggaaatagacatctcttatcttggtggatgaattttgaagaaagcggcccctgcctcccctcttcccacccagctggctgcagccttgtaccagggcacaaggcttaacaaatagggtttgagctggctcttggccctcacttgctctctaggatggatatttttgagcagtacacaagctgcgcgactgtatatgatcaccctttgagatttatggtctagatttaggcttctgattggagatagtataagatgggaagcctttctgtgtcacccaactctgattgtcttatttacttacacaattctgttagccatatgttgctgttctttgcacaagaaaccagggactattactactggaggtcaggacctttataagcacattgtccacagttcccaaatgtcctgggccctgaacattgccatcacccaggagcttatcaaaacgctgatttctgtaccccaaaatcccattgtgtgtgatgtaggagctaggacagagtccaagaacctgcattttcataagctctccagttgcacaccacagatctaacccacttctagacaaggaaacagaagcccagagaggtttggtgacttgcccaggccatcccaaactggagaggagacctgagtttggcgatgttcagtgcaggcctcctctgactgtctgcccaccatgctgaacccagtcctctccaagctctcccatctctgacgatctccaaggccaggaacctggctctgtgccattttgtttacaaactgtgcttcctttagccatcaatgttttgtcccctcttagtgtattatcagtactttactgaagcataattcacatacagtaaaatgcattaatcttaagtgcacagcctgagggattttgacaaatgtttatacccctataatcattgccccagatccaagtaaaggtgatttccattgccccagaaggccatcagttgttctgaaaggacagaggcacctattgggggacagagatcacttctgtttgttccatgcgtgtgtctttgggttttctgtaatcttccttggaagggtgaggcctgcggatggggcagaggtggaggagcagtgggaacaatgtgtagccacatttctcaaacccagagcattgtcatgtgccagggcagaccaagctgccgggtaaaagtgctgcatcttcttggggtgttaacaccatttgaagatcgtgcaagaaaatctatctttatgttgaaatatagggatggatagagagcagaatgtaaaactcatttggatattgacgacaaaacattcaccttttagaaagtggggaaagtgggcttctcttaaccctacctctggatccccaagggtagcagtcttgctcctgccctgtcctagccttaaggagagtttgagaagtgccagtgtgtggcattcattgctgaagccattcagaggatcccatggtgttctgtgtgattgagatagggcctgggaatacagcctggacacccacaccatccacacactgggggtgacctgctgggaaggatgacagtactgtttcccctggagacttggcaggtggcgcatcctccaaaactctttgaagaatctacatttttaagacatgaagctgtggacagggacacttggcattttcatcccatccctaggaggggctagagcatccaagcactgcaatatactccagcctgaagaggttctctgggactttgttaaggggcattgaccactgttcccacctcccagggacagaatcggctcagagcgtttcagccgtcgacccagccactgagcacgcctgctactcacagatgtgcctccctttctgtttcatatagattcttttctgatgctttgttttcctgcctcaatttcataaatctttatagttgagttttaaaaaataacttgcaaatgttttccctttgggtgaactcttgcttctgtgtgttgtgatggtggcgatgctgattccaagagctaaatatgcgatgaggatgcctgtcgcaggggtggtggcctctgccctcacttttcctagagacatatttgtaagtgaaatgtcaaaggcatctttggttatttctaggttctacatatatttaacgagttttaaaatactcgtgccaaattgcccagcagaagataggttgcacatgttttcactaccgttagcggacagagagcacttgtttccccaacaatggcgatcagcattcctttccacacttttacttttttttttttttttttgagacagagactcgctctgttgcccaggctggagtgcagtggctcaatcttagctcaccacaacctccttgattcaagcgattctcctgtctcagcctcccaagtaactgggattacaggcgtatgccaccatgcccggctaattttcatatctttagtagagacaggatttcaccatgttggccaggctggtctcaaactcctgacctcaagtgatctgcccacctcggcctcccaaagtgctgggattataggcgtgagccaccacgcccggccttaaatttgatagatgtaaaattgtaccaaagtttcctttgcatttctttggttagtcactgcgaagatttttcaggaatttataacctgtttctgttgcttcctttataaatttgctttttatgctctgctcattttgctatttttgatgtatttatgtctttcttttattttagttagagtcttaatttatagggtacctccttagtttccagttttcaaaaaatattatctctacccagactcagaggcttggaacagattcactccaaagcggtatcaggccaccactcctacacagtgtctttgggaacattagaaaaactgcttcttccctgtctcatacagcaccatcctaagtttagggcttagtgagtggcacccaggtaagttcaacctgtcctgggtcccttagccaggctcccctgttcagaacacagctgtacaacctacacaacccactgtggccactctagtgttgtaaaaagtgaactaagccacattcttttttttttttttttttttaattgagacggagtcttgctctgttgctcagactggaatgccgtggcatgatctcagctcaccacaacctccacctctcaggttcaggcgattctcctgcctcagcctcctgagtagctggaactacaggtgcgcaccaccatgcccggctaatttttgtatttttagtagagatggggtttcactatgttggccaggctggtctcgaactcctgacctcatgatccatccacctcggcctcccagagtgctgggattacaggcatgagccaccgcgcctggctgccacttttaaaaataataacgaaaactccaagccattgagggtacaatttttaatacaattaaacctcccagctaccactgtgggcatcatggtgttctgcatggaatctgattttgcttggcattggtctggtctgtgctgtggcatgccggatagcagaggcctgggagggagttcagaggcctgggttctagtcctggctgtgttactaatgcatggcatgactgtgggcaagccagctttttggggcctcacttttctcatctgtaaaaggagaggctgtgactaagtaaacttccaggtcattctcagctctaaatatctgcaagttcgagttttagctgtatttttcttttttcccccaaaagattatgacacctgtaagacaggttagttttagattttttctttagcatctgggttatgaaaaacaaaatccattttgacgtttttgcattccatcaaatttctacctgatttatgctgttttacgtgtgtctgaaaagaggattacttacacacagccaatcgcctttctccattttaccaaaggcatcttggggtctgtggagtcactgagagaaggcatggatgtgcttgacagtgggaaaatgtggttaaattactctcttggctcatcccaccttttccttctctcctttctcagtaactgtttatggggcatctccccggggaggctcagaactgagcaacccttcgaggacctctgtgccttgtggggagccgggaattactgggaccctcctaagtggcagctccatgggcattcttccttgctcgcatcctcatggcctctcccacagaggacaccccccagcccactctccctgattccactttctctaccaccccaggcctttcatgctttccagcattccccagaacccattctctgtggcctgtcaaaggtggggtttcatcccagccacttctccacttgctctcttcctagaccctctggccctctcaggtggccctgcctggcacctgtgtgctccacaccaggcctgtcttctgagcccaatccagctcccacttggctgccttagggacctctggacctcagatgtctcagaccatgtggtcccaaatctagctcgcgatcctcatccacagtccctgtctggctttcctgtcacctagctgatcccccaaacacatggcatcctgcctctcctgacccctgcccccaccctccctgacctgtctgtcctgcccctgcccggctcgctccacatccgtccttccttctcctggctgcatcttctgaggtctggcctcctacagtctctcctgctcccagtcttcctttattgctttgatccaaatttaaaacaaagaacaccgctgtcctgtggcgggctccctgcgggagtcactgctgtctctttacccttccccatctcaggaggggcccaatgcaggcttgcgcagctgaactggacttatccttgatcaaggtcagacttttccctctgattgttctgccacctcctcagccacacagtggctgagggcaccggacttttccctttcccctccctctctacatgtacccggcgcccctgtctcccataatcctccagaggttaagtagatccaagacccttgggctgcatgtcggagcaaatccagcccaactttttaagaaaaccagggctctgggaaggggcaaatgctgggtcacgtcgttggaggtttgtggcagggactctcatgcctgcgtgtatgagtttcccaggactattgtcacgaattatcacaacctggggggcttaagacagcagaaactcattcttttagtcctggaggctggaagtccagaatgaaggtatctgtagggctgtttccttctgagggccgtcagggggagtctgttccagcttttctcctggctcgaggcagctcccaacagtccttggcatgttagggctggcagatccagggctatgccggtcccctgcctgcctccatcttcacatgtactctcctcttgtgtgtctgtgtccaaatttccctcttcttataaggaccccagtccctggattagggttccagtatgaccccatcctaacttgtttacatctataaagaccctatttccaaataaggccacattcacaggtcctagggactaggggtccaacatgccttttaggagggaggacacagctgagctaatgcagtgtggtccatgtcacttgtttttgtggtgctagagagggaccgtgaggtgtgggtcacactggttcaccttgtgggtggatttagctggcctttgaggttgaaagttctcagcattgtatttgtaagacctgtatcattaataaacattttgctagtcttggatgcttctttgtgtggggggagctgggagatggaggacagaggtcacctgggccatctttccaggtgagattatacatttcagcctagggtggggcagagccacctcacggaagcatcacttttattctttcactttttgtcattttcccctttggaaactaagcttgttcgtgctctgggacgtgcggtcatgcgtccctcactgctgggttgagctggtaggcctgcccctgctttcctttacaggcgagtgcctcgtgctgctgtttttctgattgctctggaagttcattgttgctctggccctcctgacctgtgtctggcctttgcccatgtgcagagtttgtggatcagcatttcaggggtgcgggggcgtggtggtatgcgagtccatagccgtggaagtttgggacccaagcctcatgaggcagaagcctggctctggggctccatatttagtctggaatccagcctcagctgctgctctggggccacactggatgccagaaagggcagaacactggcccggagccagagctaggacagcagggcctgctgtgcagcgcagctggtgcccaaggggcatggaccttgctgggcctgcccggaactggcctgcccctgcctttgtgtcaaccaggaggcctgtgggaaagggggctgggaagaaagtgagcaaacacctcagaattggaaggatcagaactggacagggcctcggagtgacatagtccagtgcaccctttctgcagagaagaaagactggggtggcccagggcggtgacttgcccaaggtcacacagttaatggcagagccactagatttgggcttctggacatcaaatcctttgcccttccctggaaccatgctgcccaggaggccaggccgttatcagggtgggactccctccaggcaccaccttcgccagagaccagaagaggatggccacaccctcgggagcacgcaaattgggaaaaagcagacatccatttcggatgacttcctgcccctctttctgtgctacttcccaggctccactggcttctgccactcctcaccctccaccccgcccccaccactgagacctgcttattatgttagtcatttaccccatagtgtgaatatcagtcctctcccagaggaacttggacaacagccatggagtgagagttggagtcagccagacacagccagacacagcattacgggacatgttgcaaggtgcatatggactgaaacaggcagatctcagaaatggaggaagcccctgggacctgctctctcaggaagggaaggccagggagagctatttccaaaccaacctgggaagtgtgggaagatgctcctagcacgtctcagctcctgtctagtgactgatccatctcccttgtccatggagactggctgacccatctcatgttctatagctcagatctactcaggaggcagtccgatggcctcactcattataattaccctgactcttctaaggcagtcttcccatcaccccaccttgtgggtcccaggctggctgtggatgggccaccctctgatgtggtacccaccgctccaggcaatggctgcccacaaggacagaacaggctggcctggagctctgagcaggacacatgggagaagacagactcagcatcaagaaaaggtcaacaccagcctggcaggtccctggccccacgtccagtatgtgcccttacctgctgtgtgaccttggtgtctgaacctttctgagcctcagtttcctcatttctagggatccattcttcagattagaggcagaactgaagagagtgcagctaaaggcttagctcccagtagccactcacatagctatcattgtggtgcgcatttcctcatgcaaccctggcaggtaggcagggccagtacttgtaaccccattttacagacttggaaattgatagttagagtaagtaatggacctacccagccctttgcatttctggtgctgcactttttcttttcttttcttttttcttagagacagggtctcgctctgtggcccaggctggggtgcagtagcacaatcatagctcattgtagcctccagctcctgggctcaagcaatcctcccacctcagcctcctaagcagctggtactgcaggcatgcaccaccatgcccagctagtttaaaaattctttttttgtagagatgggatctcactttgctgccccagctggtctcaagttcctggctgcaagtgatcctcctgcctctgcttcggaaagcgctgggattacaggtgtgagccactatgcctggtcagtgctgtgctttttctactgaaacaccccggtattatctgtgggttttaggagcagttctcacccttgacccaattaacctagataccagtgaataccttattgtaaagctctctagctgccgagagaccccagcttcctgggttggtttgaaaatagctctcctggctgggtgcagtggctcacacctacctgtaatcccagcactttgggagactgaggtgggcggatcaactgaggttgggagtttgagaccagcctgaccaacatggagaaacctactaaaaactacaaaattagctgggtgtggtggcgcatgcctgtaatcccagctactcgggaggctgaggcaagagaatcgcttgaacccaggaggcagaggttgtggtgagccgagattgcgccattgaactccagcttggggaacaagagtgaaaccctgtctcaaaaaaaaaaaaaaaagaaaaagaaaaagaaaacagctctccctggccttccgttcccatgtgggcaaggagtggatgctggggcttggcctcatgggagaagctgtgcgtgggcaaccactcaagtgcagtgagtggattaataaccagcgcgagcctgcctcggccactgtcattcccatgacacgcaacttttgtcattgttaacagttggagactgtgtgcaggcctctgcctggcagtgctgaggatagcgattagcagggagtggcggggactaatcgctctcatcagccgggaagaatccaagcctgcctgccgttcacaggtggcctttagctccttgggccccagggaaagaggaacaaagggaatcgctgcaaaacatctgggggcttcctcttgttccggagaggcaggctgccgcggatcagggaatggaggcagcggggatctgggaggcccagaagcagtggaaccacagctgggctggtgtctatacagcccatgtcctgccttcagatgagcaggaacatttttagaggatgcctgtgaagttttctcctgttcctctcaccctgggcatcatcagggggctctgtatctggtgggagcatggcagcattcaaggtgcaggaggaagctcaggcggagattccctctggtcagtgtacagttggcagaaatgcccgggagaccctcagctggggaacgcacccaagatggagagcaggggcgtcaacacctccgctgggattcttaagacttcgcagaaaagggcaagtttgtagtgcatttgaaggacttggttgaattaaagcaaaattatcctcattattgtcatcattattgatattaataatatgtaactagaaatcttttttttttcttttttttttttgagacggactctcgctctgtcgcccaggccagagtgcagtggcgcgatctcggctcactgcaagctctgcctcccgggttcatgccattctcctgcctccgcctccccgagtagctgggactacaggcgcctgccacaatgcccggctaatttttttgtatttttagtagagacggggtttcaccgtattagccaggatggtctcgatctcctgacctcgtgatccgcccgcctcagcctcccaaagtgctgggattacaggtgtgagccaccacacccggccaattcgaattcttttgtattttaaagctgacttttatgttcttaaactctgggaggttttttgtttgtttttttttttaagatattattcttatttatagatataggaatgaggcctatagatgaaggtggctggctgaggtgagcaggccaaggtgaggatatacctttgcctcaggtggggttagggccaggcccagtgatgctgggaacccattcagatccttttctttcagaatatctggcatttagttatgcactgtgtgatagaggctcctgaacaatttcttagaggactgtttcctatcaaccagatgacatggaccaaagaggtgaatttttacctctcctgtgccacagatccctcctatgaacacaagccccccctcctatctgcccccttcccccactcctgcaatgtgcagcagacagtttctttggtgtcgtgaactgtggctgcagtctggcctacccttttccggcgggtcctgggggatgccttgctcaccggctggcttcctgagcctgcaccccatgcggatgcacggggtcccacactcagaagggttcatgtttggttaatactccatagtcactgttttgaaatttttattttgagcaagaagcccttcattcttccccacccccaccccaccccgccccaactgggcctcgaaaattatatagccagtcctgcttgctccaggccccacagttgttgaagcatggatctgtgctcctgactgccacgtggcaggtctgtgagctggcctaatggctatggagtagccggcagaggcccaggggctgaggcctgagctgtttgtggggcctggcatttagggcagcgtagggatttctggaatgagtcctcacacattctccagccaccactttccaaccctccctccatcccggcctctgccccttccctcctcacttggaaacaccaggtgcacgttgtgaccttgttggcaaaaagcaaggtgccggaaatccatgcacccacagcagataactgtccccctcctgtgcccatcctgaagctggcccaatctgagctccccacaggagtttatttttgatagatcgagaagactagaactatccaaggaacgagaactgccccgcttgggcctcctcctcacctggtgcgttcagtcaggctgcagcatgccctgaggatgtgctgcaagtccctggggccaggctgagagagctgaggcccttgtcttgatgaactgcaggagttgctgtcagggcctgctgggccctgaaggcctccagtctgccaagagggaggtggccgtgagctgagtggtgccaagtctccggtgccaggcattggaaaggtcatcttgacatccgtcttcccttccctgtctcgaagcatcaagtcacaatgaacaaaagaatcagcactaagcaggcatgaggaaatggacccccgagcctggccacccaagggatggggtcaggggacctggcacctgggcttcttgtggcctatccttgggtaagtcataggattctaggattttaaaggtggcaggcaccttagagctcacccagcccagcctcttatccagacgaggggactgagagcaaaggggagagtgggagcggctcccttccaggtctcagttaggattaggattgttggttgtgctgtctattgctgtgtaataaattacccctcaaattaccccaaaacttagctgaaactacgtacatttattttttaattaattaattttttttagagagacagggtctcagtctgtcacccaggctggagtgcagtggtgtgatcacagctcactgcagcttcaacctcccagtctcaagtaatcctcctgcctcagcctcccaaatggctgggaccagcggtgcacaccaccacactaggctaatattttatttttttgtagggttggggtctctgtatgttgcccatgctggtctcgaactcctggactcaagcgatcctcccacattggtctcccaaagtgctgtgcccagccttaaactacatacatttgttatttcatggtttatgctggtaaagaattggagctctgcttagctgaatcccttgctctgggatctctccgaggctgcaatcaaggtgtcagctgaggcaatattcaactgcgggaagagccacttccaagctcatgtgtgtgggtggtgacaggattcagttccttgcagcctgttggactgagttgtccacagttcctctccagcatggcagctggttcatcaaatcgtgcaagctgaggaggcagtagagtcaacaaggtggcagtcatggtcttttgtaactgaatcacagaagtgacatcctatcacctttgtcatactctatttgttagaagcaagtcaccaggttcagcctacagtcaagggaggagattacacagatcatgaatgggaggaggcaaggattattcaacaccatcttagaaagctgcttaccacggtgacatagaacagaaaatccaaagaacagaggtttaaacaacatactcctttatttctttcttacgtctacaggcaggcagctcaggcctcgtgtgagggctctgtgatcacaggggcccaagctctttctatctttctgctttgccctgtgtaatagttgaccgctatcttcaaagttgtctcatggcccaagagagttgctggaactccattcatcacatccacaatccagacaagaaagagaaagtgggaagagcaaaaggcatgtgccaatggaatcagtcccttttccttttcttttctttctttctttttttttttttctttttgggagacagagtcttgctctgtcacccaggctggaatgcagtggcgggaccttggctcactacctctgcctcccgggttcaaacgattctcctgcctcagcctcccgagtagctgggacaacaggtgtgtgctaacacacctggctaattttttgtattttagtagagattgggtttcactgtgttagccaggatggtctccatcttctgatcttgtgatccgcccacctcggcctcccaaagtgctgggattacaggcgtgagccaccgcacatgtctggaatcagttcctttaaagggttcagtaacttccctttacacctcattggtcactcctatctgtgagggaggctgcaaaatgtagtttttctctaggtacattttctcccccagtgttataaggattctgttaataaggaaggagagaatggattttccagattcaactagcagtgactgctgtttttaatggctcctcaacctgaaggtgtaaagccatatcttccacctccactgcatcatgtgggccctgccccaaattcctggtctcctggggatgctgagtgggtggaataaggggcaaatgttggaggataaagttctagtgcaacataggatagaacagtgaacgaagaagtgtaacatcaactggcctcttcgttcactgcctcattcatttatcatcgatttgctgactgcctaccttgcatgaggcagcaggaaaaggaggaagacatagagttaagggaaccacagcctccagcgggagacagacctgtgactggatagatgaccagtcagctaacagtcaccagaaagccagccctgggaaggaaggcatgcaggctgggacttgaagggtagtgatatgtgttgaatatgtgtcccctctcaatctcatgttgaaatatgatctccagtgttggaggtggggcctggtgggaggtgtttggatcatggagatggatccttcatgaatggcttggtgccatccccttggtgataagcgaactctctccctgagttcacgtgagacctggtttaaaagtgtgtggtaccctccccccgccccacccctgccttgctcctgccctggccatgtgacgtgcctgctttcactttgccttctgccatgagtgaaagctccctgaagcctccccagcagccaagtagatgctggtgcaatgcttgtacagcctgcagaaccatgaaccaatgaagccttttttctttataaattacccagcctcaggtattcctttatagcaatgtgagaatggcctaacacaggtggatagcagttgtctgggcagaatgggctgaggaagcagcctgtgtgctggcatgcagctccagccctcttgtctggaggagggccaacgctgggtgttctcttttccagcctgagaacttggctgtttcagatgaggagacccagtggccagtgcaggggacggatctctgcctgcagcagggcctaggatggagcctctatcaccctctattccaatgccctttcagcctttccagctcatcttctggctgcggcaccctgaagccaaacccttagacttccagtgggcctgcagtaagctccagactctgaaacagtgggtagatggcctgggtgggcagggaaaccccagctgagggtaatggggagttggcggaggctctgatggtcttaccagggctccagatttttcctacttggcaacctaaggaacatcacaggcatcccctgaaccatagttgctttataagtcacaaacgaacaatcaaaaccacctaacttagcctgtgaacttctgctcattcatatttaagttttcagaggctcagcctgaaggaagttggaagtgtgctgtcattagcaaggagagaaggtgtggcaggcacctctccgctctgaggccaaggtagcaccttccaaggatgctcaggagtgcatgaagcctgtcctgcctccagcaatacacagactcagaatatatgcagcagggcctgctgaggttgaggggagccagcaataagctcatggcaggtatcatctctgtgcatttaaaatttaaggtcagaacttgggaaccctttggtatttgccagccagaaggatctgcagctcagagggccatgaaacggtgaaacggcatggtggtgtgggcgggcaggctcctgtacttaccattgtggtcaacagagagggttctataacagcacgcagggcaagaatgagcatgatagcaccaataaggacatcagcatttcttgaatgtagtgaagtattcagcatgggccaaaagtactttatggggactatcttccttgcaagagacccagaacggagacactgtgattagtctccacctccaaccccagcctttttcctggagaaagggcaggggacaatcccagcaagactctttctcacccctgcccctatacgagtggagcagattccagattcaatagtggtgcatggagtgatcaatggataggatgccgccacctttgacctgaagactttagacctctctgcgtgggaggactgcccacccgacgggggcctgagagctttaacagagcagaaaatctcctctctgccgatcagctcatgggtgttggaaaggcctggcgaactgtaaagcagtgttgctggaggagtctgagcagatggttctattggcccagggtgtggccggggcctcacactgataggcatgccctccgtatgtccagcatgtgaccggatctgaaaggacacagactcctcagaaccagtgttctagccaggggggtcaacagccaacctttacatttttcctcttaaaggtttttttttttcttgttcataaaaatgccaaaatctcattttggggagataaaaagaaaatacagaaacagcaaaaggagaaaagttagtcctaataccacctctgaaagatgtctttggatatttgtagtttacagtcctatttctatgtattttcatgtagttgagatttcagggtctattaaaaattgtgttttctttcctacatatcatggtgtcatgagcaatcccgggttattacagcccttcgtaaacaattcctgagggctgaataagctagcaagccatgtctgtagctgagtgtgggcacgtcttagtgcccaccagactgtccccctcatgccagcaccttcctgctcagctggcctctgcactgcccatgtccacaggcacctggctgtgctcacaggatccagaggattagaaggagatctcctctagcgacagggtgggtaccatgtgctggagttaggaggcgaaagggtgacccctgtgtcttgcgtagatggacaaggcccccagtgtgatgtgatgagccctaacagagggtgccgtgacccagccttacctggcctgtcacggggcttccctgagccagcccagtgacctcaaagctttcctacctgtgacaccctccaagtggccaatccactttgagggtgtgaggtgagaagggacaactcacctagctgccaaccaatgtgtctaataatctccatgcctctgattcctcactgtcaattggagagactaatagcatgcaccccatggggttgagagcactaaaagcaatcaaacctgagtgtgtgcagagtctgcccccaacccccgaggcatgcaatagatgcgccccatcattgcttgcttctagggagctcccagggtggggagctggggctgacacaggaagtaacaagagtgacttggcgctggggagactgaggcctcaagagttcaggaacttcctgaaggtcatgtggcggtggcgatgagctccgaagcctgtgtctgtatgtgcttcatttgtgtgtcactccccatgggcacctttgtaactgttgtgtttttaattttctgtcagttggagcaagcagatgtggctctgggcaggatttcctatgctgtccttgtcacttcatactctgtcttctccttgccactctggggatgtccttgagcagagcccatctctcattcgccttggtatcccaaggtctagcacagtgcctggcagacactgaggaagtgacaggcgtttgttgcgctttgagtcaaggacagagccagagcaaaggctactgggtgagctgaagggatatttcttctgagctctgatatctcggtgtccccagctctgttcttggcttgtcactataaatcagactggaatgctggggtttttcctggcagtctctccatcccctctcctgaatagtgctggatgagatagacaaattcttcattatcttttgcagccaaaccagttcttccctttccctgcaatattcccagccagccctgagtagcctcctgctacatcaatcccagtgcagcctgtctcatactggtgacattttacattggcatgtccctggtgagaatgttaagcttgttgaaatctgagaggcgcctccttgctctctcagccacgtagacactgtgtttccttaggccactgctctcctacgtgttgggtagacacatttccaatttggatgatggtcctttcaggctttggtctggcctgcggagaagggtatctcagctcagctgaactgagatctgccctcaccactaaggtgttaggcccgttctttatctagctataggaaaagtaaaaagagcttttgtagaagcaaagaggacctgatcgtgttaatctgtgttaatttcaagggtccagcccggcgattccaggctcccaaaagaaaaatgtgttttcccccaccttgatctactgctctgtgaggtagatgtactgaccgcatgtttagacactgagaatcaatttagcagccttctgatctctatatattctgtgcgtgcacaacaggaataatgatttttaacactgggtttggcaagggcgttgccagactttctcataggcgatctgatgggaaagctgtccccccgagggtccttcctgtagggagagttatatgagtctgagaaaacatctggccagcctcatctgtaaacatggcacaatattattgaatgacagcctggggaccagcctgtggggagtggaaatgcagtctcaggacagctataaactaatggtctttctttgcttactgacacattgaagcagggttctgagatggcattgagacaagggcccccatcacccaccctcactggcttcttggaccaagactgcatatactgatatgttcaactcactgtcttgtatgctctaaaacacttttgttttgaagcaagaaaatggaagacaagcttagggatggcagtttcctggaggcagcctgagggatgagaaataaaagacattggcacaaatctcaggaagcaagaattttagtccaggctctgggatttggggtgtgtcatatcatagctctgtgggtatgtttcctcacctataatatgaagaattggcttgctcgtttcactgatgctaggaggcatgttcatttcacatcttaatgtttcttaaatcaggctgcatcttactatcgctggcatagcacccttgctgttgccagatgacaggcaggacatagtcgtcatggcctgagcctgtgtgaacatgggcctactgttcatagtgtcacatcctccattaaaagaggtttgttgttgattagccatgtattgagtatgaatgtcgttaaaggtgtctacaaaagggtctcatcatgatttattagcagaagggccagaagacagagcagtggggcaccaatttaatattagagaagcaaatattgttggaggaaagactgcaatctcataaaacagtaagaattgtcagtctcatgcatgctaaacaatgccacgaaaggtggaagaaattgccagaagttgactcagaagagatgaaacagtctcagagccaggtgaggcctgcgtgagcaatttgtctacatgtaagactatcatgaaggcattatggcatagcttaattgacagcatattttctctgtggttcataaaataatggtgagccttacagttgatgactttgctttctaagatctcttctagttctaatgtctaatagttgtgttttcatttttctgtcaagtggagcaagcagatcaaaaataacgtttttggtgtttctctcctatgttggtgctgcttctctgggcccctgtagcacttgacccttgatgtcataactgtgtgatcgcttctctgcccttcgttttgtgtccgtaacattcaataccaagcttgagttagtgttttttaaatggacatatgggtggatggatgggtgggtgaacgaatggatgaatgggtggatgaatggatggatggatggatgaatggatggatggatggatggatggatggatggatggataagaatgggtggatggatgggtggatggctagacaggtgggtgggtgaatggacagttagatgagtggatggatggatggatgaatgggtagatgaatggatgggtggatgaatgaatgggtagatgaatagatgggtggatggatggatagatggatgtatggatggataagaatgggtggatggatggatggatggatggctagatgggtgggtgggtgaatggatggatgaatggatggctagatagtggatggatggatggatggatggatggttggatggatagatgggtgggtggataggtgggtggatggacagatggatgaatgggtgggtgggtagattgatggatggatgaatggatggatggatgcagggcaggtgggtggaccgatgggtgggtggatggatgggtagatggatggttggatggatacatgaatgggtggattgggatggacggctagataggtgggtagatggatggatggatggatggatggatatgtgaatgagtggattgatggatggatggctagatgggtggatgaatggatggataggtgagtgaatggatggctagatgggtgggtgggtgggtgggtgggtggatggatggatggatggatggatggatagatggatgaatgtgtggatggatggatggataaatgggggggtggatggctggctgggtggatagatggatgaatgggtgggtgggtggatggatggaaggatggatggatggatggatggatgaatggatgaatggtgggtaggtgggtggattgctgggtggatggatggatgaatagatatagatgggtggctggcttgctggctggctggagctgcaccatgagatgcatcctcatctttggtgaggcaacagatacccttccaggaagcttcaaacaagttctccagattcagtgggagcctagactcagtgaaatttttttttttttttttttgagatggagtctcactgttgcccaggctggagagcagaggcgcaatcttggctcactgcaacctccgcctcccagattcaagcaattctcctgcctcagcctctcgagtagctgggactacaggcacatgccgccatgcctggctaatttttgtattttagtagagatggggtttcaccatgttgcccatgagctgaactcctgagctcaggcaatctgcccacctcggcctcccaaagtgttgggattacaggtgtgaaccaccacaccccgctgactccgtgattttttttttaagggttttttttttttttttttttttttttgagacgggtctcgctctgttccccagggctggagtgcagtggtgtgatcttggctcactgcaagctctgccttctggattcaggccattctcctgcctcagcctcccgattagctgggactacaggcgcctgccaccatgcctgcctaattttttgtatatttttagtagagacggggtttcacagtgttagccaggatggtctcgatctcctgaccttgtgatctgcccacctcggcctcccaaagtgctgggattacaggcgtgagcccctgcgcccggcgttttaaggcttgtcattgatgttcttttattcatttggtcctagatgattctaacaactatggtttttttggagaggcctccaagctactaagccagagattccaacccaagtcaataatcatggggccaatccatgtacattacttttttaacagctttattcagattcgatttatatattttataatttacacatttaaaatatacaattaaatggttttcagtctaattatagatatgtgtgacctttaccaccttcatcacctctaaaagaaaccctttagctatcacccccttgtctccctgcctccttcctgcctcagttgtaagcaaacaccattctactttttgtctctctagatgtgtctattctggacatttcatattaatgaaatcttatgtgatcttctgtgactggcttctttcatttagctttgtattttcaaggttcatccatgtggtagcgtggatcagtactttattccttctaatggctgagtaatattccattgcatgcatagttcatattttgttatccagtcatcagttgatggatgtttgtgtagattttaccttttggctattattaataatggtactaaaaacatttgtgtgcaagtttttatgtagacatgtgttttcatttttctcaggtatatacctggagtggaattgttgggtcataaggtttatgtttaatggttcaagaaattgcaaaccattccatatggttttccacagcagctgcaccatctgacattcccatgagcagtgtttgaggactccagttgctccacatcctctccaacacttgactcgatactttgtaaggtctttttacttctaagcttctaggattctgggtgaaatccagtgacagttgaggctatgggaggctcctttctggccttatatcccctccttctccatgtctcagtgtagtttgcagatggctgtgggggatttctcagttaattatctgccagttaaccactcagcctgctccctgcggttgtatctggctacagacttctcctgctgtgtgtgtgaagaggttatctgctgctaccatgctctagtgggtgaaattaaccacagaaataatgggaagtagagaccaaagactctgatggactaattagaacagccatcaggagctgccccctgtgggctctctgctgcaaggcatctggctgcacctgggagtccttcctcactgcagctgtcccagactagcctgtgggaggagctcttaggtcacagaggcccaccatgggcctctcggagggagcccacagtcctcccttccggcttctgttgattgcccacttcataccaggtcctggaaatacaatgatgggaaaaacgaaaaggtccctgttctcaagcacgcacactagagtgggttcctgatggaattaactggaacttagatttttctggctgcctgttttcccaattacttgatcatgttccagagagaagtaactggggaaaccaaccctaggaaaccatacctgaaccttctatgtggccttggccaagaggtcttgtctctggcttggcaatctgttgtgggaggcctctgtaatcgggctttatgttctacaaggtagtggatatggcttgcaaatatgtgtggcctgcagagcttggctttctcataccctctaaccagaagaagcctttgcagctcaaaaggactgcacctgtctcatccgtccctttcccccttcctcagagctcctaccctatctcagctcaacctgggggcaacgttcagtgactcattggttcatgccacaaggagtgggaatctgagatattgctagtccagggcaaatgctcaggattggagtcagatgcctgggtcatcatcctgccctgtcactgggccactggcatactgttccagggtccccatatgggagggtaacagggggtggtgatgcatgctctgcctaactgcagccgcagggttattaagagctgactggcaggaaggacaatgctgagctgtgcagactccaggggcatgaggcccagtgccaccctccagacctccctaaatgacttcggactccctggagagtacataacttctggcaccctggacaggacccaaaggcttgatctggagcagtttccaatgcccactccaggagggacgacagggtctagcagcttatgggggatgttgggcaagggctggcacattgagggagtggagctctgggaccctcactctctttggtcagagtatccatgtcttggagccattctgtccaggtttcagttctgagccagcctcttcctagccaggtgaccttgagcaacccttcgtgtcctcagtttcctaatttgtacaagggggacaaaaataatgcctacattataggatgatcttgaggattaaattaatatatgacaagcatttagcacaggggccggcacatactaaattctcaataaacacaggtatttattatcttttatatatttggggggagtcgtttataatttcatttgaaaaacaagtatgatattagaggaaaatagtttggaaaccaacaatctgtggggaatacaatattgatgatttgctttcctgctttaggaaaggtcaaagggcagctgcctttgagcaggagtttccctccctcgggtcctccaagcaaaggcagaggcagctgtgctgtgttgtctctgggcctggaggccactccaggaatcaggggccctgggcttttgctgccgatttctttgcctccctgtggttcgtagagaattcagggagagctgtaagagcgctgggcaccggatcaagtctgagattcctgtggttgctgtccagcatgcttcaggcattgtgtgggatacatgagggctccctggcagaagaggggcctgccctctgacacccaagctgtgtctgctgggtccacttgtaatgtgccacccatctgtgcccatcagcagccgtctgctaataccaaggtgggcagagcatttgttacctgctgctgaccattttctactttctgggaatccatcatgaaactgtcaaaaagaggaactgaatgtctatggtgaggtcagctcaggctcccagggtccaaggaaaggagcagacaggtcctcagcctccaggagctcatagtttagctggggaaggaggcagccactcagctcacattaaggctgagctggagggtggtgggggcattacaggagcagtgggacatccctgggctgtcctttcctcccttgagacactgagcaggagcaccctgtccctaggaggagcttgggtatgcacagccgagtttctgctgagtgacaccatcttctataatagctgtggctatcttcagccaggttatggttgagtactgctggtctggagcctttttttctttctgcttgcaatgaccttgcatatttctgttttggacctggactatcatgtattatttcacagtgtaactcccaagggcaatccttcgtcctgatttatttccaagttctgagggggagccctcatttttgtaggcatagaccacttccagttagttgctctttcgcaggggactttcgaactcggatgccttacaggggccaggcaggtaacatgtgtgagtgagggagccaggtgagagtgaggctgtgagcagcggggaggcattagagagtgtatgggtctgcagagaactggggttgattgcctggtctgaaggggacagcacttcttagctctagctgatggttacagcgcaagaaggtgggccagtgttgctcgatcatccagttttttcaagaaaagtcagaaattgtggctttttatgtgaaatattttgatttataaacgttagctcaaatatttttaaaatatctaactggctaaccagaacacaccatggtccagacgtggccccagcacaggcggtagcaatctctgctttgtgactgtgctccttgcaggacaaggcggtcatcgaaagtggtgggggggtgggggcaggcagaagcccaagggcccagtgagtggctgctatgagcattctgaggggtctctgtgacctgggccggtcagggtggcatctaagaggtgggcttgagctgttcttgaggatgagtagagagaaagggttgctgttctcgaacgtgagccagttctgccttgcaaccatagcacaagaccacctggacaggcctgcaaggccacagcctgctgagatctagcctgtgcacagcctgttctgggctgtggacactcccaccaggctctggaaacagctcggtactctctctgctccagctggtctgtagttcagggagctgttgccaagagggagaaagctgactggggaccctggaaaccccaagacagatgccagagagaacgttgcctgagaaggaaggcctggagcgctgctgccaccacacttggatgccctttctagccttaccccaggtgcttgtggacacattgctgggttcagagcagggcactattggtttcccttcctagcatgctccaagttaattttcattcttggccaataaacccagaagcttttgacagctggtggtggggctcacccatctaccttcagagtccacagaagagagaatggatctctgtgagttcctgcaggttggcaaaacaggtcaacccagggattggaatacaggagagagccagactgaggcccaaggaggactcagggtgttcagagttgggaggcattagggagtggtgagatctgcagagatctggggttcagagatagcagtcgtcattgatatccagagtagtcaaggagggcttcagggaggaggtgtgcccagaggtgggccttgagggaaaaggggagatttggagaggcagaggtaggagagaatgcagaagacagagtgaggtatagcagttgtgaagtcgagtgacaattgcaactgataattgagtgcttgatgtatgcctagcggtgttgagcacttttctcattcattctttcacatgattctcacagcacctcatgaggtggcactttcaccatcagcctactttaaacatgaggaagcaggcccagagtccgcccaacagcacgcagagaaaaggtgatttagccagcactggaacccagactcgggacccataagcatgatgtcaccctattttacgagtgggggcagtgaggaagccacctgactccagccagggatatggctgtccagctgtctggtggccctgcacagttttggtttgtttcagctatgacttccctgtccctggtgcctctagggtgtatacagcagatgctcagtatgtcttagttgggaagagttgtctcgaggaggctcttgaatgtcatgggaagaggtttggagtcctggttctgggactgggtgaccttgagggtgtggggggctggagcaagtcaactcccagcatccattggctttaacattctaggagctgggagtggggctggaggaaagcccgggcccattggcagtgggcggaagagctgaggaggcccactctgagggaaggacggtgctggagagggcgtgggcgggctgggggagccacaggcccgtctacccattctgggcctgcaatggaagcaggtgtaggatggagcagggccctcaaggattacgcagtcttatcaataccaggcaaaaacctataaaaaaaattcaagagcagggcaagagttgggtagcagcccagaggcggaggagaaggtgtcaccaggcagcctgggtttggtgccaagggagcaggtgggtggtcagtgctggagcccagtggaggcttctatgggctttgggggcagacctggaaacaggggcacccagggataaagcaggacctgcacgtcacagagcccacctggatgcccacctggatgcccacctggatgcccacctggatgcccacctggatgccctcccgcctattgggctaggcctacctgcccgggtgggttgctgtttcagtgttcttcctccgagaggaagtgctcatcaggagccaggaatctaatgaggcaccccccggggactgaggcctgtaccttccacactcctgcgggctgctctcccttcctccctctccagggcctccgatctcagcccccattctgggtgccagcactgcaggcctgctgagcaggaaagaatccatggcatctcccttgccttccggccagccatgccctgcccacctcatgaaaactggtccagctcctcagtgactcatggaggctactcttggggacagaggagtaagtgccaagccccagctctgtttccatgaagttctgatgagaccacagggcttggtccagggctttgcacagggtgggggctcaggagggtatgaggacaatgggatgattttggtgtcatctgttatttaggagtatctgtcatgtcactaactgcctgatgttgatgattgtaacccagaactgcgcttggggtccacagagcttaggagtcactaagggaaggaaggtgactctcagcaggggtccctggagaaggcaggctgttgagggatgtaaaggcttggatcctgcattgcagcctggctctacccatagatacctgagtggctcccagtacgtcattcccccttcagcccccaaggtcccagtgtcctcacctgcgtggcagcagctgaagagctgttgagggcaggcagcatagatatcaggaactacctccaacttgttcagacctggcagatgtgcctgagctccatgctgggtgttgcaggactgtaagcaggtgctgtcatgtcatgcgcctggccctgagagtccagtgtggaggtggtggccccagtgtccactgatcataataacctgtggaggtcatgcctggttctgagctccgccctgggccctgcgtgggccataagaggagccgccccttcaccagatagctgaccagctggccagaagtttggcctggggactccacccatttctagccctctggccagagcaagagtatctgaataatggataaagaagacgtgcaagattttctagatcttgtctatttcaagtgtagttctctgactggcagcagcagcctcacctgggagcgtgttaggaatgctgagtctcaggccccaactcccatccttgaaccagaatctgcattgtaacaagatgccctgtgattgtcgtactcattaaagtttcggaagcagtgctcccggccaatatgtttttcatgggtaggtgaaacaaaagtcccacaaattgatagttacaatgtgtgctacatgctgatattttcaatttagttatacattttttaatgctgagatcgtgacccaggaaatttgttttgcagctcatgaaattgctgagacctgcagtttgaacaccaccatgctagctaacaccctgttggatgtttgagtgacaaaagggttaatttggtggggtgacaggggatcagacgtttagaggacgtcagatgtccttgactcctgtgacagaaaatgttgccaatttccaaggtcacatgccttcgacttcatgcatttctgaactttcccatttcccaggggttggggacctggggctcctgcacatggaggcctctgcttcctcctgcttttctttggcaaacaccaacatggttgaattatcaggccagagcttgagggccgcagactgtcggggaagtacattctcgctggagtcttgaaggggagtgtgggctggactggggctggagggacgcggttggcagtgagcaggctcccatggcttcctcggggagagcctgggcaccctggcctctctcctccccactccagcaggcagcatggcctctggactggccctgccctgggggccacctgacagcctgcaagggagaattctagccccaattgtgcattctgggtgaaggtgttgctcccactctgtggggatgggaaggagagaggggatggaggggaccagggcccgaaagccagcagccagctctgcctataatagtcaccaggagctgcttgctggagagcaacctgggagcacagtgctttgcagcaccaggtgacatgggaagcggccacaggaaggtggggtgaagacgccagtggctgtgatgagtggatttagcagcaggagagcagggacaacactctgggccccattgcccaccacagctccgatgccacctccactgcagacttgctgttctgctgggacgagtggacagacctgtgagccccaaggctgctgatcttacggtcaccaagcaagccccctgcagccccacctgggccccctgcagcgggcctgggttccacaggaggctggaccccttgctgcagccacaagccaaaagatgagccaggaagcagaaattggggtcttcctgggtttcctcagtggggtgtcagaagggtgtgctgctggagtgagttgggtgctgggggtggagaggaaagagcctgaagaagtgtggggtgcagtgctgcctctgtgcgggcctcgaatgatggattccctgagaagtgctggtaggccctggagcagatgcatttcatctggtttgcaggtcactgaactcatccctgaggattggaggaggaggtaatgcccctaatgcctcgcagttcttaaaaggattggctaaattgatagctcctcatgccgtttgtcactgggtgggcaggaaaggatactgagaaggctgggatggctccactgattgtctctagcctgtgggtgctctccaatgtcagccttaccttttcctccagacctcctgcctctgaaggtcagactcaaagtcagacttggccaggggttagagggagagactggcaaccgaccatctcaggctgccccacggtgttcacagaaaccccttccagaacactagtttcctaaggaagctacagagtgctgggctgagagcagcaagggatggggaggaaggggaggaaggcgaaggggagtttgtttgcgtctagggtggggaggggacgctagtgtggagagaggcacctttttgtcaaagaacatgggtgattttcatttttgtccttaaaaatagccaggctaactgggccgttgtgacaagcacggactgtgattggctgcagcaggaggtggggagtccctgggctggcggccgagtctggatgaggttgtttaacagagatgcagacccaggaagagagcctgcatgcatccctttccccagacagacacagatgtggccaagcttggcggccctgggtcctctctgggaagcacaggcgaaggagctctggggcaggtcctgctgcagcccgggccctctgtgtcctccagaaagccgtgcccacaccggccctcccctccagctgtagactcagggctgcccgcccctgtggtgccctttacagcaaagtgcaacctcagcatttttcctactcctgctgcttgccttttagttcctcctcatccatcacctggcagggaatcggagcagagccgggagaggaggggagaggcgtgtcttttgtgttcttctaccttccctcttttccttttccttctgcctctggttccatcctttcttgactttcactgatcattaaaacataaattcctggctggctctctcagcttagccagcagcccagctgtttggggacttcccatcaggatcctactgggaatgagacactgagccaggctgaaacccccaaagctcaggcaggaaggcagcaaaacaagcctggaggagaccatcccttgccctgtgtctccaccagccagagaaagctctacccttttcctccacactcgtcttgccttaaaaatgtgttggaacttttctaggtggataccccaaagaataaacagggactcagagggatcgttgtacactcatattcaaagcagcattattcacaacagcaaaaggtgcaaacaacccaaatgcccatcagtggatgaatggataaataaaatatggtctagatatgcagtgtactattgtgatacgatgtcttattcagccataaaggggcatgaaattctgatacatgttacaatgtagataaaccttgaaagcattatgctaagtgaaataaatcggttgtaaaaggacaaatattgcatgattcctcttataggaggtacctggaataggcaaattcatagagagaagggtgaggaagagttcattgtttagtgggcacagagtttctgtttgggttgataaaaaagttctggaaatagatagtgatgatggctcaaaacactatgaatgtacttaaagccactgaattatgtgttcaaaaatggttaagattataaggttttgatttgtttgttttgtttggtttggttggttggttgttttttttgttgttgttgttttgttttgttttgtttttgctttcagacagaaactcactctgtcacccagactggagtgcagcaacacgatcatagctcactgtaacctcaaactcctgggctcaagcaatcctcctgcctcagcctcctgagtagctgagcatgtgcgaccatgctcagctaatttttaaaaaaatttttggaaagacgaggtcttgctatgttgcctaggctggtatcaaattcctggcttcaagtgatcctcctgcctcagcctcccaaagggctgggattacaggcatgagccactgcacccagctgaatgctgttttatgttgtgtatatttgaccataataaaaaattgggggcctaagtgccgggctgtacttccaggctgagagctgtggaggtggacgggcagaggagggccatgctctctccctctctctgctccttcttctcttgtgactgagatgaagcttggggcttttctgctttgcatgttccccgcttttctgaagctggggcctccccactccctctctgggccccgctgcggaacagggaagtgatgtattctcctgttccccctggaaaacgagagttcctggaggagctgaaatccctgggagagagtgaaaaggaggggaggaccgacaagtgaggggggctagggatctggcggccactgtgggccacggggctcaccccactcggagttgctgagggaccacgtggagcatgcctggaattgtctgagacactgaaaaggggagtatttgtcccattgagggcagccgcatggggcgctagctcctcatactccgggttgcaggtgccaggggccgggggcttcctgcaggcatctcctgactgcagaggaagcctggacaggagaccccggggcagctgaggtgaggcgccgctgggctaccccatgtgaatctggctgggcagcaaacactagagtagaaggaatggccgagaggacgtgaggacacaagaggcacccgcagagcgagtcctcttccttcctcggggcaccaaaaggctgcaggtttgggatgggtctcaattctgtcccctttctcggcaactattatgggtttggggtgatgaccatgcccaggctccctcatgggaccctgacacagccctgagacactcgggcatgtttgggagagccccgcagagccggccagaggctgctgctgcaggcagagcctggcactcaatcctcctggaaacggctccgtgtagagttcctgcaaaacccggttctccgactgcacctgttaggtgtgccagggagcccttgataagatctgacgtcttccaggaataatgggcgtggccttgtgtattgacttctcctgcaggtggctccttttcagccctctctggacatcggcggttttattcccatccagcggaggccagcttcccggggccaggcacggagcctgcttggggccagctctccggaacctgtgcccagctggggaataagcacatgctcagcacttgaagaattcactgctcactggcgagtcagtatggaattggggaacttggaggtggcctgagggactgagcaggccaccaggagtggggatggagagaaggcagttggggtataggcatagtcgtgcagacctggaactctcctgtgtgaacttgggcaagttacttaatctctctgaacctccgttttctcttctaagtagcataattatgccgattccatagggttgctgcgaaggtgaagtgagtggaggcagatcaagtgctgacgtgtctgggacatgacaaaggcacagcagacactcgtcattcctactattagcagaaattgcagcattcatacccatagccaaccctgggtgaatcttttgcttagtagcctgccatgaaaccaaggcaatgctctggccttctgtgcatataaggacctctagatttggcaggtggagggaaggagaaaatgcttccaggtgacaggttcagtgtgagcaaaagcacagaggcaggaaagagcgtcctgtgttcattttctattgcttcctaaaagtttactacaaacagcagcataaaacaatagcattcattatctcacagttctgtaagtcagaagtctggcacagcgtctcatgagactgaagtcaagttgttagccaagttgaattcttagctggaggctctgggggaaaagtctgcttccaggctcattggttctcagatgaatttacttcattgcagatgtaggatgaggtgcccacttccttgccagttgttgaccagggattgctctcaactactagaggctgcccacatgccttaccatgtgtctcttttccttcaagccagcaacagtgcattgagtctttctcatgctttggatctctggcttcttctgctgtgctgagctctagtcccagatttaatgggctcaagtgcttgggtcaggccctcctgaatagtctctctatcttaaagtcgactaatttgggatttaattttgtctgcaaaatcccttcccaagggtatctagactcctggagagtaactgggagagggtgtatacccatgactgtcttagaattctgtctgccacacctagcatgtgcccaggatgaggagcagagtagccaggggctgaagcaggggatgacttaggtgtgggcagctgtggagcaggaggagtaaggtgggtgctggtggtgtggggaggtataaggtcctgtaggctttgagtggcaggtgcaggaagaggcaatggacagtacctcccatgcccctgcctgtggcccttgccaccagatgtgcatagcccaatcccagctgactccctgaggacctgctgccacccttgcctccacatctggttccctcattctgaaaagggcaccgccttggcctgaaacctccagtccgctgattcctccctctaggatgggtgaacagacccacagctccaaggttgctgagctcagggggcccagagcgaggccctgcagcacctcagagctccctgcagcaggcctggggtccgagggaggctgggccccttgcagcggccaaaagcctaaaaatgagctgggaaagcagaggaagatgtgtgcacagcagggcggttctccttcccccgggcagttcttcctctccattccctcaccctcggagaaggcagtgagggtgtgggagagtcaacattcatgctctcagcagcatttctggaacccagcacaccattccttgccctgctttggactcgctgcagtgaaaacactcaacaaaccctagattattggcaaataactgtgttccaaagaagttctcagggttaaggttctgaggttcaaagttttgaaattcaaatgctccattaaacctgctaggacctcgcctttattactggcagcagcattcacgctgctctatatggcttcagagccctgtgtgtgcaggattcatgtcttctctgtgctttcttgtggtagtggtttggtagaagtctgttctactagttgtgatactaaaagcatgtgcagactctgttttctctggcagatcaggatcttccatggaaatcacaggtctccagataataaaagaggcacaaggcaagctttaaatccccttcccatctagcctggagcccatcagaggaaggggagggtccctggcctggaggtgagaaaggttctagctttcctcactcccaggtgggtcaggtgggagcttcgggggataagcaagggagcggggagcagagagggcggtggcggtgaggtcccagcagacctgggcccctgcagggctgggttgagcacatcagctccagagattgcagttctgttggtggactttaactagtgttccagccatagctggtcatctatgccgcgctgccccagagagagggtgcgagggctaatgggttagtcatgcccctgtaaaggtgaccaggcagtgtctgtggctaggccatatcagcatagacaatgcagcaagcctttctcgttctgccagtgaaatccagtcacgttcctgcagactcaccataggtgtgttccagtagctgcaccagagcaaggctgcaaaatcctgcttataagttacggcccataggcttcaactaatttaggggacagtctggtgactgaaaagaaaaagtctcctcttaagtagtcattttcttggaggacctgagcccctcagaggtttgtgtctcgggccccattgtgcaccctcaatcttggttctgttgtttatttcatcctgctttgtggtagattctgttaaatctgagtcaggaagtgaggcttggcctgtaggctgagctcatcttctgcctttcccagcgattaaggcctaggtagacactaactctgacactgcacagtgcctgtgctggccaatcagacaagtggcctgcattccctgggcctcagtctcctgccctacacagtgggaattacagcacatagtttatgctgagggcaagccagcccctcgctgacttctcagggttgttggaagaacagaacgccatgatggataagaagatgcttccaggagcagagggtgtttctcaggtgtgggcatcgtcgtctcctccagcagcgtctcacggagttctctgtcctctttcccaccagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccaggtgagcgcgggcccggggttggggcagcttgggaaattcagagggggtgatgcaggagcccctaattctgggcagcatccagttgcctgacactagaccgccaaggcatgaatggtcccacccagcagagcacccagaatctggcaggtgggctttgggatccaggcaggaagtgccctggctgtgcaccccgtccctctaacccacctccactcctccctatccaatgaggctttgaggcccagccaggcccacatgtctttgaacatacgtctcttgagtactgactatgtgctgaacgctgttccctgtcctcaataagcttatgttctaggagagatctggaggtttcgcttctccataatgcataccatcaaagaactataacttgtgaatattttctgtgatttcaaatacaagtagttgttggtagccaaaggaatgattgttagtagccaaagtctcgtgggattctcacccagggctctgtatgtcagacatacttagacatatgaggcaatccaaccagcgtcatgtttggtcctgcaccctcctgcctcagtctgtggcatccctgaccttggaggggagatggactcatctgaaagattgtgagctgagatttgaaagtcttggcttctccctcataaagtatgaatgcattaaggatagggaccctatcaagcatatctttgcctaacaccacaaatcctcagcagatttttgttcaagagctgcttccagattggcttctagctgccagtgtgaccttgggcagaaccttcaatgtctgtggggctgtgttttcttatctggcaaatgggaattatgctgttgcctcgggaatgttggaaggtcaaagacagtaagaagtacaaaagctgcagagaatcagtgctgcctgcacaagcatgtacaggagagtcccctgtcttatctggagtcagggttctggggatccgcctctcgtgcgtgttatcccatctccaagcctgggactcctgggacaatcagaaggtgagctacctgggtgcaccctgctttgggaaaaggctgagtccaaccacctggctcactttttgggtgggacccctagctttttagaagccagaacaaacttttggctttgctggaactcagaccaggagtcactctgggaaatgctgaagccacagtaatcccatgccctgtccccactgggaagcaggggacagaaaatagtcctgagggagaaaaaaaaaaatagatgtgatgctttctttagtgtccttgaggttctaaaatcacaagtaatgcaagcttataatttgtttgttattcaatccatgagtgtttaacaagcttctattctgtgccaggcactattctaggactcgtatctaggattgagcaaaaaagccctgccctcatggactgtgtattctactcgtggatgatcattgcgatggagaaaagtaaagcggaaaatggaacggggagtgaggaggagcaggaggggcttgcagttttaagtagcgtagtcagggaagctggcatggaggggagggaggggtgggtagtggagatatccggataggaacatctgggcagaaggaccagcctgtgccagggctgggctggaagaagagtccgggcccagccaggaggccagggtgctggagcagaggatgagggagggagagctgcggagatgagtcagagggatgatgaggactgtgtcgtcaggaggtgcgagtcctgagccctggagtggccccacatgaggaagaaagaatgtgaggagaagtgagcctagagaccagtgaggcaggagggaaccaggctgctcctggagcccaggaggggagtcgagggagtgggatggggagactgccttgcgggccactgccaggccaggtaagaggggctgagaatggctgactgagcagggggccgtgacggggaagtttccactgagcggtgaaggcagaagcctgcctgtggccagctcaaggaacagaaggagatggcctggagactaggagaatagtacaactgttttgaggagtttagctgtaaaggggagagacatgtggtggtatttgggggaaataaggtcaaaataggagcattgacctgtgtgttcaatccaggggcaagtcaggggttgctggagccctggcctatccccagcccccagcggttcatccacaatgacaggagggagtggcaggtgtggggccgcgcatctaaaatggctcctgcagcacagctgtggtttctctccagcggcttgcggccacgaaggtgcagaggcagagttacaaagatgactttaaccagggtggaggtttctccagggaatacagtggaggagagaggggtgagggaggcacaggagtgatgatggtgagtcacctggatgctgagccaggccaggacgggagtgggtacctgaggtggttgtggaggctgacaggtggtagggtcagtggattggaggccacccaaagaattgtaatcctggtagcaaagagactgagctagaaagatggtgggggtgtggcgtgtgtccaggagtggggtgtttgaaatcagaggtggaggaatgcagtcatgggtcaggagagggctgggtgtgagcatgggagtgtgtgggggagagggagaggccaggaggagagcgggtcgtgaaactcagatccatcttcatggatcttgaaatcaccaagaaaggacaaaaggatgtgggaaagggtggctgtgatacaggagaaaagtccttgaggaatgtgggagcaaggtggtggctgggtggcctggcggtctacagctgaccgcatggagggtcttgtctggtggtgcattaacttatttgcataatcctttttttaatatacaaactatgcttattgcacagctaatagtaccatgatctgaagtggaaggaggaggaggattaggatagattggaaaattgtaagggaaattaacctctttagattgtctagggcaggaactaagtgaaccaacttttgcagtcccctggaagcccctagagctgacttccccaggagcagggcctgtggatgggcatatgggctggctgggtaccccctgttgtgggctgcctgccttttcagctgtgtggcatccaggcctgcagcagggcatcctccaaaggttcctccagctgaaatttgctctacctggaggagccaaggaagcctcaaagcttcaccccagaggtatgcgtggctgatggtagaatttctgtgcccagagcagccagcggggacatagttttgaaaggaggtgccctcccagcgctttcagtctgggctctgtgcttctggcaccagctccagggatcagtggggcctgactcacgcttggatgcccccatctgtgtggcgggcaaggcaaggctgtggaggggctttcagactgacgtctgctgtgaagtgtggtgtggagaacacctgtgtggtgtgacatttggatgcattctctaaactttcttcatgctctggaattccctcgaagaatgcagacacctggcaggatgctggggcctgcaggcctgcctgctgctgccggaaagggaggatgtttcaatcctgcccctaccgcgcccctgcctccccgatccccacagtcacacacacacctggggtaccgactctggaagagggacggctgtggcccactctcaggaaggccagggttagctgtgtctacataagatactttttaaaaaaattctctattaacacagctttatgggaaatatttctgctaaagcactttggcttgtttttttttttaatctgatgactagtttaaatggaagccaaaaagaaaaaaaaaaacagcaaacactcagggaatgttcctgtctgcctgtgtggtattttgatgtttctggggaggaaatttgttaagaagcttggaaaccttgagaagacctgagggagtggagaggaatgttgctcttcagctggtgaggtcattttttaggatctgagaagtgacagttgacactcagggagaaaatatctcatgatgtttgtacacttgtgttcctctcgtccttcccagtaacaactagaaagaaatgaaggatggatggatggatggatggatggatggctggctggctggatggatggatagacagacagatagataatacatagataatagatagataagatagatagatagatcagttttcctgtctcttagatgaataaccaagacaatgtgtgttttaagtttgccaacattttctggatgccatgtttaacatcatacctctccccatgcttgacaccacgcccctccccatgtttgacaccacgcccctccccatgcttgacaccacacccctccccatgcttgacaccacgcccctccccatgcttgacaccacgcccctcccccgtattttacatcgtacccctcccccatgtttcaggagcacctgctgtccaatagattggaagtccccacagtcactctatccttgggaggaggagggattttagccctattctaaaggagggaaactgaggcacagaaatggagcatggccaaaccccactgctgggtggtggctgagctgggctctggagccccatccccaccccacctacttctggtttcctgctccgtacaggccatgactgattgggtgttgggtggttaatatagatttctttcctatagaaagaaaattaggtctccaaatctcattgaccactaatcttttggggaagagattaggatgttgtaagtggggaaaattttggcacatgtgatgttcgtggatgatctagtggatcaccagaaagcttggaagcagtatgcaactctgagcgagcatgaactcacttagggagctgtgagaaatactgatgtacaggccccactgctagagatgcaggcaaaggtgaggggcctgggcctgaactattcataagcctgtgcatgactctgattgccacagtgggagcagggctgtctcctttctccccctccatggcctgctgccccgatccagtctcttggaaagataacatgtaggaaccctatgaagatacatttaatgacagcatagtttccagtaaattcttgttaaggggtcaaattaagagccagtgagagtgaagatcacttcctatagccctattttgatgctttccggcacttggaaaccctgggtttcatctaaaatgcagtgatctttacaaaggggtgcagcagtggcaatgaataggatagggtgagagtgttcagatcggctcaatggcttttcctaacaagtttctcctctttctctttacgtctctcctttcattctgccttccctgttcactgttccctcgccctttttctaaaatcccatctcttcatttccttctgcccttaaattcatttttcctgatgtctttgctcacaggaggaagtactcaatggtggaccacccatgaaaggcttaacagaagaagtgagtttataggaggactgcggggtggttcagcatgggggatttattatatattttccccttatttaaaaaatgtattctaaattatacaagtactttatgcatacattcccatagtgcacaagaattcagatattaataattaaattctcctgagctaaaattattttaaattatacaagtcctttatgcatacattatcatggtacataagaattcaaatattaacaataaaatcttctgtgctaccacctcattctgctcccttactcctacctcccatcagatgagtgagttcatttccttgccttttttaatgcctttcctgacataggtatgacttgaagaaatacaatattgtcaaatcatatatcatagccagtggatatattgttcaataacttgcatttttcacctgcccacatgccccagagattcttctgggcttgcacatctgctgtgttccgtttagtggctgcccagttgtccatagcatggatttatttaaccatttgcttaatggtaggcactcaggttacttctaaattttcccctggaaatacgtgatacttcaacacatactgttgaacatgcctccttctgcacaaataatggagtttctttagttagatgctgagaagtaaaattaattttaatagctgttgttaaagtgctctccaaagatcttccattatccatactgccaccagtgtattgggacatcttgtcattttaattcacattgtcttatttctttttctttctttttttttttttttttttgagatggagtctcactctgtcaccaaggctgtagtgtagtggcgcgatctcagctcactgcaacctccccccaccgcaggttcaagcaactctcctgtcagcctcccgagtagctgggactacaggcacatgtcaccacacctggctaattttcgtatttttagtaaagatggggtttcaccatattgatcaggttggtcttgaactcctgacccaggtgatccacctgcctcgggctcctaaagtgctgggattacaggcgtgagccaccgcgcccggccacattgtctttatttctaatgaaattgaattaccaatctttttattttctttttttctttttttttgagatgagtcttgcactatcgcccgggctagattgccatggcatgctctcggctcactgcaacctctgcctcccaggttcaagtgattctcctgcctcagcctcccaaatagctgggattacaggcgtgtgctaccacgcctggctaattttttgtatttttagtagagacggagtttcactatgttggccaggctggtgtcgaatgcctgacttgtgatcccctcccatggcctcccaaagtgctgggattacagtcatgagccaccgcacctggccgttttttttttgttttttttttttttttgagacaaagttttgctcttgttgtcgaggctggagtgcaatggtgtgatcttgactcactgcaacctctgcctcccgggttcaagcgattctcctgcctcagcctcccgagtagctgtgattacaggtgcctgccaccatgcctggctaattttttgtatttttagtaaagacagggtttcaccattttggccagacttgtcttgaactcctgacctcaggtgatccaccctgctcggcctcccaaagtgttgggattacaggcgtgagccactgtgcctggccaccaattactttttaataggataaaattttattttctcaaagtaacaattggaaaaacagaggcaagtgaaaaatggaaaaaaatcattttatggcaactaatataatttttgtgcatcattttttaaacatcttttacaaagttgtacttctagcatacatgtaagttttatgatctgtaggttttaatgatctcctagacattgtttggtggtggtttttagcataaagtgtaactatttaaatttgctctttttctgctaggtggtaaaatataatagaatgaaagctaacatttattcattcaggctcttttgtaggctcagggggcaaagtcaagaacaaaacaaccatgatctctgtctcagtttctcacagggaaagacagacaatagagggagaaggaaatgggatgttagaaggtgatgaatgcatgagggaggcaggaagtgagtggggaaggctcgcttaggagtgaggatttgggcaaggtgactcacgcctgtaatcccagcactttagaaatctgagacaggtggatcacttgagcccaggagttcgaggccagcctgggcaacatggtgaaactcagtctctactataaatacaaaaattagctgggcatgatggtgcatgcctgtgatcccagctactggggaggctgaggtgggaggatcacctgagcccaggacccagaggttgcagtgagctgagatcacaccccttcactccagcctgggcaagagagtgagaccctgtctcaaaacaaacaaacaaaaaacagaaagaaagaaaaagaaagaagacagggttgggggggagggtggggaggaaggaagggagggagggagggagtgaggatttgaaggaggtgagagtgaggccacctgggaaagggtatccaggcagagggagtggccagggcaaaactctggtgtggggcataccacacagtcaaacgggatccctctgaatgctatgtagagaataggctatggtagggggtcagcaagagaggaagcagagaccaggaagccgtctccttgctgcaggggagaggcaatggagactggggccgtgtggtcactggaggtgatgagatgccttcagagtctaggtatgcttggaaagtgctgacactgtgattgaccctgaagattttagcctgagcaaataggatagactttgcagaaatgagctatgcaagaccctggaagagcagctctggggggcaaaggtcaagagtcccgtttgggcatgaaaggtttaagatagtattagtcaccttagaggagatgttggtccaccagttcgatgcacattggtggtgttcagaggaggataatgagctgggtgctgctttaagcccagggggtgaggaagtttacaggagaggatcaaagattgagccttgacttaagaagttggggagatgaggaggaagtaacaaaggagactgtttgcattgtttctcacatgttaactcatttagtcttgaagatgttgttattattaccatcttacaagggaggaaactgaagcacagagaggttgacttaagcttcctgaggccacacagcaagtacatggcaagactggggtttgaaacaggcagcctgtctccacgtaccatccacttatcctctctgctattggtagacctattattattacagatgggggaaacttcgtcctggggatgaagcgatttgcccaaggtcatagagtaagtggcggagctgagatctgaattcaggactctctgcttcaagaactcaagctcctaatcacgcaagcattctctacaacaggaaagttgtttgttccttaaaagatgggagcaaaagcctccctctctctctctcaaatctcagccatcagcagcatcctgtccctcttagcacaggtcttttctaaaatatcactggatagagaatgagctgccagccagccttgggtcccacatcagggtcttggttctcctccccatgtcagtaagcccatgtgcccaggagaaaggaagatgtcatgcacactcctgtctttgagaagttgggtcttcaggctagcaggattctgactggggtctgtgagactgggaggaagccatttcccttcagcctcaagtctcccttcagggaaatgaaggcattggtgagagccctggttgcattgtgcagcccccacctggcacaggttttacacacagaggtcacattccaccaccacctatgcattcagacactggggaagacctggcctgtggacccccaaaatcccccctgggtgtctgacgccaccctcggttaagaagccctgggtaagatgacctttaaaataactatgcattttgaaataatttcaaatatacatagaaattacaataatagtgcaaacaattcttgcatatccgattaacatcttactacatttgtacccacactctctctctaaatatatcttatgatatatataatttatacatataattgtatgtaaaacttctttctaaatcatttgagagttagttccagacatgatgcccctgtatcccttgacactccagtgtgtatttcctcagaacaaggacatgatacagtataggaaatgaacattgatagaatgctgtgattaaacctacagctctttcagcaattttcccagtaatattgtttagagcaaaaaaaaaaaaaaattggctgtgatctttgtctaatccaagatgacatattgtgtttaatatcagtcatttttcctgggtctttgaatgatccctatttctgtcctttgctcatgctgccactttttggctgtgtattcctgggtgagttacttaaccacactgtgcttcagtctccatgtttgctaattagagaaggtaagagtgcctcagcagccatgaagagtaaatgttagtaagtgcaatggacttagaacagtgcctagatttaagagaagtctttatatagtctggtgattaattctttgctacacagcaggctccccttatccactgttttgctttccatggttttagttacccacggtcaactacagtccaaaaatgtcaaatgaaaaattccagaaataaacaatttatacattttaaattgtatggcattccaagcagtatgatgaaatctcatgctgtctctcccgggacatgaatcatccctttgtccagcgtttctaggctgtatcctctacctgcgcgtcactgcccagcccagagtcactgagcagacatctctgttacaggatcacaaacagatgtagggctttttaccacccacggtttcaggcatccactagggaatcttggaatggatccctcagggttgggggggtgggcgactgtgcatgttgcaagtagcttctcacttgtctttatttgttcatgatttcttttgtcgcttagaagtttgaaattttgatgtagtttaaaatttgcatctcagatttcaatcaccttggaatgtgttttccaagaatagtgcaaggcagatatctaaggtcaatttttcaatggctgggtggttgtctcaataccatgtatttattgatgagtctctccctcaattcaaaacacaatccttacctatatgaggttcccatttgtacattaatttgcttgtgggtgcagttttatcagttgatctgctcttttattcctgtactggttcaacagcttttttgtctctagctttttttttttttttaattaatttatttattttgagttggagtctcgctctgttgcccaggctggagtgcggtggcgcgatctctgcttactgcaagctctgcctcccgagttcatgccattctcctgcctcagcctcccaagtagctgggactacaggtgcctgcaaccacgcctggctaatttttttgtattttttagtagagacggggtttcaccgtgttagccaggatggtcttgatctcctgaactcgtgatccaccctcctcagcctcccaaagtgctgggattacaggcatgagccaccgcacccagcccgggctctagctttatgagatactttgatatctggtagggctggtctcttggaggagttttaggcaccactgaaatgggggcctggtctagctttagcacctccagcctcccacactctgagcttcttgcttctctctcctcctcctccaatgctcagtaccctggggtctccccaatctttcccaatctctgctcataaaacactggccgggtgtggtggctcccacctgtaatcctagcacttgggaggccaaggcaggtggatcacctgagctcaggagtttgagaccatccagggcaacatggtgaaaccctgtctctactaaaaatacaaaaaaattaaccgggtgtggtggagaacgcctgtagtcccagctacttgggaggctgaggcaggagaattgcttgagccccagaggggaaggttgcagtgagccaagattgtgccactgcactccagcttgggccagagtgagactccgtctcaaaaacaagacaaacaaacaataaaacactcttcatcctgggatgtaaagacaaatagcttattttcattgttttttattgtgaaatacttaagatggactgataacagagaataataaaatgcacatctattttgagtggagaacaaacacctgtactctcatgtttattaagtcttaaccctgtgtcatgtttgttccaggtttttaaattaagacacgaattttaatagctgtggttgaggcctttaaaccactcttgtgaatttgatgctcatcgttcccatatctaacaaacttcccacgtttcccgcctttctgtttgatgaccttttcaagtaagacaccacctttacccccaagagaacttaaaggttcaggaggctcaaagctgtaagcctgtttgccttgaaagggaaatgtgtgggatttcaagccctggcccggactgaggagcgggtctggagaggtggacccttcttcattcttgactcatctcctatagatcaggacaggttctggggaggtccatttctggagattttctaggcggtgtctcagagaaggcaaacgggaggcaggaggtggtggtgcctgtgccacaagaagctggtgttgagagcagaatcccagcagggatggggaggaacttcggaatagggaagggagggctaccagagggcctttagggccagggaagaagcgtgtctctgatggaggggattcaggcagtagccctggacaggttgcctctggggctactgctgggctggggtttgagatggagccccacaagcccagtgggtagagcttgctgtgctaagtgtgatcattcacacttcactcctccccatttacacagtcacacgcagggccacagtccctcctcctgctgggggttgtgcccgcctccggctttgttgggtctctggaatgaggctctgtggactccaccatcttgctggctttcttgtgcacagatcacccgctttgcctgctgctcatctgttccacactctgagatccactgcttcatttccatctctaccaccactgctaatgaaccccaatgtgggaccctccttccccacttcccccctgggccagttcagcctcccctaacagaagccttcaacccctgcatatggaggaagtgtctctgagttctttagcctgacagccgccatctgccctaagctggccacgttctactgagcctgttgcccctcttgggcacctcactcttctctgggaaccctgggttgcctgcttttcctcccttacagcccctgccgagagcacactcttcttcatctcagccgtgccgtccccacccccctctcattgctgttatttgacatgtcatctgacctctcctgtgtggggacactctttgttgagggccccacacagaaggcactcaggaagtgacttttggttggcaaatgtacagttatggatggccttggacaaggcagagcagtctcgttggagcttggaaagctcaccaaggagggtagggttgcatacggatgtgcacgaagcctcagggtctgatttgtgcgtgcccatcaggaggccccatcctgccaaggcccgtgctgaccctggagaaggtgtgtcccccgtgagtcaccgtgccgtggaatatcacaccagcactacgcagctggggttaaaatgttcaggatgcctggaaggggagaagcctttttctgagaggtcacctaggatgggatgaggagtgcaagcatggcctcatgttccctccagccagtgggcactgtgtgccttggatgtctcccacctgtcagccaggctccaaccagggaagcagaaactactccaatatataaagcagagggattatagttacagtactttaaacattatacatacgtatgtatatacatatacatatgtttatgtgtatctgtatacattattctaaaaatgtggactggacatggtggcttatgcctgtatcccagcactgtgggaagccaaggtgggtggatcacctgaggtcaggagtttgaaaccaggctggccaacatggtgaaaccccatctctactaaaaatacaacaattagttgggcgtggtggcgggcacctgtaatcccagctactcaggaggctgaggcaagagaatcgcttgaacctgggaggtggaggttgcagggaaccaagattgcgccactgcactccagcctgggcgacagaatgagcctccatctcaataaataaataaataaataaataaataaataaataaatgtacatatatacttatagttatgtatgcatgtattttacgtatgtatgaatacatacatattagtttttgttttggaattattttagacttatagccaaggtgcagaatggaacagggtgttcccaaacacttgtcactcaccttgccgtaatatgaacaccttacataactatagaaccattatcagaagcaggaaattaacattggtacaatgctcttaactagaggctttattcagatttcaccagttgttccacgaacgtccttttcctgttccaggatccaaatttgcatgtaattgccacatctcctctttcccttccaatctgatattttgtcttctcttttcttttacaaccttgacacttttgaagagttctggtcaatgcttctgtagaaagctcattaatttgggtggcgtgatgttttctcatgattatgtcgagagggtgcattttgtcaagaataccccagaagtgatgtgcccgtctcgatgcaccacactggggagtccatgatgcagatatgttttgttactggtgatattaaccttgatcacttggctaaagtggcatctgatggtttctcatttttctctccccactgacagccacaattaataaatatcttgggggaaatactttgagactgcaatgatccaagcagagggaatttaatacaaagaattgattactcctacctgagaagctccacagcccagaaaatggcaacctcaggtagctagtaccaactcttgacctgaggctcaaagaaagaaggtgttgccagagtccagggttcccggtcatgcatagaagcctgtctggtgaggctggagccaggaaggagacccaggcactgctggtaatgctgcctgaggcatagagagatgggagaaatgccctcttcctgtctcccattggccaagcccagccagaagccagctgacgtgggagcctgggaattgtggtccgcaggggtcagcccctctgcagtatagtggggatgggcaaggagtgcctctgacaccgttgccacttctctagggctccactgacccttatggtagccacaggccacgcatggctcttgaaatgtggctcatccaaactgaggtgtgctctaagtggatttctaacacggaatggaaagaagaatgtaaaatatctcattaacaacttttcatattgattacctgttgaagtgataatattttgatgtattagattaaatataatatattatttcatttaattttacctgtttcttttaaaaatttggctactagaaaatttaaaattccgcctgtggtttctgtgtgtggctctcattttgtttcagttggatagtgctgctctagggtacacttctacccagcctatgtcaacaacattgtaagaataacatccatcctggacaaaggtcatacccttgagccatgctcaggagggcatgtccagccaaggttttagaaagccaggactgcactggcacacactcacagctctgaccatgtcatcaaacatacagagactgggcttccctctgctttttcttttttttctttttctttttctttttctttctttttttttttttttttttgaggctcactctgtcacccaagagcattgtgcattggcacgaccacagctcactgcaaccttaaattcctgggcttaagcaatcctccagcctcagcctcccaagtagctaggacagcaggtgcatgccaccatagctggctagtttttgcttttgttttagtagggacaaggtgtctctatgttgcccaggctggtctcagactcctgggttcaagtgatctcctgtcttggcctcccaaagtgctggattataggtgtgagctgcctggccctcctctgctctttatgtatcatgcagggtgtaggttaaggtcaatattcaacaacttcagctccggaggctacctaatgtttaatacaatagtaaaaacactatcatatacctggatagcatttgacaggaagggctatatgactgctactgcattgtatctatacagtgtttttatagctcacaaaggtctttcatcccagcctcccagccagtcacccagcatggctctcctcattttatagatgacagaatgaagcctgagagatcacatggatttctgtggctcccagactcccaatgcatcccttggggagctcgtcaaaatgctgatcctctggccctggcctcacagagtctaattcagtgggtaaagcctggggcccagggacctccatgttgcagactctggggactctcgtgcagatggttgtcagaccacactttgggacacagcagccctctgagttctcaggggatgtgagtggcagggcttgtctgagccatgcttctaatagccaggttgggctctttcctggtgccaaacccatcatcttttggagctaggcttctaggaagaccaatacatacctgcctcactgccatctctggccacacccgtgatgtaatagagggttagtgtggctgaagccaggtcaggcggtcaaacatggtgctggttgtaccaaactcagaataagttttgtcatatctggctgactttgggatatagccagtctttgtcactgtgctgggctcaggtgaagggaagtgagtttgcctcccccaagcggacaccaaagcttcatcttgatgtggagcttgatgatgccaaattgggtctgatggttgagaaagatttgcattgaaatggccaaataggattccacagtcatgctaatggggaaggccagggcacaactcctgcagcctggcagagtgagcatgggcctggctgtcctgccgtcactgatcgctcctttctgttctgcagtggacagcggactgcagcgaaccgctggacagcagctgttccttctcccgagggcgagcccccccacagcaggtagggaaccagctctgcgctctgtctgggggtgtcctatgtcttgtctgcctgggttcctgggccggcccacagtggctcctgaggagtggtgacatggagagtgcagagaggtgggagaggggagggggcatctgttccctggaaagccctccctaactccctgcccacagggaagctcccactcccccaaactcatcgattgatgagatttctttttagtagctgcgttctatatattaacacatatctggaagcagcccagatgttcactgaggggaatggagaggtgccttgggatccatccttacagtggaatattacacggctctcaaatgactgcactgagggttcaggtaccgacattgcagccccacaaacaatgggactcggcattttgatgctggtgggtgctttggatatcacttctgctccagatctgcagaaggcctgggaggggcagcctgtgggggagctgtcagagacctgtccatccccccagccaaccaacagtcctgggaccccgccagagcctgccacctttctccctgctgcttgcggtgaggtcctgagaggcttgtgggtgggttgcatggctgggagggaagggaggcagctgctgctctttgagagctgccctggtgaccccctggccctccaccaaaccctatggtggtccagctgttctcactgatacctcatccctgcctgcaggagcctgtgggattagaggctgaaaaaaacatgtgtccccatcccgagtccagcctccgactatgcctgtctggaaagcggagggagcccctgcaggctcctgcgaggggccatgcctggtttcagagccgctgcagtcatgggttgccctgggcctgcttgctcatgttcagcttcagtccacttaatcatgttcagcttcggtctcctggcagattcacccaactcctctattctgtcccgagagaagctggtcagtggccttggttctagatctttcttaggctgtagggcgtggctgccccatggtgtggagggacggctgcccaggatggttctttcacgtgacaaaatgtgcttgtacgtcttgtttcttaagaaggaggccataataagagccccgggggtggggggtgatgggagacctggagtctcgtttttgttctgccgcaaacttggtggcaaactcttccttcttgggtctcagcttcctcacataaaacccagaaggagcctcgacggcctctgagggtccttctaacatctccgtgccatttgcagatgaggaaactgagtcccacggaggtgccacttgtctgccctcctccccatacggcactgctaccttgcccaactgcaggaggtggccttctagggggtgcctctgtctctgctgcctccctgcctgggaccccatgttatgctccctgaccccctagcttttggtctaggccctgctcctcaggggcactgtctctagctcctgccagttattctggggtctcctaaaaggagattcccctcactcttcagcagcaatggtgaacttggatttggggactcaagcaccagagagaggctttcaggaagtgcttgaagctcttggatgggaaataagaggtttgtcactgagagctctctgctgtttggtcagcaggtgtctggttctggaatgttccaatgaagagtcctttttcctctcctctttaccatctttctgggggcttgtctgctgtctttcccctctggtccccttctccacatcactcctgatagggtctccaggggttcaggaagtgttctaccccctttctcccctcatctgcctcacctcccgcacccagctgtcctctcgggtctgccttccccacctgcaggaggtcatgtaggggttcgccagataatatgggcccatggagcagggctgggggcttgtggagtggggttaggtatgggcttgtccctgctccaggcaccctaacaccgcaaggagcagctcaccccaatctcaccttcaagaagcagctgagcagttgactcggggtacgcagtgtttgacaaaacgaaatataactcaacttaaaagtgaagttgtgaaaagctcatattaaatcctttcttgacaggtggaactgagacgtagcttcattacaggggaggagcccaaggagggtggaggacagggtctctgcatagaaccccacctaatcacctgacatgcccagaggcaaggttttgtgggagggacctcctacaggccttaggggcactggcattcccatcacccctgacctgcggtggccgactgatcatctcagagggaagagggagagatgtctacttccgagaagtggaagaggggctgggccactgagggacaccccctgccacagacatgtgtgcctggtgccgtgttggtcttgggtgcagagtctgcgacgcccatgcctggagagccggctgggacggaagggaaggctcagtcagaatgctgggtttgcctgagtctggcgtgggatgcaccacctgtgctgtatgaaattgcttacagccacggaaacctctgaaggttggagagggtctttcaggagcgatttcttagaggtttgtcaaccaggagtgtttgcagggacctggtgctgagctcccggtgggcttgaagccagggacctgccttcaagggcgtcactgctaagtgggaaggacaagacacaggtgtaaaaaaatgcaccctgcacggcatgagatggggcccagggggcagcctggagttcagaaacctgggcaggtgcacagaggaggtgagggggagttgcacctcctggatggatggccaaggttcagacctgggtgctgcagggggaggcaggagcatctgtgggcctgaatttacacgaggtctcctgtggttggcagcaccttggttcagtgatgacaggctttatttttagacatcagagactgaatttattaggtacaaacaacagggtggcataaacaagaggaatctttatttttctcttgccaccagcctggatgggcgtttggggctggtgtggtagcccaacagtgtgggggccggatccttgcttctcactgctctaccctctctagagtgttgcccttggccacgtggcccatggtggctcatacccacgtccatgcatctgcccgtggggacacccacctgggtttccttcccaggaaactctgatttctgcccacgaagcagccatctcctgttgccccctactggagggatcaaagctgggcggcttcctttgagtgacggcaccccaaggaaagccccatgtagctggcctgtggcagtgtccttgtcacccctgtcatgcaggggctctctgatggaggaggacccaggcagctgcccactgaagggtgcctttgctgagtgccactctgatgggatgctgctgttcccttcatccttcaaggctcccttcagcctggcccaccagaggcaagagcacaggaccagctctcggggacaccacccatgagcaccccggctggctccttgctgcactcacgcgcccaggcagacaccctcacactgactcatgctgttgccaagctgttccgcgcacacctgcctgtgcctcagccagctggtcaaccctaagacgggagtcagggcgggctctacttcctcaaccacttctggcctagggccttgtactcagtaggcactcaatagtgatgcctgagactgcactgagttggcccaggctcagtctgtgcagtcattccctagtgggcccttttcctcctgccacaccaactttgatgagctttctggggccatcaggatgatgggagaacactgctaacccattttcacccgtggggacaattagtttcagggagaaactgaggctacatggagatgcggtggctggctgctctggtgctcctcttgactgcccacgttggctgcacatgtccaggaaggtagagttggcaggaagatgcagaggtcctgcattctgccaagcaacctctgggtggtgggtcacagaccatgccctgcaccagggcccagggcccagatgtggccccatttgcagattagtcatacactgggatgattgattcatccccagcaggcttccagcctcatcctgtttgttattttagctaatgtcaaaaagaaaaccttgctttttctgaaccctttcagaggcagaaagtgggggcaacctagaagagattgggtcccacgagagaggaggaagagagcccagagagtgtagagcataaaaagggctacagatagttcagaagaggctgaccagctgccggcaactgggattcagctgtatttgggattgcctgacatcctggcatcctcttcccaaaagactcacccatcacctagtcatttagttaggacgtcagacgtttccagctttttattgtaatgggggaaatgtatagggattgttgaaatgagagactgcagcagcagtacattcagaaagcttttcaaggtgttggcatgggatttagaattcaggaaagaaaccaaatgcatgggaaaggttgtatggggtcaggagtgagcagctgttttccatctgcacaggtgtgccaagaacaggaaattaatatgcaccacaacagcacagcctctgattagacttgggaaggacttcccttgacggaaggacttgttggcccaccgtgttggctgttaagcaaggtgatgaaatctttgctaggaacctgatgagcacgactgcctatcaggcaggttcacctgaagccctgggaaagatgggggtgtgtcacaaatgatgactttgagttttgactgagggcctatgatcccaacattccctggaataagtgaagggcactctcttgtttcatcctgacgccctgtagcaaacagaagcataaagagagtcaaagagccttgtcccaagctccaggagaaccagatgttgacccaggagtgacactggctccaagcacctattcagaaaaacaactacacagactccttagagtctctccagaaatctctgtttgcattctgtaactccgtgaaacacccaactggatccaaatcactgccacagcaggtctgggtcttcctaatttctctactgttccccatcccctgatacctttgccaaccttcaggccagctatatgggcaccaacattgactccgacccaggggataacagatggtaggtggaggagaccctcaaatacactaattacctctggccccagaaaaagatggaaggagttttctgcaagtcaacttgctacccttcagtaattataggatttggttctgtgctaatttaaaaaataattagtgcaaatgatatcttagtaaaagtgcctacattttttagcacttccttggatacgtaagaaataccaggtatatgttcatagtgctgctctctgtttagttcgtatttattgagtccctgctgtgagcccagcagatgcgtctgagtgggagcttctggatcactgccagtttgtagggtaaaaactagtttacacagaacaagatgacaacatacacgtaagatccccaaagagatgtcatcctggccacaagaactgtggtgattccaaagagtggttcagttggtctctgtgggtagggaggtgtcttgcaggacatgaggcctgacctatgcctttgggaatgggtaggatgtttgactagatggaagggaagagagaagaagatgaagagagaagacatgatgttagcaaaggttgagtagggcacagtgttgggatgttagagtaatagttaggaggcagcacagctagaggaggatcatattgggtgttactcaagtggggggctgagaatggtgaatgcagaggggtctgtgtgtgggctcagatgttggaacctctgtccaacccagcccctgttgtgtgccttgaacttttttcttgtatctttctctggtgttccatacaggcaaagtctgttcccctgtatcagtcaggatagcctagataatgctgcagtaacaaacaagcccaaatctcagtaacattaacattaaacaaccaacaaccaaacaatccaaatcttagtaacattaaacaaccagggcacagcttggtggggcagttccgttttaaccagttgccatgacagagaaaaaggagctctggaggatcatgcattggcagttcagtgctccagcctagatacaacacttgtcacttccgctctgagcttgttacccagaacgggtcatgtggcctcatccaaccataagcacattaagaagtacaacgctactctgtgcctggaatgaggggaaccagaattatttggtgactggctggaatgactgtcacatgccctatctctagtagcagcttcccggaggctggggctgaacttttctttccctcttcttcttcaccacctcaaatccttgatggaactcaaggattaaacttgtgggggcctagggtaacgcttagctctctgaagatttgctgaaaaatcaacttgtaaaaggcagattaataagagaaaaggcatacacatttatttaacatgtatacatgggaggctgcagaatgaagacccaaagatacagggaaaattatctatttttatggttaagttcaacaaagtatggacagttgtagaaatgggattggaccaaaagggcatgatctaatgctaatagacaaaatggggaaacacagcaaggcctgtctgtctagactctccctggcctgtctgtgcagcattccttccttctgagttggggcaggaccctctctggaatgggggtgtcatgacctataatcaaacaaagcagatcagataatttatttatggccagtttttaaaaagaaaggcagagggagaattagagctctatctttaggtttcatggctggctttgggagaaagaggctgtggtttctcgtggtggggaagagggagtctaacttctatggctagcttcaggggagagtgagactgacaggcaggagggcagaaagtcagagaaagacttttgcttctgaggctgctgctgaggccttcattttgggatattgttttctgagccccaacaaactcccatgcactggagtttaaggcctccagtgaattctgaaacatcatgggctctcagatggcaggaagctcagaggtcacctgatccaagtccccaccatgttagcaaaggttgatttccagtagcagggagcatttccagcagcagggagctcactgcttcagaaggcatctcagcatattgttaggcagctccattaataaaaaagttctttctttgattcagccgcaagcccccttctcattgctccagctgacggtttttatttaactcttttgcttgtgtcttttgcctacttactttcctcagcagccgagcacggcaagtctttttaagctaaatatcctctttcctgcatgaggaattgcctttgctgtggttgggtcattcctttgtttatttatttgttctttcacctattgatcggctccaatcagccagtcatcactgagggctgctgtactccaggttgggcactgggcactgggatggtgaggaacatagccatggtggctgtttgcatggagggtagagtggagagaacagatgctgaagctgcagtgagaagatgtctgggacatgacacagtggtccttcgggcctgggtcacatgcccaggagcactagaagtgtgcgctgtgattccccttaacattcctcccagaaacaaacatggcacaacctctgtgctcaccagcgtgtatgtctgtctttcagaaaatgccatctgtcctcatcctcaaagtgccttctggctccagctcacttggaggaacaggatgccacacttactaaacaatgctgacaactagctcctatagggagaaccatcagcagccatgcattgggtgcttgctgtatacattctgagccacatggcctggtctctgcactcagggaagctggaatctgcttagggaaataagctattctggaggagatggcagcatgtgagtatggggaggagtaggctggtgtccgcacagggccttgcattgtagcaggagaggtgagacatacaggcaaagtgggagccgccatgatgtcgcggaagcagcattgcacctgggtttaggagatgtgctttcagcctgggctgtgcttccaacttactattggatccaaacttactattggatcgtggataagatacattatctcactgcagcctcagtttctgctctataaaatgaggaggtgaactagatgtaaggccatcaaaatgtcttgttgaaaatatagacctaaacttctgcttctggaaaatgcaatagatgttcttatctatatttctcctgctaaatacaactaaaaacccaagacattctgtataaaatgaacgtaagaagactcggagaggtggagggaagaaggcagacctgctagggtgcccagaacctgaggaacgacacagcgaggagcttgttttctttttgcctcatgtgtcccatacttggcactaggaaatgctaatggacacaggcaaaaaaaaaaaaaaatcccaataaaaagctgctctctacaggaaacggactaagaaaagagaaaaagataggatagagaagaaggaaaatgataggaaaagatctagcaaaacaaaaaacttttcgactgtcactgctgtaccccagccaaacaccacagaacacatccccacccccatccatcccagccaagaccaagtgggagctcagatcccacccctgctgggctatcagaggggctccaaccccctaccagagtagtgtcagagaaggccagtggggagctgtgactttcgtccccgccaactggtgagaaggctcctacccacgccccatggtgtcactggagacagcaggaacctgacttgcacccccactgggcagtatcgaggtgtccctctccttcctgctggggtggtgtcagaaatagtgagtcagacttcatagactcccagggatgatgaggccagccccactgcatgtcagaggggaccacatggggatccggaactcccacctccacccagcggtgacagcaagcacccctgcggcgtcggaggaggttgagtgggcaacctggacttccacttccacctggcaataatgaggctgtcccctgcccttttcccctgccagagtggtaccatgaaacacgagttaaagcaggaggtttaaatatgactctctcatgagctaacatgaaaatgtcctggtttcaattaaaaattgtttgtcatatcacaaacaaactgaaataatcaatggatgttaacactgagatgctaaattggactttatcatcattaaatttttgctctgggaaggaccctattaagaggatgaagagacaagttacagagagggagaaaatatttgcaaaacatatctgacaaacggctcgtatttagaatatataaagaactctcaaaactcatcattaaaaaacaatccaattagaaaatggacaaaataaagtgacatttttcactgaagacgtttttccctgaaggtgatgtacagatggcagataagcacacaaaaaatatgcaacatcattagccatgacggagacgcaaataaaaccccaacaagacatcactatactccaatcagaatggttaaaataattttttttaaagtgacaatgtccacttcaacttggcagcattaaaaaaaaaaaagtgacggccaagagcggtggctcatgcctgtaatcttaacactctgggaggccgaggcgggtggattgcctaaggccaggagttcgagaccagcctgggcaacatggtgaaacaccgtctcaacaaaaaatacaagcattagctgggcatagtggcacatacctgtggttccagctgctcggaaggctgaggtaggaggatcacttgagcctgggaggtggaggttgcggtgagctgtgatcaaaccactgtacttcagcctgggtaacagcgagaccctgtctcaaaaaaaaaaaagaaaataaaataaaaacaaaaaggaaagaaaaactaaatgacagcgtccaatgctggtgagaatgcagagaaactggatcactcctgcagtaggagtagggatgtagaatggtatagccattctggaaaacagtttggcagtttcaaaaaaaaaaaaaaaaaaaaaaaacgaaacctgcaagtaccatatgatttgattgagcaattgcactcctgggtgtttatcccagagcaatgaaaacttatgttcacacaaaaacttgtactcaactgtttgtagcagctttgttcacaatacacagaaacctggaagcagctcaggtgatcttcagcagatgaatggttaaacactcagcaatgagaaggaatgaatgcctgatgatgcagcagcctggaggagtctctggaaatcatgctgagtgattttcaaaaagccagtcctccaaagtcgcatactctgcaattccatttatataacattcttgagagggcaaagtaatagaaacggggaagaggtttgtggttgccaggatgagggaaggggtaggggcaggaggaaagtggatgtggctataaggggcagccttgtgatggtgggagtgttctgtgtctccactgtatcaatgttgatacccggagatgctgagttggacttcatcataattaaacttttgctctgggaaggatcgtattaagaggatgaagagacaagttacattgtggcattgaactatactttccccatggagggaaactgcgtatagggcacaagaggtctctttgtattattttttacaagtatgtatgaatctacaaccacctaaaaataaaaagtgtaatttgtaaaaagtataaaaagtgtaatttacaaaatacaaaaagtaatttgtaaaaagtatttctatttcctcagaaccttacatggagattccacatagaaacaggaaagggatagaactgtttttagggggcaaggggaggagccctgcctgctttctcccccacccgcccacctcatggctcttagaacatctctgcaggactcctaggtcaccccccagaccagatgagctctcagcctctcctgtcatgaccttctgtagttctgagtctggtactggcagaaaaggacagaactttggggcctggggagttcaaagaaggcctccctgtgaggcaaccttggaggatgggatggtgttggaatggggggtgttgattttccccatctcctggaagcctttccctggcaggagctggggacagttgaggaggatcccattatttcagcaggttttggacaggcagccagacagaaatggcctctggtgtggccctgtccaggacaggctcaaatagcatggtccatttaaaacctaaatcacaaccttaattagctgagagtgggcagagggttggcctaggagaaatatacttggccacaggcattatcattgtctcctatctctctctggcctttgggtcttaattcaaagaaaaagggagcatgggggaaaagacaggatggacagacagacacagatgtcccagcatgaaaggaatggcctttccctctcccagactcagctttagtgccacccagaaagctgtctctgctgggctctgccctgctgttctcctgcttcaaaggccccttgggggtctatttccccctttcccagctgtgtctggggtgccgtccttcgttctgaacacacacacacacacacacgcacacacacacacaaacacacacatggtgttgccatgataggcctgtttctctttgggttctgccccctgacacctccccctgtgctttccccctcagttgctctctgagaagattcaaccattctcaaagtctgctttagtttgggcctgagaggagtttcagatctggcccataggaagcctctgttttggcccaggagatgagtctggggtcctctggtccagaacatttcatgtaatgtaaaagccctcatagtgtctctcatatattccaatatagagtcaccaatgtagtccatgtagtcgtgggaccagtgaggaaacacaggtccaaaaagccagagtgaggctgggcgtggtggctcacgcctgtgatcccagcactttgggaggctgaggcgggtggatcacctgaggtcaggagttcaagaccagcctggccaacatggtgaaaccctgtctctactaaaaatacaaaaattgctcatggacccattccaagatggccaaataggaacagctctggtctgcagctcccagcatgattgatgcagaagacaggtgacttctgcatttccaactgaggcacctggttcatctcactgggactggttggacagtggacgcagcccacagaaggcaagctgaagctgggtggggcattgcgtcacccgagaagcacaaggggtcaggggatttccctttcctagctaagggaagccatgacagatggtacctggaaaaatgggacactcccacccaaatactgcacttttccaatagtcttagcaaatggcacaccagattatatcctgcagctggctcagcgggtcccatgcccatagagccttactcactgctagcgcagcagtctaacattgacctgtgaggcagcagcctggagggggaggggcgtctgccattgctgacgcttgagtaggtaaacagagcagctggggaagctcgaactgggcagagccaaccatagctcagcaaggcctgttgcctctgtagactccacctctgggggcagcgcatagctgaacaaaaggcagcagaaacttctgcagacttaaacatccctgtctgacagctctgaagagagcagtggttctcccagcatggtgtttgagctcggagaatggacagactgcctcctcaagtgggtccctgacccttgtatagcctaactgggaaacacctcccagtaggggccgactgacacctcatacaggcaggtgcacctctgggacaaagcttccagaggaatgatcaggcagcagtatttgctgttctgcaatatttgctgttctgcagtgtccactagtgatacccaggcaaacagggtctggagtggacgtccagcaaactccaacagacctgcacctgagggacctgactgttagaaggaaaactaacacacagaaaggaatagcatcaacatcaacaaaaaggacatccacaccaaagccccatctgtaggtcaccaacgtcaaagaccaaagttagataaaaccacaaagatagggagaaaccagagcagaaaagctgaaaattctaaaaacaagagcgcctcttctcctccaaaggattgcagctcctcgccagcaatggaacaaagctggatggagaatgactttgatgagctgacagaagtaggcttcagaaggtcggtaataacaaacttctcctagctaaaggaggatgtttgaacccatcataaggaagctaaaacccttgaaaaaagattagacaaatggctaactagaataaagagtgtggagaagaccttaaatgacctgatggagctgaaaaccatggcatgagaactcgtgacgcatgcacaagctttaatagtcaatttgatcaagtgtaacaaaggatatcagtgattgaagatcaaatcaatgaaataaagtgagaagagaagtttagagaaaaaagaataaaaagaaacaaacaaagcctccaagaaatataggactatgtgaaaagaccaaatctatgtttgattggtgtacctgaaagcaaaagggagaaccaagttggaaaacactcttcaggatattatccaggagaacttccccaacctagcaaggcaggccaacattcaaattcaggaaatacagagaacaccataaagatactccttgagaagagcaaccctaagacacaaaattgtcagattcaccaaggttgaaacgaaggaaaaaatgttaagggcagccatagagaaaggtcgggttacccacgaaagaaagcccatcagactaacagcagatctcttggcagaaactctacaagccagaagagagtggaggccaatattcaacattcttaaagaaaagaattttcaaaaaaaaaagagaattttcaaccgagaatttcacatccagccaaactaagcttcacaagagaaggagaaataaaacccttcacagacaagcaaatgctgagagattttgtcaccaccaggcctgccttacaggagctcctgaaggaagcactaaacgtggaaaggaacacccagtaccagccactgcaaaaacatgccaaattctaaagaccatcgaggctaggaagaaactgcatcaattaacgggcaaaataaccagctaacatcataatgacaggatcaaattcacacataacaatattaaccttgaatgtaaatgagctaaatgccccaattaaaagacacagactggcaaattggataaagagtcaaaacccatcagtgtgctgtattcaggagacccatctcacgtgcagagacacacatatgctcaaaataaagggatggaggaagatctatcaagcaaatggaaaacaaaaaaaggcaggggttgcaatcctagtctctgataaaacagactttaaaccaacaaagatcaaaagagacaaagaaggccattacataacggtaaagagatcaattcaagaagagctagctaacctaaacatgtatggccctaatacaggagcacacagtagactcccacttagactcccacacaataataacgggagactttaacaccgcactgtcaatattagacagatcaacgagacagaaggttaacaaggatatccaggacttgagcttagctctgcaccaagcagacctaatagacatctacagaactcgccaccccaagtcaacagaatatacattcttctcagcaccacatcgcacttattccaaaattgaccacttagttggaagtaaagcactcctcagcaaatgtgaaagaacagaaatcacaacaaactgtctctcagaccacagtgcaatcaaattagcactcaggattaagaaactcactcaaaaccacacaactacacagaaactgaacaacctgctcctgaatgactactgggtaaataacaaaatgaaggcagaaataaagatgttctttgaaaccagtgagaacaaagacacaacgtaccagaatccctcggacacatttaaagcagtgtgtagagggaaatttatagcactaaatgcccacaagagaaagcaggaaagatctaaaattgacaaagatctaaaatcgacaccctaacatcacaattaaaagaactagagaagcaagagcaaacacattcaaaagctagcagaaggcaagaaataactaagatcagagcagaactgaaggagatagagacgcaaaaaacccttcaaaaaatcaatgaatccaggagctggttttttgaaaagatcaacaaaattgatagactgctagcaagactaataaagaagaaaagagagaagaatcaaatagatgcaataaaaaatgataaaggggatatcaccactgatcccacagaaatacaaactaccatcagagaataccataaacacctctacacaaataaactagaaaatctagaagaaatggataaattcctggacacatacaccctcccaagactaaaccaggaagaagctgaatctctgaatagaccaataacaggctctcaaattgaggcaataatgaatagcctaccaaccaaaaaaagtccagggccagacagattcacagctgaattctaccagaggtacaaagaggagctggtaccattccttctgaaactattccaatcgaaaaacagggaatcctctctaactcattttataaggccagcattatcctgataccaaagcccggcagagacacgacaaaaaaagaattttagaccaatatccctgatgaacatcgatgtgaaaatcctcaataaaatactggcaaactgaatccagcagcatatcaaaaagcttatccaccatgatcaagtgggcttcatccctgggatgcaaggctggttcaacatatgcaaatcaataaatgtaatccatcacataaacaaaaccaacgacaaaaaccacatgattatctcaatagatgcagaaaaggcctttgacaaaattcaacagcccttcatgctaaaaattctcaataaactaggtattgatgggatgtatctcaaaataattagagctatctatgacaaacccacagccaatatcatactgaatgggcaaaaactggaagcattccctttgaaaactggcacaagacagggatgccctctctcaccactcctattcaacgtagtattggaagttctggccagggcactcaggcaagagaaagaaataaagggtattcaatgaggaaaagaggaaatcaaattatccctgtttgcagatgacatgattgtatacttagaaaaccccatcgtctcagcccaaaatctccttaagctgataaggaacttcagcaaagtctcaggatacaaaatcaatgtgcaaaaatcacaagcattcctatacaccaataacaaacagagagccaaatcgtgagtgaactcccattcacaattgctacaaagagaataaaatacctaggaatccaacttataaggaatgtgaaggacctcttcaaggagaactacaaaccactactcaatgaaataaaagaggacacaaacaaatggaagaacattctatgctcatggataggaagaatcaatatcatgaaaatagccatactgcccaaggtaatttatagattcaatgccatccccatcaagctaccaatgactttcttcacagaattggaaaaaactactttaaagttcatatggaaccaaaaaagagcccgcattgccaagacaatcctaagcaaaaagaacaaagctggaggcatcacgcgacctgacttcaaactatgctgcaaggctacagtaaccaaaacagcattgcactggtaccaaaacagagagctagaccaatggaacataacagaggcctcagaaataacaccacacatctacaaccatctgatctttgacaaacctgacaaaaacaggaaatggggaaaggattccctatttaataaatggtgctgggaaaactggctagccatatggagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgactaaaacaccaaaagtgatggcaacaaaagctaaaatagacaaatgggatctaactaaactaaagagcttctgcacagcaaaagaaactaccataagagtgaataggcaacctacagaatgggagaaaatttttacaatctacccatctgacaaagggctaatattcagaatctacaaagaacttaaacaaatttacaagaaaaaaaacaaccccatcaaaaaatgggcaaaggatatgaacagacgcttctcaaaagaagatatttatgcagccaaaagacacatgaaaaaatgctcatcatcactggccatcagagaaatgcagatcaaaaccacaatgagataccatctcacaccagttagaatgacaatcattaaaaagtcaggaaataacagatgctggagaggatgtggagaaataggaacacttttacactgttggtgggagcataaactagttcaaccattgtggaagacagtgtggtgattcctcaaggatctagaactagaaataccatttgacccagccatcccattactgggtatatacccaaaggattataaatcatgctactataaagacacatgcacacgtatgtttgttgcggcactattcacaatagcaaagacttggaaccaacccaaatgtctaccagtgatagactggattaagaaaatgtggcacatgtataccatggaatactatgcaaccataaaaaaggatgagttcatgtcctttgcagggacatggattcagctggaaaccatcattctgagcaaactatcacaaggacagaaaaccaaacaccacacgttctcactcataggtgggaactgaacaatgagaacacttggacacagggcggggaacatcacaccccagggcctgtgtggggtggggggcagggggagagatagcattaggataaatacctaacgtaaatgacgagttaatgggtgcagcaaaccaacatggcacatgtatacctatataacaaacctgcgcattgtgcacatgtaccctagaacttaaagtataatttaaaaataataataataataaaaatacaaaaatttgctgggtatggtggcttgcacctgtagtcccagcaactcgggaggttgaggcaagagaatcgcttgaacctgggaggccgaggttgcagtaagctgagatcacaccactgcactccagcctgggccatagagcaagactaaaaaaaaaaaaaaaaaaaaaaagaagaataaaaaaagccggagtgactgaatgaggccgcaggaagcagaaagcaggttgcaggctgagaatcctgttttctccactctcagctcaaaccagaccccctgtcccacagctagctccccagggaaccccgtgtccatgaagtgagagaaccgtattagggtcgggcttgcctcttgccctcatggaatctggaaggacatcctgcactgagaagggtgtggactgggactgggagtcctttggggagtggagactgcaccacctttatctctctcatgcccagagctgggtcctgcacagcccagctgctcagtgactgagggtgcactgtatcagggggtttccattcaggaggccggggctgagggctggccacctctgccccagtgtcacctgatgtagcaggcctgctagggaaatccacaccagcctgccctagaattctctaggggaaacttcccccatgactgtcccaacaatagagagcatcctcccgctgtcctatcccattcagcctagtttctaaacactcacagcctggaattgtcattacacacatgcccccacatatgcacttgcacagcaaaaatcactgcacagttgtgtattcataaagaaaagccagcagctagaagatttgttgttttcactgcatctgactttgtatgtttttctatcatacagcaactcactctcaccttgttgcattcatgcatgtgtggagaccgcagcctcatcgcatacccactcacattccacaatccctctctcttcactgcagatgatgcacttcctccaccagcactgccttcccaatcattaacaaagataggtgtggagaatacagatgcttgcaggggagggatacgttcctgctttatggaaatctctgcagtgggttcagtttacttgactgaatagaataactgcatgcatagtgtacagtggttagagcatggcctctgggccacactgtctgtgctcccatcctggtaactggctccatgaacattggcaggtgctctgtgcctcagtctccccatcagtaaaatggggatggtgatcatactatctgcttcttagggttgtagtaacagtgccacgcttgggcagtgctggcacatactgcatgctgggtcaatatctcctattgtcatcatctttattcttggcccttttaggagtctgacctcccctgagctggggatgtctctgaggccttcccagagacaacttcagtttcccttcccacaagcaagctgtttccatttgattttccacatggcttaaagtgctcattatccctctgtgatctgttctgccagcagtatggtgcaccctggtatggggccccctaattgccaataaaaggggctgtcacgaaggattcagcagtgtttaagtgctaagaacaacccactgaaaaggatgattgtttttgataaggcttctcagaaccttggcatttcagcaaccgggggggcagggcctggatgctgtcagggctggagaggatgctgtgctcagagggaagctgtggttaccagggccaaccatggaattgccaactgcagaatgttctttaagaggccactgaggttttgatgggtagctgacagtgcccagccactgagtctgtgcgaagaaatatttaatgaatgactctgggtcccaaggctaggacgaggggtgaatgggcaggaagatacaacaaggaagtggagccacggttcccaccatcgaaaggggagagagttaacagaaagtgtgttagctgagtatttcccaaagggggttccatggaaccctagtcctgcaaaattctctgtggaatgaaaaggaagagtgaggtagatttctagccaaaaaccttgggaaagaaatattgcatactccacttccacatatgtgaagagttaacatccactgaagaagttctgcaataaaaatttcaacatcgtaacaattttctacattttaataatgtattagcagtcttatcattcagtatataccaaacatttgactatataatctttttgatttttttccctgttaaaacttgaacattttgaggaatgaggaccatttagaggaatgaggctttctgaaagcatcgtctgtgaaccatcccagctacactaaatttaaaccaccaaccctcccttctctcagtgattctgatgcacactgacatttagagccaggggattggtgcttccagagcaccccggggagctctgcagtacaacaatgacgagaggaatcagctctgcacgggagtgtgcagggtacgtgctgtgaacggcatgtgctatgaggttcacagggtgtgggctgctgaggaggctgcagagctgcagagaggaagagtcctcaactagatcctagcaggaaggaagactcatgggagtgggagggtgtggagagaacattcttttgttttcactgagtccaggaagagtatagtagcctaaagtgaaatataactccatacatgctgctgcttcgtgtgcccttgagaggcaagtccaacgcttgcctgggatgagccgagcttgggtccccttcttctctgtcctcagcttgacagccacctctctgtatgggtcctcagtgtgagccagaggtgagggtggtgggagagagaggtgggtctgtttcctggtgagaagttccagaactcaggtacagtctgcctgtgaggggtctgcctgcaggcacctgccttcctgcttctctgacttctctggcttctttggacattcgagggtttgtagaacagctgacacatgtatgtgtatgtgtgtgtggtacatgtatgtttgtgtgtgatgtgtgtgtatgtgtgaggtgtatatgtgtgtgcatggtgtgtatgtgggtgtggatatgtgtgtgtgtgtatatgcctgtgtgcatggtgtgtatatgtgtcttgtatgtatatgtgtgtggtctacatgcatgttgtgtgtggcatgtgcctgtatgtgtggtgtatataatatgcatgtagcatgtgatgtgcacatatagttgtagtatacatgtataccacatgtatatatgtggtgtgtgcacatatgtgtgtttggtgtgtatatgggtgtggtgtggatgtgtgtggatggatgtgtatattgtataagtgtggtatatatatgcatgtatgtgtgtagtatatacatgtatgtgtgtggtgtgtacgtgtgtatatgtacgtgtggcacacattgtgtggatgtgtgtatgcataccatgcatgtgtgtgtatgtatgtgtgtctggtatgtatatgcatgtatggtgtgtattatgtggatgtgtgtggatgtgtctgtctagtatatgcatgtgtgtagtattgtgtatatatgtgtctgtggcatatgtacatgtatgcatatgcggccctgtggcatgtgtacatgtatgcatatgtggcacttgtatggctgtaagcatttgtctggctccagagccacgtggcagggctgggtgacagagtggccacttgggtgctcagcccagggcaagtgggccctggggaaggacatgtgaaaacgttgggctcctggttgtccagtttagcttggcagttaataactctgttgcgtgaggcctggccccctgggcactgcctgggccaccacctcagcatcaagggacagcaaaggaaagctctgcaggtgagactcttcctgctctgggctaaggctggaaggagatggatgtcttctccacgtgctaggctatttctccagcccctgttgatgaaagtttgcctttagtggttatatgcctgtcttgtgccattgaaacaaaccccaaggaggtgtccagattcttgatatgcactgcagttcttatatcaagtagagtggcaataaggagtgcggcccctgtgtccaaggtgttgccctatacctacttctccagagactcagcttctcgtctgccaggccccgagtcttcatggcgatctccttcctgatattcagacagagaggcccgatgccttgcccactgctctcctccatgtgtccagctcagcggctggggtcctcattcttctcagtgctgtcacctccacctgctgcctcctccagggctgctgagcttcacagctccgggggtgctgtccatatgatattcgttcctggagctgcacccccagggctccctggagctgtgcaaagatggggtccggctccttggtttgtaaagggctcaccttgctggcacttttgttcctcagctctgagaatcagagttgcagtcatcacgggggagggaatgaggcaggaggccggtcagtgtgagagttaacaagactcaagccttgtggcaaaggagaggtgagacccggcccaaaggcccaaggtgggcttggggcagagacctgtggggcagagcgagagaggaaggagaagcagcctggtgccgagttttccagcctggggagggagacacaggagtcaggaggctgagccacagggcgggggtggctaaagaaatacggtgtgtactgggaatggcagggatatcgctgggtttcttgtcatttaaatatggatgtaggctcttgatgtcgttcagggatatgttccctgagttgttgtaaggagttgtggggattcaatgaggaaaatgtgtgagtctgtcacctgtgacgtgtgtcgattgtgtgactgccatggctcttggaggagcactggttgccaccgtgactccaccacctgctccccagctgggccatggcctctctccccaggctcctctgggaatggcagggatatcgctaggtttcttggcatttaaatatggatgtaggctcttgatatcgttcagggatatgttccctgagttgttgtaaggagctgtggggattcaatgaggaaaatgtgagagtctgtcacctgtgacgtgtgttggttgcgtgactgccatggctcttggaggagcactggttgccaccgtgactccaccacctgctccccagctgggccatggtccctctccccaggcttctgtttttcacccccaacatggagatggcagcagctgatcacagggctgttctgcagatgcacggaagggtgggcttcctctgtaaagaataaacacatacatgcaggcacagcttctgccctggctctttccctcccatcagctgggagcacatttccctgaccccaagaatctggaagtccagagattggtgggtcccccgccagggatactgctttggaaatgcccaagtttgccctgcccagtcacctcccttagcccaagggtagtgccccctcctccaggcagagaggttccaccagctctctgcacaggggcattggccccctcacagctgctgccagtgactgttactgtgacctgtcctcgctccctgccagttgaggagtagtagccaagatgccaacctgcaggccaggagggagatttatgtgcccatctgcactgcccttcaactgccttcaaggtgaatcaccatcttcctggaagatgctttgcacttctaggtttggccatgaccttctctacatagttgctctctctttctatctctccatccatgtttcttactctctaagggccttacgggcctcggatcctaggacggtaaatcattcttgacatcctaatcttgattcagtctttcagccacagaggcagtagggtcgtgcttcctcctgttacaaagtggcatctcctcaatcagttggcaggaatccaagctggccctcctgtgtgcctggcttggccactgtgggggcacaaagagaaagaggcagtccagtggaaaagattacagtctacttggggaaggtctaacattcatgtaagagagcagtgaccaagaggtgatccactgaagctgaatttataggcgccagagaacattgggtatttaacagatcagggattagggaagacacgtgtggaggagaggcttcaggtcactgggctgaaggaggaaaatgaactgcatgctgagtgaggtctgcaatagatgctttggaagcaagagttttgtttgcatgtatgatttttttttatctttgctttctatgttatttttggctgctatccccaatgataattacattcgaggcccaggaggggggtgtgaacaagccggtcaacatctcgggaggcaggggctgtccccttgggggttgtgtgatagaaggtgagtctctctagctgacctggagtttcagagttgcacttggagcaagcagggccccaggagttggaatggggaggatgtgaggcaactcgaagaaaagggagagaggacgatcctagaacattaggggccacctgcttggaggactggcaaccatgctgtaattgattagtgatatctgccgctggcaggagaggggatggtagcagcacgcatgccagtcagaaggagcccatctacagggcatggtatttcattctgggatctctttatttaaatatgaagaatctgaagtccagactggtgaagtgactttgccgaggtcacacagtttattgacgcaaaaagaaaacgcatgtttaaagaagatggtgaaaatctcttgcagtatatgtcaggagcactgagcttccagctctgggggacccagggggtccctgccatcaagggcccgctatctcctgtgggagagaggtcactacaggaaatagaagtgagaactgcaagaggccggctctgctactgtaagtcacccacacagatagcaagttcagggcagagcgaggtgactgcagtttgggaggccagaggtgcttcctggctgagccaatctttgacagatggggcacattcggagagggcaagaggggagcaaggcccagttgacaggccatggtcaggagcaaaggggattacggggatgggacaggaaaggcatggggagaagcacccagggccatggcggccctgaataaatgtggctgatctgctagaaaggattgtgcaagctctcagggcagcctggaatgaggaagtttcaagttacttagacctgcaggctgttggtgcccagagagagggaccagtgttcatgttatcaatgagacccaggaaggctgagggacttgcccagagtcagacagcccaggtggttctccccagacagtcctcttgtcccttcgactccataagccctccacctctcctccaggctctcattacctcctgcctcctgtctgtggcggctggagtgcctggccccttctgcttggaggctggactgtccagccttcccggtttttgtgccctctccttctagttaatcaaagctgctcgctctctctgtctctctctggaagagagattggtttcctcttccagttactatctgagttctttcactatacattcgttagtttgcctgttcctgaacataattggttctcttttgcatctgggttcttttgttccctgtatgcttgtgatatttattcatattgctgcatgttattttactttgtttgtgctcactgcggtgtgatactccaatatgtgaacataccacggtttatttatcgaatcagctgatgacaggcatgtgggtggtctccagtttggagctgtaatggcggatgctgctgtatacgctttctgtacatgtcttttggtgagcatcgggcacatttctgtgtgtttatacctgggagtgaatttctgggtcatacggcgtgcacacgttcagctcaggtggatgtggaagtattgttttaaagagtgtgacgatggaaaccagattgcaggggtaagaagggctggagggcatcaggtgcggtcaggggttggagaatttgccagggagctcaccagccagagagcagagaaaccaaatcatagaagctgcattgagtaaagaggtttctgtctctggggtgggtcacatagggaacactggaggatcggctcgactcagagaaatccagttgctggtgtagccttggtcggtgggggcttctggggagtaggactgaactgtgaaggaaggcagcctccatgggctccccagtgggcctggctctgcagagcccctccctggggagaagcctcagccatcaggctggcagtggtgatggtggctctgggtggtacagagcccttgctgggtgtggaggctttgaggagagagccatgggcctggggcagcaggggcctggacccttctgtatacatctataaaacctcagtgaaacgagggcctatgcctggggggaggccaggagacccccaggcagtcccctgactctgactgggtgcaccagccaccatactcacttgggggctcactccagccccccagcccctcaggccctggccccgtgttctcagcatcctggccgagcaattaatgtcagccctttcacccccatctcttccagaatggcagcaaagacaactctctggacatgctgggcacggacatctgggcggccaacaccttcgattccttcaggtaacctcctcctccctccttccctgtggtgtgaggtccagccggggaaactggcttccttggggacggaatgaacgctgatggttcatgagcaagaggcagagagaagcagagtaggggatgtaggaaggatggggtggaaagaaggccggagagaggaggcggtgagtgtcaacgggagacagtggaggcatggggagggcccccgggatggggctgcagaggctgggccccgcttcccactagcctgcctcatctacctcagggtggccgggtcgtcactttgagctgcttgtcagaggctggagactggcatttggccccttgctctccctggccttcctcaaatgtgggcacgaaaacaaactcaggtgttgcagaggccgctgtgcaatgggcatcaggcccacacttgtttcataagcatgcactttcccacggcagggtgaggaaggtgaggggtggcacctggggctccattctgagtggggctccccgcctggcccctggcggctcctttctgcggatctgctctgccaggttcagcctggccccctggttccgtcagtaactgggctgttgccctcttgcctccgtttctcaccctccctcgccctctagtggtgccacctgggacctgcagccggaaaagctggacttcacccagttccaccgcaaagtccgacacacgcccaagcagcccctgccacacatcgaccgcgaagggtaaggggtgctggggctcttacccagggtggggtggggcaggggacgggagtggcctttgcctccacagggaggctgctctgctgcacaggggactcaggtggctgatgccccgggatgctcttcttatgcgtcccagagctgcaggctcactggcttctcctggaatccctccatttccctctgcccagccccctctagccatgccatccccacctgctcctgatgacccacagtggccctgcttgtcagtaatccacgccagcgcagcagaatcacctgggcggtggcacagaggacaggcccaccccagagtctgtgattccgtaggtgtggactgaggctgtgtgtttctttcttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcatgagccaccgcgcccggcctgaggctgtgtgtttctaacaagttccccagcgggtgctgatgctggtccagggaccacacttggggagcagctggtgtcatgcctgattttacactggcttttctcaccctctatgactttgtgtggcagggttgccttcccttttcaaaagtggtgtcacagcctgggcagacctcaggacgggaatgtgactccagcgagacacagaggtgtgggacaaatggctgctccttcttttatagttttatataatttttaatgaggcagaattcccataccataaaattaaccattataaagtgttcagtccactggcatttagtatgctagacctgttgtgcaactaccatgtctatctagttctgaaacattctcatcatcccaatataaaaccccatacccactaggcaatcattccccatcccatcaccacccccagtccctggcaaccaccaatctgctttctgtttctattaattaatctattttgcatacttacagaaacagtcatatgtgacctcttgggcctggcttctttcccttggcataatgtttttgaggttcattcattatagcatgtagcagaactttattccttttcatggctgaatactagtccattgtatggatataccacaatttgtttacccatgcatctatcaatccttacttgagtcatctccaccttttggctattgtcaaaaatactgctgtatctttttgagtccttgcttgtaattacttgggtgtatacctggggtggaattgctgggttgtatggtaattctgttgaactctttgaggagctgtcaaactgtgttccatagcagctgaatattctgcattcataccagcaatgtatgagattccaatttctccacatccccaccagcacttgtgtttttttttctttcttggtttttgtttgtttgtgttttattatgatactgatgacccttacttttccttccagccctcccctgctcactcttgtctccctttcacttcaggtctaagtattagtgactttactggacactatcctacatctcacatgtcttcctgctgctatatttgtcccactcaacctctcctcttggcaacattggtcccatcatagtgtaatgagcaacaacccgtggaaagaaatgggctcattcctactttagagatgaggaaaataacactcagagaagcaaagtaacttgcctgaataacagagccatcatttaaggccaggccttctgacaccatccaacccctagttcaccacatcagggtattcttaacctccttaaaattttctgcaaatttgtatgtgtgcatgcacacgtgtgtgttgctggggagaggcccatcacttgcatccgactctcccaggagacaccagcctctcacacgcctctttttcattgccctccctgttgtgggttccatttctctttgggtgaagagggagagatggctttgcgcatggaggcactggttaagatggagcataggagagacacagctgcaaggctcccgaccctaccttaccccatccaccctgctcactgcctgctcagcccactcattcagttgcagggaggccatgctccttccagactgctgagctgcacagggctgggcctccacacttctgtgcttaggaaggatggccttacctacctttctcagtgggtcagcttcaggaaggggttgtgagcaaaggtgatgcttgcccagtgtcctgttgcaacagtgtagcggagcttgggtatgccacaggaataggagcaggattttgcttttctcaagttcagtgtagccagtctgtcactagacctgctgggtccctgcatggtgctgggtaccaggaaagtagacacacacacacacacacacacacacacacacacgagtatacaatacagtccctgcccagaaggactgtttattctactgggaaaaggaaatatgaacctattcatgatggagactgtgtaggggaagaaagactagactatgcggtgtagacatacagactagactatgcagtgtagacatatagacaccataaagacatatatagacaggtataaagtgtgatgcctggtgcagggttaaataaagtcaatgcaaaaggggttagaaaggagagcactttacaggttgaaccatctgggaaaggcttcaggagggagacttccctgggcagctccagtctctcctgtgtgccccgggagcacatagctggtgacgtcagtggggacactgaggcctggggagatcgaagcgatggtgctgccttattgactacaggtgcccaatggggcctgcatgttgaaggcaagcttgccaaagtgtctcaccagtccccagagatgaactaacttcctagcaaaaaagcgatgaataactatgaaggagaggaattccccttatgccgagggactttgtcccttctgaagccagagtaaccagccacacctgtgtcaccagctgtgggcctaaattcctcggccagtctcactttctcaccaggagcctccagatttgctgagagtcacctggggtctcccatggatatctggctcactagccaaagcctgtcactcccaggttcccagggagtctgagtgcagtgtctgtggccacctcatggccagaccaggaactgtgacccccttagagtcctgctgtagtggggacacactccatgcgccagccactgcagccttcctgggatgcaggtaccactcagttgccaaggctccctgcagcctgtgtttccatggagggacagaaatcagagaaggctgttgccttggaaaccctgttggcagcagtgactcagctggtctgtagccaccttcagccctccaaacctgcaggcctctggggagatctgagccctgacgagggcaggcctcgtgggacagcagccctccctgcaggcctccacctgcccacccccaggggcgctgaggcgagaacagaaagctgtgtttggagtgtgctaggctggtgcccagcgtgtgcttggagctcagtgcatgcgagagagtcctgaggtgtgttttacccacaggagacactggggaggtggtatcagccattctagtcaagccaagtccccagtgccctcctcccctatggcccaggcgggtgcagaacacagaagactacacgcagttggtgctttcacaggccagcctgtctgcaccaggcagattgatgagttaagagatgtttggatgttccgggcctttctccacctgctcacctgtagccccagcacatcacagttgtggggacagccgggggccgggggaaactttttcttttccttcatgcctgttataccttgcacaccattccccaccccagctccaccatgccccttgcctaccccttgcaccctgacccctaacatgctctagccacagcaaactggcaccacacatgctcctaactctaggcctttgcctgcgccgtgtcagcctgggacatcctcccaaattccctgtgcttggccagctcacctctcaccttcctcctgcccctcgcccaagacagttctagacgctgctccttggggttcctgcaacgatcccttgtccccagcggggcacttgctgctctactgtggggggtgattatcccgccagacaccgagaggggcagttgtgtgcactgtttacacctgggtcccagaccctgtccagagccgggcacagaagtgtttggtgaatggagaaatgagccatcaaatggggcttgggttagccccctgttctcttccacccaggcctttgctggtgtttgcagctagtttctcctcctctgggttccagggcgcctctggccataggacttttatgacaccgatctcgtgctgcccccagtggtgctccggcacccagccctgttagaggagtttaggatttgttctaagggccatccactgtctgagggcaggaaccaaaactgattttttttttggttcacaaggcccaaaacagaagagatgcttggtaaatgtttaaacaatgaactagttactctgaaaggtgagattcgtatgaactctgcagctggaaaatgacccaactcatgggacatctctcaccattcctcagtcaataccagtaataatagtaactgacaatacttactatgcaccggccatgctccagcctctgttctaagtgtttgcctcatttatttaaaactcgccaccacccagagagggaggaactgttaccatcttctcttcaatagatgaagcaactaggagacccagaaattgagtaatttgcatgaggctgggttggctccagaatctgtgtccttaattaatcaccctcctgcctctttgcctaaacaacagcaacaatattagtggtaatgaaagtagtcatagtagtagcaatatatttacttcattatttattttaattttgttattattaccagtatttaccattaaacatatgtgtgtatgtttaagatatatttaatggtaaatacagataataatacatacacaagaaatatacacacacacatttataaacaaacaagctaaacatttatatatatatatatatatatatatatatatatatatatatatatataagctagactatatatgtgtgtatatatgtaccgtttactgtgggctgtcacagttctaagcatctaagcactccagatacattcattaatttaatcctccagccaccttaagatgttagacactattatcctcatttaacaaatgaggaaactcatttgatgaaatgagtacagagaggttaaacaacttgtacagggtccccagttggtaagggatgcagcggggattcaaaccctgggagtctggtttcggaatctgcacccttaaatatgccaaagattcagacctctggccagggagttggggccagcctctctggcccgagggcacgcccactcacagaggacatgaagacaaagcatagactatctgagtgggcttgctggactgacccagagtcaagccaaaaaggaaggaagccctattgggttttctgctagcccctgccagcctatgtgaccttgagaaagttgcttggtgtctctgtccactgatcttctgttcagtgtaatggggcaaggtggatgggctttgacaggagttgtgatgagtaaggagcttagcttctctgcctggaaggagcaaggggaactctggttcctctcccacctccctccaggttggctgttgcattacgggaggaccccccccccacacacacacagcttctctagggctgtttcctctaggtgggacagcccctgcagggcttgagggtgggcagcaccaggtatctgctgactgtccctcctctcctgctggccggatgggacaggaggcatgaatgagccatctttccaatgcctttctgtcttttctggtccaggtgtggcaaagggaagctggaagatggggatggcatcaacctgaatgacatcgagaaggtccttccagcctggcaggtaggtgcaggggcaggctctctaacagcccacccccacccctggagtcctgatcctcttcctggacaggacctaaccaaagcactccttctggctgcttgttccagcaaggagtgtaaccgcctgtatggtagtaataggcagggctggctacctgccattctccagggtgtcccattgtgatcgtgtgtgtgacagcctactcggtgatgctgcaggccctgctggcaggcctgatgtgccctagagatgaaatagaccatgccctggcaactcagtgaacttggaagtttttgtcccttggcctgaaacctctctgcaggtgaagtgtcctgtggtgtgttcaggtgggactggcaggcctggaagagattctaatgtggctggggctgtctttaggcttttgaacagtggacttgccctgctggcctccaggtgtctgctatgcttgctcttttttttattgattgggcctctttcctggaatcaggccaggttccaggacaaagaggattcactcagtgaatccaggtctctagatacttatagtgctggacttttggtggaaacagcaggagtctagctgctctcaggagtgtgactgggcctgctgcaggggtgtaaaagcagtggaccttccacagtgactgagtctgccgctgccagtgaccatgacctaccaccacactccactgtgccacccttcccttctctcctgattcttctcctgctattttatctatatccattcatctcttcctggtgcctttgccattttgtttcttctctgttcatgccttgggcctatcaatgagagacaatagagcatacagttaagacctcatctatttgattatgatgtgccttggtgtggtggttttcttcatgtttctcccacttgggatttattgagtttcttggatctgtaggtttatagtttcatcaaatttggaaaattttcagccacgattcctcctactttccctcaaccctggggttccaattgtatgtattctatgcttcttcatcttttcccatggctcaccaaagctctgcctgattttttaaagtctttctttactctctgtgtttcattttggatagcttttattgctatttcttcaagttcactaatattttattccagtgtcaaatctactgttaatcccattcagtatatttttcatttcagacattgtagtttttatctctcgaaggtcattgtgggcttttttaataagccactgtgtccagctagaatctgcatttttaaagcattgtaggaaattctgattatcagcaagagttgaaaacttaaagtcctggctgataatgctcctggcttgactgctccttggagtatctacaattcacatgggtacccttaggacaaggtagacaggcttcttgatccccaaacacagacttttggtgtttgaggaatttgcggtcctgtgagagcacaatgggatgacttatctgagttttcctagtgttcttcaaagcccctcataaatagggctggctggttcactcgtctggccttgggtcctgagggtcagctggcctagctattagcatatgtggtggggacaactcttaatagtatggacgtgtccaatgcaatgtgggatatttaggactcctggcctctgccactgaatggccgtcactggagaggggcaggcatagtgaccaccaaaaacatcctcctacttccagattcacctaggagatattgtgcatccagctgaaggcccccaaatgggagggaaagcccacctctagcctgaggacctccagccctcctatgggagtcttgagcctgtacatagataagcgggcttcctagagactttcttagacaaaaatcagggctggcctcccctccctacctggaggcaagaaggaaagagggtgacaaagggaggttggcctcaagcccattgcctacctgccctccacttctgcaccccagaagaagaggggcataaagatcctaccagctgtgtccccagcatgttctcaacccacagaggcccagacccccatctccggccccttctgtccctgttcggactccttagcaggcaggaggctttgtgatgttctcagcacccttgcccagcctctgtcctgggctccccctgccatcctgtggccctgtcagtccctcccctgatctgttctgatcttccatctctccttgctttctcaccagcaggcggttccctctgcctaaaatctcactcagcccttctctgcctgtcctttttctggctcaggatacctcccctgatccctctcagatgcacaggatggagtccagcatccacctgccatttccccagagcccctgcccccatctctgtggcatggctcccaccacgtcgcacctgcttacataactgccagactcccttcctggactctgggctgcctgagggctgggccatttccttcagcctcataaccccagcaccaggtgctctagagtgagtgctgctgaagaacctcctttctagatgtgctgttgtgttgtctagagtgtacaagaaaggcaggatttgtgtctgtcttgacactcagtcgtccctctgtctctgagtttctcccaccacttcccagcagaaattcagcatgaacctggttatgctcttctcggtgtgatttctgagacacatttgttgttgttgttgttaaagaaaacaggatttttccatcgtctcctgtattaggacactataggccatggcataatactaaacaaaccccacatctcagtggaatcacacacagaattttatttctaactttctgaaattctgctgagggtccagctggtctccagggtagctccttggggactccagggtccaggtggattgcgttctgtggccctgccatctcaatccatggtatccaagtggccctggcacaggcaaagagagctggagggtcgtgttctaggtcaagcttggccaacctgtggcccaggatggctttgaatatggcccaaaacaaatttttaaactttcttaaaacattatgaggtattttacaattttttgttttagctcatcagctatcattagtgtattttatgtgtggcccaagacagttgtttcggtgtggcccagggaagccaaaagattggacacccctgctgtatgtcttaaatgctttggcccagaaatatcagctccactcagagcccattggacagaactagtcacatgcccccgccccaactgcaagggctgacacttctgcaggggagcgggaagaaggggagcacatggctgttctgtaagcctcaagtgcctctgccaaatcttcctctttccttcacttgctcacttaactcatcttcatggacaagtgctctgccctagccttttagagagagagaattgatcacataagatacagttccccacgagaggcacagcctagtagaggaaatgagacatgcacagattaccacatgcattcaaagctgcaaatgcccgagcaagtgctggtgccttgcccaggtcacagtccctgaagggcaaagtctgggtcctctcccagtacaccccaccttcctcccctgtgctgctgcagctcctgcagtctggggcgtgaatgtgtggctgagtacaaagcagagggcgccatgggcccccacactgaatgcctgttgatctcctgggagccctagcttatctctcagtgggttacacacagagcgcatgccacaatgagtggttttaggaggtgatgcctccactgggggtcagatgctgacacctaggcgtctggccaagctcctctccagccaaagccaaggcccctattcctggtgactccatctggctgtgtttccacaactggcaatgaatccaggggtgagtctcactgcagtgctgacctcaggaacttcatctctggagctgctggactcaggctcttggagcccccacaaggatgtggggcaacagggtagacagtaggtgtctgtgtccagggctcaccctatacctctgtgaacccctgctgccaggaatagttctgcactctgaaaaggcatttagtgagctagttaagtaaagggtctgttggtggtgttaactgtccccaaggtcttccttcccacactggtggctggagggaaaggagcaggtacgctgggataggagctagccaatagccaggttttatggcatccacaccgaggcatgacatgccatacaatggcagcctcaggccagttgagactgacattgctctctaagaacactgatggggtggtggggggtcggcgggggtggagtgggtgggagatggggggcagcagaaggctctgagtacagggccatggattcagggttcaatcatggttctcagtgttgaagccatagggcaggcagacactgagacacacacttgggctcagactgcagttctaggggacccccaaattccatccacaaggctggtgtcctggtagcatttttggcatctctatcacaggagtggaggggttggccaggctaccactctgtcagtgttgtgggcagcccaggcccatcattaacagtcctgctctgagtgtggccccagtgttgaggactgctggagtggaggcctcgccaggatcggtggctgtatggtggtgtgctcccactagagggcaccagcgcaccactctgcaggctccagcctggtgcttgctgtgggaagtcccctggtcccagcgccagcagccaaaggcgtcttcaccggccatgcctcctggtcagcgctgcacatgcacactgtcctgaaaatgaccccactcaatgcccaggcccttcctccctgcagcaagtgggaggatggcgaggtgcaagaggcagccacactaaggtgtagggaagctcctgttgggccacatgtcccctgctaggccaaggcatgacactcctccagagggcccgcccctccctgggacccctgggaacacactgcttccaggagggcagcagcacggggctgcaggggaacacccactggggtggggctgggggagttacaaagtgttggcttccgcccttggaaggatgggggctggctaagtggggagatggagccgcataatctgtaatccatagtctaagccgagttaatttactaagttctgaattaacttgactaagttccaagttaacttgaccaagttccatgtgaaggcaagggatgaaatccgaattgcatatccttcacctcatctctggtctgagaccaccccccggcaccccctcccccaggacccctttactctgaggtgtgacttggggagcaatttctccatgtgtgtgaagtcggcgcgaccagtgtgagaaagacggtctaacgggcatgttgtccctgtgccctagatggcccctaggtgagcattagatttcctcaggttcccgggcacagggccctcggcgccctgcggaaatgccacctccttatatcacacagtggcctggtgcttttgtgtcatatacaataccccattgaaagacgttgtttgttgaattatccagtgtcctgcccagggctttctatcaggacgtattttggtcattatccttgaattctcccagacaaacattatgtctgctgtctttggtctgacagtaggaactacataacccactgacttctcgttttgcctttctcttaggaaattttgaaaccaaattctgtgtctgttggccgttaatcattagatggctcagacctagcagggccggctcccctgcccccacattgctggccttgtccagagcgtgtgactcaggagccctttgctgtgaaaggggcttagtgcccacacaacagtggacgccacccggtcaagtgggatttctggccttagggatgtgcccaaagcattccccattgagggtccccagaaggctcaggggacggaaagtggctttctggcctcctgagcctgtgtccaagtccagccttcacacgggagatggctaaaggaagggacagttccttcctcgttcttctgcttggccctggatgataacagagagatcctccccactacctctctaaagaatccgagggacaaatgagctttcaaaatgaaaatcatggctccatgaaatgacactcaggtgtccctcactcctggaggagtgaaaatggtggccgataaggaatggcctggcagccccagcaggtggcgctgctgctatttagtaatgggggtcctgggcgggaggccggggccgcggctggggctgccccacactggggttgaagcctctgtagccgggttcccagacctccagatgagaaggagtaactttattgttccctagggctgtgttagctgttgccaagtcttctggaaacttctaggacatgctaactcacaggcgtgaggattagtaaagtgccccgagacacccaggagcagagtcctgaaaaccatgccccacctcgcctccccaggccctgtgcaccggcgactgttgctccatgtcacccgtggtcccacggaggtgaggtctgaccttattcacccaggccaacattacggatcaggcatctctctgtgtcccaggcattgtcttatagccattatggactgagtttaagtgcaggggctggtacctgtcccatagacggggacatggtattctcctaatgtccccttagtgagaattcaacaaggagcgtaatgcaccaacagtaacactagcgaacattcacagagtgctttccgtgttccaggaactgagaaggtccttgctttttctaatcttaccctcacgttgtcccatggagcacgtactgttattgacctcactttacagaccgatgtctttggtcggatgtaaccttctcagtaagggcttgtgaacactccatatgcctcctcatcactcaagaatcgtcactcgattcttccctgcagcgcctgtcgcatgtttgctttatttcttttgcgtctgtattctcccagtggagtgtacgttcccctggggcacatctaggggctcattaaatatgggttgagtgacttgctcctgccccagagggactcccacccagcatcttagtccagaacttgtgcctccaccacagaggctaccatgacttgagtgctgtctgagctgcgggctgcatatactatctctgaagtctcacaaataccctgggaaatgtttattctattattatttcacagattggagaactgagctcaaataccttgcctcaaatcacacagctgggagaagggggattggaatccaggcagcctgactcctctggtacctctttctaaggagggacgatgaggaggaagaggtgctggaaaaacattttctaattccaggagacggtagtcacgtacagcaagttaggggtgaatgtcatttccttaataagcaagaacaagaaagtgggtatctctgtttttctctctactgctgaaggcaataaaaatggaaagaaaaaaagagaaaagcctctacagacagctttgaaagagaaatatttttttcttcttttttaatcagacaggtttgtagtggccttccccatccctgctggcccaagacgctgtagcagccatcaaggagggggtcttacaaacgagagcccctttccctccccagccacctccccacccccaagtgcttcctccctcaggacaaaaataggcgcccatacaataaatggggccagaagttctccaatccgtggtttcctgtctgagacctccaggtagcaggtccactgggaaggggcagcgtgctctgtgaggcgagcctatttttattttttgttatttgtgagtcttttttttttttttttaaagaactgattattctggaggtgaagacttttgttggtgacaactgggaaagttcctcgggaagaggccactgtctgcgtctagatggggtttccacgcgggcctcctcctgctcactccatgcggagcagaaggcagggagctgggactgtgggcagcgagtactttcagggctgtgtggggcaggcttcaaggggcctgggcaagtctgcccaccctataggaacacctcaatgatccaggccacggctaggattttagggattggcaaactggtccacagaccaagtccagctctccagcctgtttttgcaaataaagttttatcaaaacgcagccacacccattcacttgcttcctgtctgtgactgcatttgtgccacagccacttgctgtgtggaccctatcgccggcaaagcctaaaatattgactctctggctttttacagaaaaagtttgccaaacactgatctagaatataaacagaacaaaaaaggaaacctctgagagttaaaacaggtggcagaaatcctaaagctcactcactagtcatccaagagcccttctgctttgcacacagaacattgtgtaattcacccaaaataattttcttccagcttccatttcttctgctgtaaagttgggggtcatatacctgttcaacttacgttgcaaagctgtgctaagagtcaaaatacaataaaccagttcatataatgacagggatttttgaacttaaaaaacactctgcagatgtgatgtggcctcatgaagtggtagtcacatctggaagcaggcagagaactggcaagcttggcagataagaactgcgcttggagatggtccaacagcttccttctgtgggtttcttggcgggtgggagatggagggcagggactgttggctttccccagctcctcctgagactgagacctaaagggtgactgtcttcctgcccttgaccttagacagaaaagactgttgggggagtcttctgctcacccatttctctttcctcttatgtccttccctctttcttgctcaaatcttccccctctttcatggccctgttccaatttcacctcctgcatgaaactattctggataaatcagaccacatcagcccacagaggtttcttggttttttgggggtcttgattctaggccaattttgaggttttccccttttttatgcccctccatgcatttgtgcctcctggaggaggtagacctggaactgggccttggggggtggcctgggaggggagagggacctatggggagaaagagaattatggtcaggagaaaaggaggctgttgagagtgggggagtccaggagtcctcgagaggggagactgtatgtagggagagcagttgggggtggccctggacgtcttgggacctgaccaaatagggactcagccgaatgctctccagcaaggaaatgcaggatggaaggaggattcagaagccgtgggacagggcctgactgagcctatgccctcctcctggagaccaagagggagttcccaggatctccctccaggcaccagggaagaagttttgttatttgttagggacaaaggctagagccctttaaaagtaggacttggccccagtggagaggtcatctgtccatgccctactttgggccagaccatatccagaatcccttgatgagtatcagagggcttaatccttcagggagtagggccttgaggccagcatgggacagggagctgggacagtaggctcaaagaaggccagattgaggacagccttcctcaaggtctcagctgggccaaggccatcacacagacaaagagctgctggcctagccctgctggaggaatgagctcagggttgagaagaggccagcaggggtgcccggtacacagtgagcaggccccaggctggcctgagtggccctgtcgacggatgcccagaggcagacccaccctgcacacgtccacccgctttgatgaatggggccacacagcccgcagccttgccgtccctgtccttcagcagtttccagggtctggtttaatcctcccactccctgagccaatttggcgatgcccttgatgacttgggccaggcctggttgattgagattgcttgccggtccagcatcttccctcctctgtcctttgtggaaggagccgccggggcttgggggaagaggaaggtgtcgccaagggtgtgaagcatccattattcctttattagccaatgtcccatttctggtctcattctccttcctggcagcggtgagtttaggggcggagaagcccagttattttagtttccccctgcttctgtcactgggagcagtggtggtggagggggcggggacggacagggctacgtgctctccagcaggcatttgtgaatgggcctcggctcccaggctgacccgccggcaggcggcccccccaggacacactgactcttactggctggaaggcgtttttccagcattgcagcggccaggcaggaggaagctttcctctggcccaagaacaataccagggtcagcccagggacctccctcctacaccctcttccttccattgtgagctgctgcacaatcccaggcccctctgttctatacagccaggggggctggggggtcaggcccaggagagattcacagtgtgtgtgacaccgtcagttgcttgcctccacttcccaggctgggccagggatctggaggcagccgatggccaaacaaaccaagtgagtgagtggccattgggtccctgtcctttgcaaggggctacctccagagtggggcccccagctggatgctaccactctttccctcctttccccattgactcgtagcctgccagggctggaaaagacccagaacttccacctacaaccccattacagacgaggaaactgagagacccagaaaggcaaacttctcattgccttgcttaaaaatccttcactgattctcagggcctatggaaaaccctggactttcctttagcccagggcctgctggcacccccggcttctttcctgtgactccgagtctgtctgtgctctcagcttggtgactgattgccaagcccctgatccagcagcaccagttgccttcagtgtccttcccacctcatccacctgcctgcctgccccacacctggtttttgtttgtttgtttgtttgtttgttttttgagatggtgtttcactcttgtcacccaggctggagtacaatggctcgatcttggctcactgtaacctccgcctcccaggttcaagcaattctcctacctcagcctcccaagtagctaggattacaggcgcgtgccaccacacccggctaatttttatgtctttagtagagatgaggtttcaccatgttggccaggctggtcttgaactcctgagctcaggtgatccacctgcctcggcctcccaaagtgctgggattacaggtgtgagccaccgtgcccagccccacacctgttcttcaaagactctgcttagaggtcacctcctctgtgaagccctccctgataagggacttttccaatgcgttagtttattgattcacctggctcctccagcacttaatatattcctagagcacagctgcccctccacatcactggtacacatgcatgcctcacccacacatgcatctctccctgaaacacacatgatcccgggagccaaaagcgtatcttattcacctctgcagctctttgcacaggtcctcaaagtgtggcccctgatcagcagcagtaatatcacctggggacttgctagaactgcaaagtcttgtgttctatcttcaccccagtgaaccagaaactctgggagaggggcccagtggtctgcattttaacaagccctctgtgatactgatgcgtgcaacagttggagaaccactgccttacgacctacttgcaggccactggcttttcactacttctggatagttcagggagtcactgacatcaccttcccctatccccttctatctgctgctgagatttttggttggttggtttttaccattattttgctcaaatgaaggacaaagaattgtgccctgtttgacaacccaggacatggatttgcaaatggtttggtgattcaaggacaacatggtcccccagactccagcaactgctcctgtcactggtcatgcctcagaggacccctgggtcccgacagccctgggcgggccattggggattagggtttctggaaggctcattccctttgcaccaaagatagaaacctcagcagagtcctcagtgacgctgcgtatttccaggtggtcaaagccaacacctggggtggagatgtgggggcaacccacctggatggggcgaagccctgggctcagtgttccagatctttccttccagcgcactgctttgtgtgtgtggcagatgaaccatccacagcgtgctgggcagaggccgacagggagaggagtttgttccctgcgtgcagaacctctgcagcggcgggcgctgacaccgaagcacactgggtggcagggggaagcctccctgggaataaagcaacaaacacaaacttctgtctgcaaagagaataatccaaagttgatgttacatcgaccataagtaagaacaacaagggagtagcaggcctagctaaacacgccctggaaaggctacatactgtggttgtgtccagaaaacaattttggactccaggaaccccacagaaaatgacggcctgtcccttggacccctgcttgcagtgagaccactgtccctccgagcatcagtggtctcacttcgagcagggggcacaagggacaggccatcatttcctgcccccgagcctcaccctcctcctgtgaaataggagtgctggccttgccctccttctggatccaagccttcaccccccttgcccacttttggggtgctcctgaaggaaagagctctgattattaaagcattagatgtagtcttgtgttctccaaagaccctctttgttccttttggcaccccacccccaaagggttcaggaggaagctctgcctctagcggtctaggccctgctctctctccagagtgaaaacctcaaggagtgttttcattactcctggggactttggtgttgcttttcgctgtgggtttcctggagtgtgtctcttttggatcccagaggtctgccagcctggccgggatccagggagggtaaatggtggctccttgtctgctgagacaagcgtggcaccactgtggccaccagccctgaaaatttggggcccaggctcccaagctctcatgggggcccagttgcaccatgaggcccagggctgctggccactagttctatgttgagtggccaacatggcctgggctggggttcccctacctgtgaggtgctaaagtgtcaggtgggatggacactgctgtggcgtggtgacattgctaaggtgactattggagcaaatgacctcagtagccacttgcacctcgcatgctttgtggctctgattagatcattcatctccaacgtagtataatgtggggccacaggtgcaggtgggattcagaaaagggaaaatgtaggctggggcgacctcatgccttcatggggaggtgggccccaaacacttgaaccatctactcattttttatcaaaatagtacctgtctgtaacttacaaaaattaaatgatactgaaaggcctgtgacagaaaatagcagctttctaccccctgcgtcctcaagtgacccgttccattcctcaaagcaactacataccttcactgtttttactatttttttctagtggtaccaccctatttcgaatacagatatctaatctctaatatttctaatatctagtatactattattatactgttctttttaagtatatcaattctagtgatttcctgctgattttcttattatgagagagaagaattttgttctcctatactctgtcctctcaatataggtataccgaattttacttaaatgtttaatcagatgattacttcattaacgaatcctgctttccttttctttattttgcaaaaattcagattcacaggaaagttgcaaaaataacacaaagaattcctatatagccttcacccagattccccaagtgttcactttttaccatactcgctttatcattctccctatgtaattttattattttcttaattccttgaagagtaagttgcagacacagtgccactttacacctagatacttcagcatgttttcctaaaagcatggacattcttttccataaatgcaatctaattgtcatatcaggaaattagcattgacagaatactgttacataacctgtagacatttacattttgttaattgtcccactaatgttcttgatagctaaagaaaaagtttttgtttttttgtttgtttgtattttttttttttttttggtttagaacctatacaagatcagactttgcttttagttgtcatatctctttatctcctcaatctttctttgtcttttatgaccttgacattttgaatagtacaagcaggccagttattgtgtagaatgtctgtcaatttgattttgtttgatgtttcttcataattgagtttgtgtactttttttttttcttgagatggagttttgctcttgtcacccaggctggagtgcaatggtgcgacctcggctcactgcaacctccgcctcccgggttcaagtgattctcatgcctcagcctcctgagtagctgggattacaggcacatgccaccacgcccggctaatttttctatttttggtagagacggggtttcaccatgttagccaggctggtcttgaattcctgacatcagatgatccgcctgcctcgacctcccaaagtgctggcattacaggcatgagccaccactctcggctgagtatgtgcactttttaagggaataccacagaaatggcgctgtgtccctcttcgtgcagctcatggagaggcacagggatttcgtgatgttgacattgaccaactggttaagatagtagcttccaggcctcactgctatgaagttactatttttctttttttaatttttttgagacagagtcatgctctgttgcccaggctgaagtggagtggtgcgatctcaagtcactgcaacctctgcctcctgggttcaagtgattctcctgcctcagcctcccaagtagctgggattacaggtgcctgccaccacgcctggctaatttttgtatttttagtagagatggggtttcactgtgttggccgggctgatctcaagctcctgacctcaggtgatacacccacctcggcctcccaaagtgctagaattacaggcatgagccactgtgccccggccccaagttactatttttctctttgtaattaataagtatcttgcaaggagatagttgagactatgtaaatatactgtttctgctaatactttcactcacaaattttagcattccttaatgattcgtgcctgaaatgtcatcatgctgatcagcaaatagtggttttaaaaaattccatctacatttattagttggctttctgctataaagatctttccttctctatttttcttttatctgtttatttatatatgttttggctcatagatttttattttattctaagggttataatccattactattatttattttgatgctcaaatcatcccagtgggagcccttgcaaactggcttctgtgtgtttctaaaatgtccccattattctttgagcacttcttgactttcaggcatgagaacttgttctgggcttatctggtattttctctgccccagccctggaatctagtgttatctaaggagccctggtaccttttaatgaatggttcttagaagccaagatcgggacctaggtgtgctcattgctgctcggttctcacgtttttttactctctcctccctcattccttgagtgcctgggttctcaggtcacagcttctgttattctgcttctccagaaataaactttgaatcttttgcctggtggtggggaccaaagtgtagtttcctggctatgtggaaagggaaggggacttggggagtctcatatttagacttcgatctggttctgctgtttcctgccaacacctgagccttgcctctcctggtacctggggcctgcaagctttgagtcctcggagatttgcagcctccatccatgcatttctcatcagtattcctctctgcacataacttaggttgcacctgtccccacactgccaagttgcccactcctccttcgtttactttctgtctttgcaaagtttgttgaaatctcttttcttgatctctgtgcttatgggggtttacaagtttttgtattcatgagagagcaggagttgaattaaatgcatgtggtcaatcctgtcgagtcagaagtctaatttgtttggatttaaatagttagggaaacaggaagaaggtcggaagactgagctctgtgtgcttgtcaagaggagcaacgggagcagatggtgtcgtgtgggagtcggggataaagcgatctgtcttcagagttcaggcaggagaactggcttgtggctgagccctggacaggttgtatagagaggataaagggggtgcaggatgtacctgaatgccagtacatagatttttttctttgctgttgttcaaagaactctaggaggggacacacacacacacacacacacacacacacacacacacacacacaccaagcttaccaaccaggagatgggcagagtgagcagagtataagccccagtcgtctgaggggcctgggaaaatctctgcttggattcagaccttacaaagattcagaccctacacaagagccaccagggcaaaagtgctctgggactcaaggataaggctctattgtcctcccctgcttaggattccagccacaccctgcctagctttgtatttgccccttcctggtgggaaagactcttcctcagcaagcctccagagccctgggagcagggctcttgtccgacaccacctctgagacagcactggtacgctgttggagctccatcaatcacagaaccagagaatcgttgctgaaattgccagagcaaatgtgaagccgactgtgtgcaaaggtgagcctgaaagcagcctcttcaaattgcccttaagaacttgtaaggcaccaggtagttgctggcacctctgtctctgcagccgcctgagtcccgctgtcctttgccgttactaagaaatgtggcccccacccccagtggtagcccagtcccagaaggtctcatataaagtacaagctgtccttgccttttgccaattcacatttcaacaatccacgcattctgcagttcctgaaaaccgcttgtgtagaacttctggtagctttaatctccttacttgggagttcctgctcatttctggaaatgtttaaataagcaagtctacccttaaggaaagtcaagacagcttttccagtataatacattgcatcttagtgataaagaggtagaaacctcagagcttagtctggttgaggcaaggccagtctgtgcacggttttgtcagctgctcctcctctcaagaacactaaggcctgaagggcaagggctctgggtgcatccttattacctggaagtgctccttttccagcagatcacctgcaaggattcctcctaccgacatgttgtcacctcagcccctgatgtggaggataaagctgggtatacttgcgatggggctggtgaagaagagagggtcagatgagggcaggctcaggtataggggtgccaaggatgggtacctagaccagccagagagaacacagaagacttagctgtctcaccatggtgcccagagtaaggaacagccagcattggatggaggaacaaagagatgaaatgtcctctgtgcatgtatcttgaaaagcacctagtcaccattctaaaccatcctaaacacgtccttctaaacaaggaaggcaaggctcccagtggggaagtgctgggccagaggccacacagctcactcagccactgacttggggcccagggtcccttggtcgctggtcttcccacacatcctgtagtttcttttataatgaatccgaatgattggtccttgtacaaggctcacaggacatctgtttaataatgtattctagaatttcctagagatcagcatcaagtaggtgtctttgaaaaggcttcatcactaaagcatctgcacagaaaatgttctgtagagaggaaagagggggagaaaaagaaaggaatgacaatcagagctgcctctctgtctctgcacacactcccctctctcatccaagtgagaactgcaagaccacataagctgctaatggccgaggttcccggggccccactcctcagccccgccatgccggggcacagagaggtgggggcacagagaggtgagggctcttccgaaagatgcggtggtgtttgggggccttcagacacaccctggaggaggaggactgccacagcatctgggcatcccgcactggcagttgtaccctgtcctcattgttctctgttctgcatactgggctgtgtgtcaggcctgtggcttcctttttcatccctgaaggaggccactagccacatggcgactttttgcaaattagaaagaggtgccccttcctcagcacagcctctgtctgatattgtcataaaaataactcaaatctatgaggacagagtggccgagtcacctcctggggttgttcaaagcatgcagaagcagcagcccgctctcattttaagtggatttcacatgctgcagcttgaattgaaggcttgggtcactaagtcattttctagaaggccaaactttgagttgagaacctttcagctacagagaaccctccgctgaagggtaatgtctaacagccaagaaggcaagtttcctccattctatttcttcaggaggatggagtcacgaggtcataggagggcccacctgaaaggagccttcatggttgtccatataacacagcccctttcagtctgcactgagccaaactcaagccccaggccagcgcagatgagctgaattctcaaggttgttgtgagtcagaggtcactgtacacaggagagagattcctgctgtccaggaggggctaagtgcaaaggtgactttcagggaagaaaaggtcactaccttcccctgccgcagttaactctctgggcaatgggtcctgggcatgaggcacttgtaaagctccccgagtgaatctggcttgcagtcatggctgagcccctctgccctaaggtattaaagacttatcccatttccccagtctgtgagatacttacatcatagaaaaataagcagttagccaggacttgatcctaacttataaaacattagttcagtagcttctgtcatcttgaaattgatcatgcccagccttattttctccctgtcctataagaaggtaggattcctcagagcagggctcatgtcttctttgccattgtgtttcttataggtgacactctctcccccatctccaccccaccccgtccttcaccaaaactcatcaatttcattctaaattttattttatttgggcgtttacagactctccttccatccactatggcttccctaactcctccgctagtcctccttgccccttggctgttgtgacagccccttaccagtctgccctgggtttggtttaaatcccctaaatccagtcacctctagcatgacctacaaagtgcacacatctagctagtttcctgatttgctccagcctgtccttgccttccatcacgtggaagacaagctcctctcatgcacggtcatcccaatccagcccctgcatttccttccaaccctgcatcccacattttccctatcttgcaccccatgtaacagcacactggactagctgtggagccctgagtacagaagggccaggtctgtcttctcctggctgatccatcatgacctggctcggggattggctgtggaaagtagtccacaaacacttaaggaacactctctcagcagccctggcgcaccctgcaacacgcacaggacccagaaggcatcctcccagagccggaacacaggagcctgccccgctccacctcttccaagctgcatggacttgaccaagcacctttacttccccatttcctcctatctaggatggagataataaaacctcctccctgcaaaccaccatctcagaaggctgtagtgagaatcaagcaagacaataatggagaaacttctttgaaaacagtgaggtgccagtcaaatctaagggcttctgagagggcagcagtaaataggtattgcacacggcagctcctggggcccactgggagccactcaccacgagcatggtgcacgtgcctgtgagcagggcagacagagtggctgcaacacaggcttcttccttcggtatttttataaagggaatcgggtgaaggaaatgtcttggaatagacaatcttcctaaactcccccaaaataacttcagtggaaacaattgtaacgtccactctgccggcattgtttcagtccactgtagtatgggaaaagtctcccggcatttccaactcaactgggaatccacttgacttccagacgtctagaaacaaagggattgtgcccaagggccactctgggtgttcgtggccctctggtgccgaagacaattccagggcctgtgtatagcttactcttcctctctccctccctttgggagacatatttgctgaagggctttgtattttcccatacataactttgtaggggtcgttaccaaaatagtttgttagaatacacttgagattctagatttccctccagtcagtcacacagcccagtgttccagattcgaggcctcccaatgctcagtgactctttgccacctgcaccagatagaatcagtcctctcctaaaaggtctttccttcttcctttctctagctgggaacaggtgctcatgtccccagtccttgtctggtcttcctgtctccccactccttctcttgtgagtctgtcctcctcaaagaaattgtccaagcatctttgctcactcctgtctcccctttccctctccctcccagacccaagtggtgacaccagctctcccctggcctgagacagatctgaagccctggaatgtttcttcactccctcatctattcttatcctccaccgcccctcacttgctgccccaggtattccaggacaatcctatttacctgccattttatccttttcttctttttgagacagagtctcactctgtcacccaggctagagcacagtggtgtgatttcggctcacggcaacgtctgtctcccgggttcaagcaattcttgtgcttcagcctcccgagtagctggattacaggcgtgtgccaccatgcccagctaatttgtatatcttttagtagagatggggttttgccatgttggccaggttggtctcaaactcctgacctcagattttatccttttcaaaaacctgagcttgttaattgtctcactaaatgagacttaagtttttatctttgtaaaacaaaacaaaaaacccttgctcaactcaactgggaatccacttgacttctggaggtctggaaacaaagggattgtgcccaagggccactctgggtgttcatgggccacaaaaaaacaaaaacaaaaacaaaacaaaaaacaaaaaacaaaaaaaaaaaaccacccttactcctatttctggctcaccatacacgaagatcagtttccttcttgcctggatcttgtcctctccacctctctgcctctaattctcccatccatcaaaatctctctcacttccccctctttgtaagaagtgtttcctaaccattctgctgggacattctagaatctttgctttctcagaacatggtaccctgcctcattacttctcaaactttagcgtgcatatgaatagcatgcagatctggtgaacatgcagcttctgattcaggaggactagggtaggcctgaacttctgcatctccagccagctcccaggtgagaccaacgcggctggtcctcagaccacactttgagtagcggaaccctacaacaatggttcccacattttgctgcacaatgggctcctgtggaggggtgggttgaaagagactggtgctagtcttccatccctagacactctgatgtttttagcatggagcttgacccaggcattgggattttaaaatctcctcaggtcattatactgtgcagtgtgggaaccactgccttattgcataaagtgaatatggctaagcctattattatttcatctgtgcttaccttgtctcgaccttgatagactacagccctctctaaggcaggacttggtcaacattttgttttgagcattgatagatgaaccaactgattagatattaggcccttacgtgcttttctgatgatgaatcggtgttaatgagcatatatgtgttgccacagagaaatgtactagatatcaagagggaaataaaaatggatcttggcagaccatggtgaaatctacccggtgccagcatcagcggagggtggcccaggctgtcctgtgtggcaggctccaagggctctgggcatgtttttggccctttcccacccacaagaggaaaaagaaattctacctctctggcctgcttgttctaaaaatactcactttttctccttttagtctgaggcagtggttctcgaccacgttgtagactcgcctggggagcttttaacatctttgatgcccaggctgcacccagaccaaatgcatgagagtctctggagtgggacctgggcatcgagatgttttaaatgtccccaggggctgtcactgagcaaccagggctgagagccaccaacctcaggtaaatgtaacccctttatcctcatctcaggtggactgaatttgtcaggtccttctatgaaggagtggggagagagtgtgagaaggctgggtacctatccaaggcagaaaaccagcacccagtagagagaagggcccagagagggaagacactgctgccaaatgcgccaggtctccaacatgtctccagtgcaagggtctatcggccatgatccacgcgccaagtccagccctccattggtttttataaataaagctttattggaacacagccacacttctgtagctgtttttgccatacagctgcagagctgagtcattgtgacaaagaccttatggcctgcaaagcctaaaatatttagtatttgactctttacaggaaatctgctgatccctgctctagagggttgaccctgcatagactccctaactgcagtttatgcgttggtgcctatgcggggaatttttaaaaccacattttggactttgtgtaaatttttagttgctcttaaaacagagcagtgtcctggtggctgtgctgacaataagtcctggttggcttccctcactcagctgttggggtggcaggtgctgctgctcccaccctctggtcccaaagactctctttggttgccctagggtgcccggcagatgttactgttttctctgcaggctgtgagtcgggggcttgggaagccccatatcaaaacctagtagatgtaagaagttagacactctggctaggaatggacgctattcctgcccaaggacaatggattcaggtgaggagggctgcaggaggcagaggctctggagacagagagcagggaggggatgagagctgccctcagtcagagccacaggaaccctggcagtggaggatggccaggaagcgcctaaagactgagcttcaatatcctgagtccaggttctcaaattctccgccattccttcttgagccaccgctgtgcccctgaaagtaggtcagatcactgtctgctacagagccatggtgggaatgagataccaactacgtcagcagggccactattgcttagtgagcctgctggccagaaccaatggctgcccaatttaagacaacccataaagacctttttatgtggtgcagactctttaatgccgtgcatccacacaacaaaagcttagcactgctttctgggaatggaacaagtaattgaatttctgaaatgataaatttcactatagtcagagagaatggtacaaccagtctccttaaagcatctggattctcttgtaaaattaacaagttggagtcgattgtctaatttactaaagatatttggaacaggacttacaatttcctagtatgcttaaaatacagttccacacagagatttttctgcatgcaagcagctttttaggaactcatctttgtccatctaatctttcttcctaattggaaacctctgtaagaccttatcctttgtcatttctgcaagttcctcatgctttttaaatttttgaccacacacttgtcagggagatctattatcttcttctggtactgatcagattcacatgaagcagcacagctattttggaagcacagcacagaatttggaagaagggagagggaagaagtgaggtgctctggcacaacccagttacagcaaccttgtaaatgtatgcattcagtgctggaattgtttacagagcgagtgcccaccacaattggggctaaccctttctgtagcttgtttaaagccacattcattattcattcattcatttgttcactccatcaatcagcatttgttgagtacctgctatgtgacattgctgtgcagagtcattataatgggatctgggggtctattgccagagaaagggaacccacgcacacacttctggatgggcactcgctgccgtcagtgctgggtctcatgactgatgctcttatgagcattccgctacggttcaatcctgagcctcatgggaataggctttgatgttagagaactgaggtgccaccctagttccattgcttacttgctgcatttctttagacatgctgtttagtctatccagccctccttttcctcatttgtagagaatagataatcgtagtacctatatctcagggctattgtgaggtttaaattagttactgtatcagaaacttttcactcagtgcctgcctccatacattacagcccgttgctatcattatgatagctcataatccatgtagacatcatttggctccttctatggcgaggagactttctgaacaccttccaggaaactggcattgctcagtcaggagaagagcgcgtatttatcgggcaggactggaggggaaggaaagagttcgcagggaacttcctgccattgttgggctgtctcctccgcatgtgactcggctcaaagatgcccaagcctggtcttgctgtctcctttttctttatgttcttgccactctgaggtatcctaggaggagctagtagaaccttttgaaaacagccaaggagtgtcacagatctggcaggtttcgtgcaaaggcccaagccgcctcccacagatattccccctctccacttcttccccagctgtcagtctcattagcatctgcaacgtgtaagatgcaattctggaggtgaagcttagggctctggcatggggcggggggcttaggagtccctggagtcccctagtctttgcctaggctatgggcccagctgtgatccagagtttactttcacctccagccctttcacatcagtagacagcacaaatctagggcagcgagcctgtgtcttctataacccagtagaggccattggatgggacccccctgttggtgctgactggggtcacagtttgggctggcctacctccttggaccctgctgcccatccatcgcagggtggaactcctggtctcaccgtcccggcctgtgttactttgtgtgacccccgccagacatattgctctctttatgggtaccgacaccgctcttagtctgtctggcttgagctctcgggacctagggtccacttggacccttctctttgcaagctgatctggcttgagcatttcccatttgggttcagcaaacatgtaatccagaactggccaggtgtgtttctatctgtcatctcctttggttttcagcatctcatttaattcctacaacgaaaggtaggtattagtctctccattttcaggcagaggaaactgaagcttagagaggataaatgagcagcatgggtgcctggccaatgtacctgctgccttgctgtctcagaagtgagacacttgttacacacagggggcctgtggagctaagtagtgggcctaagcatctgtggtgtgttgtcaccatgcagccagtgaatggccacctttgtcctcggagagcttacagtttcactgagtcctgggggacccaggtctttgttaccttttccctttaactgaaggagagctagcaatcactaagcactgagccttatggttagaggacatcaaggatcctggcctcttgcagagcaagagatattgcctagttaaaggccacagacccctgggcctctgggccaccaatgaatgctcttggtccacagtggatccagtaagaatggcccaactctggcctgtcaggacagtggtcatcttaactttttatacaacaaacaattatggaggctcatggtatctaaggcactgtgccagacactgtggggcctacagaagtgaaggaagcatggctcctgagctcctgaaagtttgtagcttgtttggggaggcaagcatttaagtaactatctagaccattcagacagcaggatggagtactaggaagtttgtccagtgtgctgtgtgaccagatggattccttctcatgggaactgggatcagctttgcatggcaggggcatttgtgctaatggtaaaagctgacagaattttaggggtaaacagaagtgggaagatgttccaggctgaagacaaagcctggaaggaggagtgtgtgttcagggatggcatggcaggtgcacagggaaagggaggcccagatggtccttaaagatcagtggctgaccattctccagtctaactccaaatgccagggcaggaacccgggtatcctggcccccagcccagtgctccttctgctgcattgctgtaaatagaagtttaaagtggttctcaaggccagaggggattggggagcaatccatttgctgaagcttttcctctggatgggcttctcctgagagatgacatgtgagggggtagtgagaatctaagggatcacctcctcctgataagccagaaagcacctccactgttgggaggctgtgatgcagccagaaatagtgatcctgccgttgcatcctagcccttgagtccatcaccccagccctgcagtcctgcagtcctgaagcacaggatctgatcccctgagcctggctcatgcactctggccttccaggtcaagcgtggggtatgaccagagccaggaaccatgtggcactgcagggcaactctctactcctccctcctgaaagtcaactcagtggaaaatgtagccatcattaaaaaaaaaaaaaaaaaaaaaaaaaaaaaaaaaaaaagcaaactcccctctgaaaaccctatggatgaagggagcacttgaagggaacaccaagtacacaaggagaaaatgacaaaatgctgctttcctggcctctgctgctgggcagctgggtgattcagctgcaggggctgccctcctggaacctgtcgcaggagatgccccggctgcatgccaagctaggagggcccagcagctggcatgggactcgcttccatcctggggaggcaactatgtatttatcttattttcagagactgagtctccttgtgttgccccggctggtctcgaactcctgggttccagtgattctcctacctcggcctcccaaagtgctgggattacaggcatgagccactgtgtacagcccaattctccatttttaaatttactggtttatgaaatttgaaatgttgggcaccactaatttaggtctacgactttatttaaagaaactctaagcttcacatattaaagactaaacagaataggaataccctatttgttttctctcagccttgaatctttcccgatcttttcaacctggtcattctggtctggctcacctgtccctttcttagggaggactcttctgatgccctaatctaaagcattatccccttcctatggtttggtttggttttgagcacacttgtttctgtttgaatgaccttggtgtttttagctgcaggctggggactgtcatttccccttggtagagtggaagttcctctctgtggcctaggtcactgtggcatccccagcacctagtacagccgctggcaccacataagcctcagcagaaatgtgttgcctgaatgaatgaaaccacggattggcttcctggacgaggacccacgtttcaaccctctgtccctccagcaccaaggctgagctgcccctgctggttctcggtcagacctgaggagagaggtcctctcttccccactcttcttatctgtgctgtggctagcttcttagatacccccgagcctcctggtgcccgacggccccagcaggctagtcagacccagtgtctcagtcgagtttcttggctgccgaggcctgaaatcttcagggcctttgagtaacattctgcccttgagcaggttcacagactggctggtcctctgggagacaggcccctccctggctcttcagagcctccttgcagcttcccctcttctagctctctgccttgcccagagtcctgtgatgagatgaggggagggattgggaagtgccagcatggggctggggctggggctggggctggggctggggctggggctggagccgggtggtgcaggtctgtgtggaggaagctgaggttgcagggactgctttggcccaagagtgtcctggacacggcctgggagcttagcaggtggttagttgattaacacaggtatgaccacattctaggatggttttggggtttgggcggctgcttcccagcaggtgcacaaagaccacagacgcaagtgcttacgaagcctcaggttggaggccttcctagcccaggggtctccacatgcagcggggcattcttgagctgggctgtcgacatgccattcatgcccagtcatctcatttaaccctcgtaacggtcctctgatatgcgtatgcttctttattaccaccattttttaggtgagaaaactagaagcttaaataaggtaggcattgctgccagctcctgcggtaagtggcagtgacagcatctagccaaaacgtttgatgcctgatctctgctcagggcacctggatctgcattgctgcagtcccccagctctccaattccacgtgagcacactccacactggctcggcagatactgagaggcaggtcctgctgctctcgccttcactgtggcctccttatccatgctgatatggcttggctgtgtccccacccagatttcactttgaattataataattgccacgtgtcaagggctgggccaggtggggataattgaagggagatggtttcctccatgctgttctcatggtagtgagtaagtttcatgagatgtgatggttttataaaggggagttcccctgtacatgctctctttctgctaccatgtaagatgtgactttgttcgtcctttgccttctgccataattgtgaggcctccccagccatgtggaactgtgagtccattaaacctctttcctttataaattacccagtctcaagtatgtccctattagcagtgtgagaacaggctaatacacatgcctgtggcctctccagccagctgtgacctaccagggcagacagcaggacagtgatgaacctgttcattcatgtgaggccttggaggcttccccccggcacagcggggtacacctcagaatcttagcatggctgcgcaggtggtttaggcaggggctccctccctgctacccacagatgcccctgccctgtgcgaacgtgactactgctagtttgtataatgagctgcagcagagtgtgctcagaagaagcagagcagagcccctcaagcgtgggccgtgcctctctcactctaacctcagagcctctgttcacttcgaagggtgacctcaggcatcccttcctccacagctccttggaccttggatgttcttccattgtgactccactcaatttgcgtgtccctcttccccagggcccatgcccctcttggagacagaggtggagtcttgttttcctgtgtctgtgcacacagcatgctcacagggcaccgtgggcatcctctgagggtttgttgagcatcactcctcttctagagttggttgatgcttcagttctatgatggtctttgaacctcctcaagtacataaaactcttcacaatgttgcccacttctcaacagttgtcatttcccccttagaggccagaacgcaaacattgctttgccttctcttgagcttgctctctagagttcttgaggctctgggtcttatctgtgccatagacacaccacttcatgaggggccaggacacaggccatatgtgtctcatcatgcccaggtggttttttcaggggctgcagaatggaaactctcattcctcatggccctttgtacctctcacatttcttgggcgtctttctgcccctggtctgcagcagcttgaaggcattgccattttcagttcagaagtgtgtccaggacccttaatagatatccattatccagggaatggagcatgtcagtccactccagttccattctcttgtgcgtgtcccgtgtcaatgagcagcatgaacaccatgagcctaagtggcctgtgttcaagtctttcctgggttcatgacctggagaaggcccgtagccttttggtcccatttggtcttcgacacagagagtcacagtcatcctccagtgcctccgtcccccagcccccagtgcacacagtgcactcccttcagtgcactgtgctggctgcagaatggaagcctgacaatggtagttgaagaagtggcattttactaattgtttcctgtacattttaccctctataatgtagaaacaatcttctaacacttccctgttggtccctagtccctgttctttgcatcagtgtcctcacctattttatctgtttattcagaaattaataagtaaatgtcatttgtatttgacattgcctggtagattcctcctgacatggctacccgtggagggcaataagggaggggccatgtctgctttccatgacttcctggatataataagatcagccccactgactcctaaagttgtatcatgttaaattatttaggacttttttggttgcaagcgacagaaacccaactcaaagtattttaaacgtaaaaagaatttgttggctcatgaaatcaaagaaagtcttaatagtgtggcaaaggaggtaggaagagcaaatattttcatcctcattttacacaagagagaggagagggcagaatgggatattaaaagaatggtccatggtgatccaggcttagcgacagctaggatccgggtcacccaaagggtgtgtgcagtttattattcaggactctttagactgttacaataagaaaccctgttggaaggaaaagggagagaggggtggttattcccttggagcatccaaggaagtcttgcccattccagcgacccagcctctggaaccgcagtgctgtgcagatgaaaaccatctggatatagggtgcatgtcataggctctcacccacaaggctaccctgcgcaaaatattcacgtgcacttttaagggggtcgtggaatccactgaaacctgtccggggttcctgagtgaagcccttcttctagaaaaatgtctagctcattgtgtagctagcctctgggatagtattgagagcagagcttttcagaatgggtagagttttaggttcacgccacagggcaccaatgtgtggcaggtggaggcaggatgtgtggggtgccagggctcagcggcagcttccagaaattccatgtttacttttattgtctatgattttatattagaacttcagctaaggtattgtttttaaaaggatctctgctgattaaaaaataataaattaaaagttagaaaaccacaaatttaagcatgggtgagcctgcccacccccgactttcctttctgaatcaggtcaacttctctgaatagctgtgcagcctagagattccaggaattttagaaacattacctatttatttctgcttggacgtgacccacacatcctgcccacgtggagagagaccttggtaggataacttcttagaaaaaaaaaaacatgaaaaaccatgacccccagcaggaggaagcctctgctgttaagacaagcttattgtcagaggagctgtgcttgggatttttatggtcctttaatcaagtgctgtggttcctttgtattgttcaccccttgggatgtctacccaggttggggctagagatgatgggagtctgcaagtcctgagctagcagggtctggacttggcctgaggatctgccctacctccatggggctcatgctctctgggtatgcccagggagtgacagaaacctgatgtaatcaatatagaagcttgtgaagaagagggggactgtagcttccaagaggccagggcagagtggatatccaggcactgtgggggcagacaggtgatcagctgggagggagcagggttggagctgcaaggtgtgcctggtgaggagcccggtgtggccacctcctgcctgggacctcccaccccttccctggcctgggctaggatccccaccactgcacggctgcaccacttccttgcaaagacaagcatttagtgtagttgtttttaacaaagcaggaggaagactttcttgtgtctgtataatgctttcttccttttcaaaaagctgctgtatgggagagagagagataatagacctagagatagttaggcttggatgatttctatcagacctaggttcgtggtcaggggtcagaggtcaaagatcatgagactgtcaggaagattttccttgaaggttaagtgggcattggattctatgaaagtgcaggccatggaattgagctctgcggggcacttcaaaacctcattggggcaggggcagcagcccggggactccccctccaccaccaccaccaccactccagcctgtggagtgaagggcagggtgggcttggtggccaggaatacccctttctggagaggagaagggaggcgagcaggtgagcctgccaaaagggctgtggccagggtcatctctggggttacagcaaggatatgccaggcagacacaggaggctgtctgaaccagtgcctgccagacgccagctctcccacttctgggcctggggggaagcgtagtggtcactgggagggactgcctgtctctgagtacagaaatgagggagggacttgctcttgtccactccctcttgcttctagaggcctggggagcatggcggagcaccacggggtctatggtagggtgggagagagctctctgatgctcctggggggttggcctcccatctctgccctggtaccgtaggccatgtcacatcaccattgggaccatgtgcctcagagatggaagacacaggcttcctgctaactggttgggcctctgtgggcaacttctttgacctcactaagccttctcttcctcttccataaaaatgggctggatatacagtggaattacctggtgagcattcaacatatacaaattcaaatctcaaattcaaattcaaaatttggcaaaggaaatatactcagaaaaatatccctcccagcctgggtgattttgcccaccactccacctgggttagtttcccggggccgccataacaaaggaccgcaaactgggtgacttagaacggaaacttcttggctcactgttctgaaagcagaattcccacatcaaggtgtcggcagggccacacccgccctaagatgctagggaaggaccatcgctcccttccagcttctagtagcccctcagcttcttgcagtgtccccccagtcctcacgcggccttgtttttacaaggacatcagtcatatcggaccggggccccacacatgcacattccaatgtgtcctcatcctaacttaattacacctgcagtagccctctttcccaatcaggccattcagaggaaccaggggttaagacttcagcgtaagaatttggagatcacacttcaacccatgacatcatccagaggacccttggttggggaaggaggaagcatgggagagaggcacaggcccctcagggtgggcacatctcggccccatgtgaggactgggtagagacaacaacttttacaccagaggcccctaagtgcatgctgaccacctcggctggcaggcagtggtggagacaagagccttttccagcctctgaaggaattggtctatgctggacaactggtaactccactgtggtctccagggaagcaggttcatccttcagggagggtggggtaatgggtgtccacgggcacagcctgacccattgctgacggcaacagcagtgcatcatctcacagtctagaggtgttggccgggctgcgctccttcttccaaggctctaggggaggagccttctgcacttcttcccagcttcccgtggctgccagcaatccttggcactcctgggcttgtgtctgcctcactccaaacactgcctccgtcttcacatggccttcatccctctgtgtctcctccatctttctgtgttcaagtttacttctcctataaggacacccatcgttggatttagggcccaactaaatcccacaggacttacttcatcataacttgattatatcttcaaagattctattttcaaataaagtcacgttcacaggtgcacggggttaggactccaaccagtctttctggggaacacaattctacctcctgcggagggtgaggaggactttacagatgggatcacaccaggactttacagatggggtcacactgtggtcagcatcaccagcaacggtcctcggaatgccagggcttcacctctgcccaggggcccagcccaactcccggcactcagcccatgatgctgctgccatcggcctgccgggttgaggttgtggcatgccctcttctcctctcttgtgccttgtcaaatgccttagagctccactcaactatcacccacctggcagaaccttccctgactcttctcccaagaagtcctcggtccttcctatgggccgccagaggcgcccgttcaacttcaactatcgcacatggcacatatcagcttctttgtttgtgttcccttgagttcccctaggcctgggacagagtcttattctcctgatattctccatcaggtgcactgttgcatggcgggccccctacatttgtcgagtgagagagagacaagggtggatggatgggggcatgggtaggtagatggacgtcaagtgttacctgaacagagaggtcttccctgacccctccacccgtccctctctcatccccttgccctgttgtgttttgctccatagcaaaacatagtcctttatcatatgatatactttgttgcctctctcctttcattagaatatgtgctctgtaagaacaagcatattgcctttctatttcagtattgtatccacagtgcctgaaacaacaatatttatgagattgcaggtgcatggagggatgggtggatggaggcatagacgggtgggtggctgggagcctgttgcctaggggaggtgtgtcactcctatcacagtgtcagctggtcacagagccacccggcacaatgctttctgctcactgtttgttttgccctccctccccatcccctcacccccagattcaagaattattatttttttatggctgtcatcacagggcaaggcctcgcactctctgcctaggattattaactatctggggctcatgttctggggccagagctctgctgggcctgcccttaatccctcagaaatacccaccacactgggttgtgagataccagcctcagcctgccctggagtgggctgattttacataacatgtttttgcaaccagagcaataacatgccgcccctcagtgtcatgtcttctgcaagcactgacctcaggacaggagtgtatgtgcacgtgtgtgttccacgtgtactctgccggcgctgcatgtggaaggagtattagcttccctccatccctggagaggcttggtttatataatctacttgtctctcaggcccatttagttaccggaagtggtcagatgttagacagacagggaactgcagccaggtctcagagctcaggggagaatggttctcatgcagagaggttggggaaaagcaggcagggcctggtgggtagtcccagtgtgctacagaggcacatctgactcaggtagaccagacagccaaaaagccagctgggaaacccaagggctggttctctcatgtggggagtgcaggaggtggaggggatacttatacctggactgatgtctacatggggccctttcaaagcacatagtagaaggatttgctgagcaaagaattaaagcaaagtccactgtatgtgcttttaaaggatacatttcccatttaccattcaagggatctatcctttttaaaaagcaaggagaggtctttggtctaaagccagaatactatctcccctggccaggccaccagaagcaacaacttatactttttccagatttcaggaacgtattggtccttcctgtcattgggtgccacttgtcttggacatgccaccttttccagccgcatcttaacagataatgttttagggcagctgtttccttgagattaactggtggggggcacttttcattttgattgatcttctcttcttctcctcctccttcttttccttgtcctcctcttcttcttcttcttcctctttcccttctcctcctcttccttctcctttcttcctcctcctccttctcctcttcctcattctcctttttttcttcctctgaacacatgccattccctctacctggaatacaccacccccagatactttttacctttttaattgagatataatttacataccatgatattcaccctctcatagtatacagcttagtggtttttagggtattcacaaggttgtgcaacgatcactactgtctaattctggaacgttgttatcaccacagaaggaacgcagcatcccttagcagtcattcttcattcttccccttcccagcccctggcaaccacggatccactttccatctctgcagatatgcctattatggacgtttcttaaaaactgaaatcatgcactccgtggtcctttgtaactagcttctttccctgaacatgatgttttcaaagttcattcatgttgtagtgtggctcagaacttccttcctctttatggccatataatactccactgtatatatgtaccataatttatttatccagtcatcagtggacgggcactaggttgttgccatgttttggctcttatgaacaatgctgcccagaccactcacatattaccttacctctcaccaatgactttaaagaagctctgccaacctgcatgagctgcacatctggtgacaggtttgtgactcagtacagactttctcctttcttctgctggcctcacacttgccccctgttaacacccaagtgttcttgttttgggaggagtgtaggcagcaccctgagttgtatgtgtctcttggtaccagctaccatcttgagtttgaagaacaagatggctgattttgaggggttctcaatggagcttgtgtcaacacagtgccccccattgcatgcaggaggaggttcccggtgctggaagttctatgtaaaaggccccagggaaggcagtaaggtccattcacttatccacctagatgccacattgaggctgaggccccaggtggccttatacataggaccagccctctatagccctggcctggattgttcctggagagggaggacctcagagggtgcaaggctttgttctgtcacctctgtcactttgttccactcatttttcgcctcactatagtcttccagccccaggccaaaaacagcataaaatagagcttctccatcctcccccagcacaccaccctggaccaccaggcactgtgcagattctgtcttccttccatggcctgagcttcccatgccctccctccctgcaaatcacttcctgctggactcttttccaaggctgggggctccatgaggacaggtgcctgtgctgccttgtttgtcctggcacactcagccctgagcagagtgtcaggatcacaggaaagataacgatgatgatgatgatgatggcatcgatgacagtgatgatgacaatgaggcttactatgtaccaagcattatcctatgttctttacatgtttcggaactcatttaatcctcacaaggattctagcagccagatgctattatctccattttacagatatggaaactgaggcacatagaggttaggtcatctgctcaaagtcacacagccatcaagaggaagagccaggatctgacattcacagtctaactctagagcacaggcctctaaccactgtcatggtttatacacatacactacatagatgtgagttgttctgggatggatggatgggtggacacaggggacctaacagtggcttcatgagaagccccgagtggcccggtatgccccattgagccacactgagtcttgggacagggttagctccccatggctgctgcctgtgtgcaggtaaggaggccaggaggtaggttagagcccagggctggaggcccacaccgaggaggctggcaccccctgggctcgtgttacactaggggctatggccagttccctctgcccggcctcagagccgagatcctagtccctgccgccgccggtagggagcctcggcttcctgtccattgtctccttggggcacacccggtgtgttcctgaagtgacctggagaggcagggagggagggaaagagggaagggggccagcccagagcctagtcagggtgggagaggggaaacgagaggggaagacttggtgtttttccttatttgtgttttgtattaaagaaaacaaataatatcctttgagaaaaccattaaacaaagcacatcctaaggccccagaggcctattgtggctgcctggagcccggaattcattcatgctttcttggctagattgttggaggcaagagagacgggggtgagaggaaaggattgttattaaaatgtattttgaaatgtgttgctccctccctgcactcaatccagtccaggccaagtggccataactccaaggtccctgtgtcctcctgagtctgttgttctcccattacctctctgggaagctccccaaaactggccagtcccagcatagccagggtggtcagtttcccccatgagcttgggggctgagccccgtgaaggcaaaacagtgggaccctcctttatggaacctgaatcccgagggctgcatgtgccccaccacagggtgtaacccacaggactatgatctctaactcactgtgtggccactctgggccttgggctccctgcctgtaaggtggggagtgggccagaatagaccccctctgactgctctccagcagcctggaccctgtggctccctgtcatccagcgcatgctcaggtcgctgcaggtgggtgggagtcacactcaggctatggcctctgcatccaggcctatacccaggtgtcccaggtccaagccagaccactccctcccacttgactccaagccttggtaccccctactccaccccaggccgctcataatggaatggtagtgcatggtggtgctctctgccatgtccacaccagaacacacttttctgttggaggagggatgggaagaggtggtaagagcagagctggccatcagcccagcttgtgcaaatagctctgcctgtgatcctgcatttgcaggatctgccctgggttgcaaatagagggtctctctccaaccttgatgtagatgtagaaatagttgctgtcatgatgacaatacgcaaaagactatccttagaattttccccagttcctcctttaaagttgaaaaaggagcctgggcaacaaagtgagaccccatctctgcaaaaaatcaaaaaacaagccaggcgtggtgatgtgtgcctatgatactggctacacgggaggctgaggaaggaggattgcttgagctcaggaggtcaaggctgcagtgagccgtgtttgtaccacagctcttcagcctggatgacaaaacaagaccctgtctcaaataataataataatgatgatagtaatgctgaaaaagtaatttagctaattccatgttttcctaaatactccctaggcaatatagggaaagaagatcttgggtaaaaatttcactgggggtgcctggactaggtttaggagacaaatttcctcttcacagggcttagggttttcaggcttcacctccttggtcctctagcagcccagagaagaagggtaacattcccattgtgttatggaacttgtgcttagagaagtaacttgtcctgggatgcacagccagtgagctgcagaacctggccccagctctgttgctcattttctgcaaaaccttgaaccagcttgttcatctttccagatttgaatgtctcatctgtaattcaaggacttggacataatggattctaaggtcctcattgtccctactgttctttgattctgtaattccagcatcactgcctggtaggaagttcattgactctactgtttttcctttttcagtctggatttggtggttagagtctagtctctccaaactcttgatgtctttctgtcttagatgctggtgtacttagtgcagtcccagaggtgctttgctctctttcaggagttactaatgatcccccttcctccccccatgacacagggctaccacccgatgccccatgaagtggagatcgcacacaccaagaagctgttccgcaggaggagaaatgatcgaaggtaggagagacttcgtcgtgagctttgggttttcctttcctgcttctgccatctgtagcgacgtcagctttggcctgcatttcgcttttcccagtcaccagctgatcctgatgagatggggttggtggcatcgtgggttggttactggctggggattccccaggggcagagtggcggctccacttctcttgttggcctagggattggctcccttcaggcgtttggctgagagcccaccatcaccactgcctcttcctgggggtcaggcagtgaccaggctttgcagttcaggaggaaaaatgctgtttccgctgacctcaaagcaacaatagtggtcctcagaaaataggactggctggctgtgtgttttgagacatggcctccaggaggctcctggagctcacaagtgcaagagtatctgttttcctcctccctggtcattgggggttgtccctcatgcgtgctggctctgctgtcacaggcaacacacagatcagcaatggcacatgctactgctcccaaattcctgggggaacccacttaaactaaggcagaaaccgagatctcctgtggagctcagactcccgagtgacaatggggccaggaaaggggcaatgaggtagccctggataagaacatgcagctgaaattgagcatcctgggaatgtgtgcatttattttcaaaaaggctttcttataaggggagatcttcaagatatattttaagtggaaaaaattcaggtgcagagtaatgtttcttatgtgtggtcatttatgcaaaagggggagttagagtatattttttgcttgaacatgcataaattatttctggatggaaataccaaaaaaagaacgaacaaaaaggcttatgcctcaggaattaaaatgaggtgttcctctatagggaatatattcttagataaagatgacggcttttggttctacctttaatgaacagagaatgttctctgagggccaagaaacagccggtggacatgccttgctcagaaccctagcggcgcctgtgctcaggctggctggccacctccttaggctgagaccagggtctctgatccttccctacgcatgcacaccctgaatagggattattaggtggtgactgcaactctcagggtggatgtaggcctgggtgcccagactgctttgtcatccactggtggattaagtggatctgaacacattcacagaggatggcaaatgtataagtagcttgggaagaaggcagtgtcctggcttagaaatcagaaccaccagacactttctgtagaagcaccaggcatcaaaaaggaacactgagcaggaagaggtggacccaggcctgttcctgccttgaccagagtacagtttatcgcatcgtgtgtgctgcctttttgctgtgcagcatcacagaggcaaattcctggtttctgggttcctggtagagggaagaaggaggcagcacccctcaaggaggaatagggttcacaggggcctgggaggtgtcagagagagcaaaggctttatgtcctctgcctctggccctgtagtctctgatggcagggaagacccagagtgtgtgtctgggaggtgtggagagtccccgagcttcctgatgagaagtcaccctctgccccacctctctgcgcccaggcaatggcaggctgccacccagcatccaggtcagcctgcatgtccatttctgggccaggtcacctcactcagcaggaagaccctggacagtggcaggcctccggaaagcagcagcgtgacccagggatgtaggaagaggagcgcggcatgcaacggctgggaagccgagcttccgctgagctgcgctcacattcaccaatgtccgggttaggtcagcacacctcccaaaggatgtggacgggccagggtccaaagtgaggcaataaagatgattaaaggggtggaaagtatgtcctgtgaggagtgctggagggctggggccagggaagaggaggccggagggaaggaacatcgtgccgtgaaactcatgaaagatttatacggagagatgaggggccgctgcctccatgtccacagggacccagactagaggaagtcagcttggatggaagaacagagttttcagctagaccgaagacagacttatggagcaaacatcttgaccatttggggcaacactgtgcaagtcagagcagcagccatgcctgaacacagagcgtgtgctcgtcggggcgccccgctctaattcctcttctagatgcggtagaatccgttactcactcacagcctggagctgtcgtggagtcctcaggtgatggggactttcaggaggaaagcaggcagccatatagtttaaggacctttttgtctaaaagcaggggtctcctgagtctgttttgggaaatcgtgggattctgccacccaaagagccgctgcagaatattatcaggtgacccctaaccttcccagctaatgacccatagtagtagccttgctaagtgtcaaacctgcatatttgaccttggaagtccatacttgtgtgcagcaggttcaccttcctaatattctgggcttaaactacactgggaggggcttgcatttcctgggcacgcatggtggcaaagggagaagtgaccagaatcagatttggtggacaaagggcacagccagcatctgtgccatgcctctgatctccccccaccatatgaagggaaggggccagctgtatccctctggtggcttggtggctctccttggaatggagaggagtctgtggctttccatcttcctgcaaagtggctggagttggtgtccgatagctgcaaactccaggcagcatgagcgtgctgctgaagctaggagcatgcaatttcccacagcctggagcagggattttcagactgggacctaaagtcctaggcttcatcaaagtctgtgtcccatcccagttccagctgcactctcaggggtttttgtgtgccttactgcttttattttccacttgtttaagtctgaggctgttagcaagctgaattatatagcagtttagggacatgccctggaattaggagctggatgggaatcccacctcctctcctcactcaccctatgatcttgccaattacatcacttttgaaagccctgtcccttcttctacaaaatgggttcactagtcagggagctgaaaggagctgattctaataaagcacctagaaacacggtcttagtgttggcccactctgcaggtcagagggggtcctaggtgctcaggaaggctttcaaggtaagtgtggagcacaggtgtctgcagtgagcggggagcttttgtcctgtgattgtggcagcaaacccggaaagccttgccctgcattccctccaggggcgggccgctaggatcaattgttccttcccctggatccacttttaaagccctacccacactgtcagagggggcagagcctgggctagcagggaaggaggccccttcagagtggtcacctgcagactctgctcctgatgccatgggctgcgtctagtgaattgtggatgtcttttttccattttgaaaaaaaaaaattaagctcatggacagttcaaaggtttcctcaagaatgttcttgacatttgaacaactagtaaccacttgtttgtttttggaagctaagaaaagacatttgctgatttcagacaaaattatgcattttgtgacataaatgtgctaaatgagtgttccacgcgttcctcaaagagcagcatgccttctgatgctctggccccatgcaagttggagacctgttgcttggaacgggggctgctaaggctcgttcccccccttttctcaaagctttctgcccagagcacatagaccagaagagcaagctcactagagggctggagacccggcgcactgcccaagttgaccctgagtgaggtccctcaccgctggggaggatattttctctccccaccacaccctggctgcatttaagagatgaacacattaaggcaatgaatggatgttgtagcctgagctccctgggaagcaggctctgggacagtgattatcagcagctgcttttaaaggcatgcctttggtgttgatactggtagaagatcaaaagaggaagtggtatcagcagagagaagttgggctgcagtgcagtcttagagagttctgagcctgtaggggaggttctgaagttgggctgactctttaagagctgtcccaagatggggtaaaggggcaggccttgatacctccatgtctgttggtcatcaggcagggactgcccaaggaagggagcgttaccttgggcggggctgcgctctttgcccagagcagttgtcctaggggttggcagctgagggctgtctgcacagcacttccagcagccgggaggcagtgccccgctcctgaatgtgtatcacagcagacactgcagtgaagcactgttcagttctcctactgggattggttgggctgtaccctgtgccataagctgtgcccgagaatacgggaagtatagggtgtggcccctgctctcgagggcctgagctgtagcttgcacaatggtgccttgactccagaagcaaccagaacgctgtgcatgactgtcagtcatccacgtgttaacagggaggaggcttagagaaagcagccatcctgggagatgctccagaatgcttcctggaggaggtggggcttgaactactagtgagacctccaggaggatttgggagatgggagggtgttgggatgagaggagcggtgcttgctgcctctgtcctgtgattgaccgtgactgtggcttggtgtcctctaaatgctcctctgcatctaagcaggctctggagccagggattccccacatccccagaagtcgtccccacatggctccctagaaacagagccatgtgggtggtgctcacagcggccaccacccccaattgaactacatagaagggaaaagccactggagcctgccagctccagatgatcccgcccgactgtcagcaatgtcagaagaccctgcaggctccaaagcccggcctcttaaccatcagaagaggtggctaatgtaggcattagtggtccatcgcaccgtgcctgtgcggccagggagacaagagagccattctccaaattaatttgtttcattaagtgaggtctcggaatggttaatttactccatgtgcaaagcagattgaaaggaagaagagaaaaagaccttagccagcccagctagtgtcagatggctccgcaggactagaggcaggggagcgagccatccacctggcgtgcggagtgggccacatgctggacgttgcagggtggccacagcctacagcagcgcttgctgcctctgtcctgcgattgaccgtgactgtgatttggtgtcttctaaatgtagaaccaattaagaattttggggccgggcgtggaggctcatgcctataatcccagcactttgggaggctgagacgggcagatcacctgaggttcaggggtttgagactagcctgatcaacatggagaaaccccgtctctactaaaaatacaaaattagccgagcgtggtggtgcagcctataatcccagttactcgggaggctgaggcaggagaattgcctgaacctgggaggcggaggttgcagtgagccgagatcacgccattgcactccagcctgggcaacaagagcgaaaatctgtctttaaaaaataaataaataaataaataaataaataaataaataaataaataataagaattttgtccctccctctcttcctctgccaacgtgaacccagaccctaagtgtcagtcatcagattggatttttcaagctctctgtaacatcatctaagtcactgataaaaacaaacaggacatatggaactttgtgaatagactaaaaagcactcaattatatactttaaaggagtgaattttgtactgtgtgaattatatctcaattaaaaaaaatttaaagaataaggcaggtcccaggatgaagtgatgtggcaagcctcttgaaacaccccttcaaaattttttttagcaacagggtcttgctctgtcacccaggctggagtacagtagtgcaataatagttcattgcagccttgaactcctggcctcaagcaatcctcctgcctcagcctcttgagtagttctagggactataggcacccgccaccacacctgactaattttatttttattgcttgattgattggtagcgatggagtcttgctatgttgcccagactggtctcaaactcctggcctcaagtgctcctctcccgtcaaccttccaagtagctgggattatagacacaagccaccatacccagctacctcttcaaccttgatattttcagggttccctaaatgtgtcaggctagtaactgtttcaaaaaaggacatagatttggtctggccatgacttggtctgtgtgaacctgtgctagctattagtggtcaccttttttcttccaaaccatctgtttggcaatctcttttggagaaatgatatccatatttttccaatttttgaaaattagactgtgtatacctagctacagtctctaacacttttgttgcattattcagagttttccagagaaacagaactgataggatatattgagaggaagagagagagatgtatcatgggaattggctcatgagattatggaggccaagaagtcccacagtctgccatctgctgcaagctagagaaccaggaaagccagtggtgtaatcaacccaagtccgaaggccaagaaacaggagcatgtatgaggttcccagcgtgaccgtaagcataccatgtgttacagcatgggatgtccaagggcaggagaagatggatgtcgccactcaagaagagggagtgaagtcacccctcctctgccttttgttctgtttgggcccttggcggattggatggtgcccatccacactgggagagagatctttactcagtctactgactgaaaatgtcctcatagacacacctagaaataatgtcttaccagctaactgggcaccccctagcccagtcaggttgacatgaaattaacccttatatctgttctccaggattcctcagacatggtcaggggccatttatgacctcatgtaaagatttcttttactccaatcaatatcaatatcgccccattcccgaggcatgaaggtgagcactcagagcacccattgctctccgtggagtcttccaggccctcagcgtctgacagatgcggcaactgcagctgccttttctgggctggtacctgttctcttgcagaaggcaaacttggagtgggagaggtctgctttctttttgccacctcttaattctacgctgtctgccccatcagtagcctcatgtgtccctctgacttctcactctcaatacgaaaatatgcttctagaattgtctttaatatttttaagccccattccttgacactgctgtggcttctgtatcccaggctttgatggtcatctgtgactacaggaggccccacattccttttcacatgtgggctcatgggcaaggactctgggggataccaagtgcctctcgacatccctctctttaagtcacagctgctatctggaacttgctgctccttttagcacctcagaacactctaccagtcatagagtcccacatcctacaaaaatgaccaggtcccccagatcttgcccaccgggaactgatgaggaattaacctagtcggagtcctatatctatacatcagctcattcacatgagttgttaagatagctcttttggaagtgcagtccatccttattactcattgattcatatttgcacattcgcctacttgtaaaacttatttgtaacaccgcactcaatactcatggtgtttttgcagtcagtcattgacacacaaacagtgaaaaatttgagttgcctgacctgcaagatcccagtccaggccaaagtaacactctgcctccttgtttcagctctcatagtataagcaagcacccttctcatggttctgtttactgccatgtttttcacatttttgtgcttttccttggtgaatttgctattttaaatggctcctaaacatagtactgaagtgccgtctactgttcttaagcgcaaggaggctgtgatgtgccttccggagaaaatgtgtgtgttagataagcatcactcaggcatgagttatagtgctgttggccgtgagttcaatgttaataaatcaacaatatgtattaaataaggtttctttaaacagaaacacatacaaaacgaggttatgtattgatccagtggtgaaaatgttgtgaccagaggcttgcaggaaccaaaccccgcatttcccctaggagtaatagttcagtattcactaattcagtatttgcagcaactttatggaatgcaactaccataaataatgagaagtgaccgtacttgctctttaaaacagagtagagagatgctgaagataaagaagtatgttgtaggcaacaggatcttaggtctgagtgatttatcttgttcgtgtgtggtggtagcttcgctaggggatgagatggggacgggggggatgcttcttccagtggtcattgtcctgcatggtttgactgagcctatcactgcttcatttgcaccatgctgggatgccactgttgctgaggccctcgcagacagctcagccctgcagtgactgtcattgccatcctgtcatccgagcccagggaccgcgagacagatctatgctcactttgcccacggtttgtctttccatcccagcaaggaaattgccctcattaagtccctgctaaagatagataagaaaatgggacaggcaaacccccacctggcaggcagccctgtcagattctaagcaaaatgagtcagataagaattatttttaggatccttctcctcctccctcacgcccacccccaagcaggctctctcttgaaaagaagagcagctcatttcttcaagccagatgtccaggtccatgcttgattgaaatggagcccctgatacacccagagaaagccccacgctttgtacaaatcatgatggtcccaataatcctttgcacagtgcagctgcctcaggccgcactcctgggcagaacaagctgcagagagtggccctgttgaggctggcccacaactcacccatgagggatataccttcccccgatccccatgctcaggacttcctcccagcatcacacttcatgggaatacaaggctctgggggttctctcccatcgggacccacatccacgcgggggacaaatgggtaagaaaagaggttgcctacagctcattttggcagagccctggaaccccctgtgcccaccaggcagtgggcatcccctagttctgtgcccacagttggagagcagagtactactctttctcgatcacaataatccccttttccccagcaattagaattccttcagaccccttaagccctaaatagcaaagggagacccaatgacaagaaaggtgactgaagaggacgtaggggcacatgtctagttacctgcaggacaggagggctgctccctgagaaactggccctggagagataaatgccatttccccaaggtctgcgtctaggatgggacgtagaatggacgccttgggaaccagccacccaagctggtttcattcctcctcagaggtctagtctctactgaaatgctaggcatttgaggattggctcacaaacactaacacccaacccttcattcctctccggagccccaagcaacctggcctctggcaccaagccagcccagccctccccggggacagtgtgtctggtgggcagcccaggcccagggcgaggctcactggcttcaagacgagctcatctctcaccagccaggggatcttgggccctggacaaaccattcttcttatgtccccaaggacaccattgtgcagactacagggatgccattagatgccatgtgatggcagatacgagggaagtcctgaccctgtgtgcggctctgagtctaacctcagagaacgtgcatccccccctctctgtcctgacactcactcctgtgcaggaagaaaagaacactggaccagaagtcatggaatctggattttcatacttgtggtgtggttcagagcaattctcttacactttaagggtacacagtttctcagctataaaatagggctctgatttcagctctacaatgtattagagagagtgcgaggtgaagatgaaaagggacacttctcagggatattccattccttaaccatgggatgggaaagacagttctgaaagacatgttggaggctggccagggctttcagtgcaaataaccagtgtctcgtgtatcttcagctcagcccatgtgccctgtccagaaggttctagaaaggcagccatgcctgctgcccctgtgtatatttttccttccccagatctggcacacagtcatactaggctaagcctcatactcctggccctgtgcttttttttttttttttttttttttgtgagacaggatctcactctgttgtccaggctggagttgcagtggcacaattatagctcacgacagcctcgacctgctgggctcaagtgatcctcccacctcagcctcccaagtaactgggaccacaggcacgtgccaccacacttggctaaattttttattttttattttatagagacagggttttgccatgttgcctaagctggtcttgaacccctggcctcaagcaatcctctcacctcagcctcccacagtgctaggattaagggcatgagccacagcacccagcctctctgtcctcttgagatcgtatgctgcccaggaccgcaagattcacaggtgtaagtacccagccatacctgttggtgctcacaggtgtaagcacccggccgtactcatcggcactcacaggtgtaagcacccggccgtacccatcagcgctcacaggtgtaagcacccagccgtacccatcagcgctcacaggtgtaagcacccggccgtacccatcagcgctcacaggtgtaagcacacggctgtgcccatcggcgctcacaggtgtaagcacccggccatacccatcggcgctcataggtgtaagcacttggctgtactcattgatgtagcaggctgtgcatcccactggttctgagggtctttttcgctagactcccaggcaagcctggcccaccctctgccaagcctggatgtcactcagcaattcacaagcacttccagagcactcactgtattcagggcaccctttagctcatatagtcttcccaatgaccttaggaaggagatgctatttttatttccaatttacagatgaggaaagtcactagtccagaaaagtgaagcgacacaagcagcctggcttccaggcgtgtgctgctaacaacccactgctctgggaccccctccttccccatctgcagactcagcttccgtctgctgggcccctccctggctgcctcctacatactccccctgttaaccacctgatcaactcacatgcacggggagctaaagacggcatggtcctctttggggtgagggggctgtcatgtcaaatggactaggggagggctgctgcctcattcaaagggatgaatgaatgaatgaatgaatgaatgatgagatttcagatgagaccctcagacagggtcacccaccctcccaccttctccccacctgcactaggtcagtcctgcccatagattactttccttgtctggatgattcatgaatagacatatttaggaagccctcgaaactgaccagggatttcccagattgtggggaccccactcgatgagcacccagagggaaagttctgtgagttctggagtggtgggcagctcagggggtggggaggcagcccggccagaggagagcttcctccagctgttggctcccctgactcccaagaggacaaacccagagcatgagggtgcctttcactcctcagggctccccaggagagacaggggcacaggttttaaaaataccaaggagctttcctcctgggtcggcatttaccctgaactccaagagttatttctgagtcttcccagtaatttaattatagccatttattccaatgcatgtgttttggggaagccaaggtggcctctattacagtttggaatattttgggaggccttggtttccaaaagtgatgcagggactcaattaggcaagacaccagcaaacagaaataaaatagctcaagaagataggccctcaagttcccagaggcgatgcctgtacttagcacccacgggggaaattaagatgaagttgtcccctgggtgcttggtgtagtcatctctgtagcagcagcatatgccaccttctccatgtctctaagcacctgcagggatttcaatgcccttcaaattatgggctggatggggttgcccattctttccaagtaggcctggacagatgaacagcctgggcaccaggatttaggtcccccttgtaggtggacacagactcaccaacaacttgtgggatggcattatcaaacagcttctaacctttcaaataggcctttggaatcctcaactggttcgcgctccctgaccccctgctccttgtagatggcctgctccacctgccctcagctctgtccccacctaccctcccacccactgtcttcactcgctgtgctctccagaccccagtcttctcgctgttctttgaacaggcctgtctctgtcctgctcccaacactgaccagcccctgtacctcagtccctctcccttgcctcttgttcctgctggcctcctctgattctgcaggttctgctgactccttcctactcctccaccccttactattcatggcctcattcatcctcccttgatcctcttccctgaccttccctacagctgctgggcggggtccagcctgacacagactgagagctttccctgctgtgtgtgagctcctgggctcacctgaagcaggtgcggccactgagggacttagggaagggcagagggccggagagcatccagcacacacattcattcatgtctggagggcaagccccgggatcctgagtcacctcagcaggtggatagaggagcccaaaacagaagctgctgcctggagcccacattatctgcattgacacccgcctgcaggaatacgactgcccttgtgttggctttgaactctgtctttcagcttcaaggggaggatttggtggacaaaagatctaattttaggcttattacttgtcaggactgacattgaactcaagaaaagacatgtgtgaacttgaaacaaagatgagaaatgtttttagaaagagaaaatgtgttctggggtggtgtgcatgtttggtctggtggtctgtgtggccacagcaaacacgtgttccagactggctctgcatgtcagggagcagatggctcggcctggtcaccctgagcaggaagcttgctgcctttgagctgtgagctgcagccacggtgcaaagaggctgggcggaggctggggtgagacacttagagggcaggattctgactgtgccctgatattcaggagggctggcggtgctcagtcaggggtagggtaggaacagtgatcatcagggcctctttaggcagagcacacaaaggccaattccctcccaaggctccaccatcccaattcctgtcccaacgcccctcctaggatggcaggggagcctcggcgccctttccgggagacagccccggtgtattttgactgtgcttccttactctacaagcagtcaaggacagccaccttctgccttcccaccacccccttagggtgagaatgaggaggagctcccaccttcctctactctcatgcggccccttttgaccccagatttactgctcctgcatcccgttttgtgaactggtgtgtcagtggttgatctacccttaatggtaacccagggcatgttactttgcattttcacttgagccttcagtgattacccagagttaagagaatgatttagtttctggcacactgagaagctcccacgtgtgggaggtaggtgagggtgggtatatgtcatgttatttcaaggcagatttttttgctcctaagagcctaaaaccatcccacttgaggcaaacccacattttgcctctgactttgttgcctggaggtcatatcacaggagccacaccagggcccttattccagcctaatgtgtaggtggtcctttgagaatgctgagttgcctagacttcattcgagtcctgtcactagatatgtagcctcaagacatcccttcacctctttgaggcatgttgctcaactataaaatacgatatccaccttgtaagagtgttctgcagttcaaatgaggtgatgctcagaaaggaggtaaaatgccaagggcaacacaaacctgaggacttattgcctatatttgtgtttgaatcacacatgttcggtttatgtttatagttgtggatatgtacgtgtgcatgtgattgctttaggactctgctaatcatcatttccaatgataatttgctggaaatggagcttggcttggacgtttgtattggggttatctattgctgtgtaacaaatttctccaagacgtagagtttaaaacaacaaatatttattatgtcacccagtttccaagggtcaggaatccaggagcagtttaacagggttgtcctagctcaaagtcacccttgagagtgtagtcaaactgtcagccaggggtgtaggcatctgaaggcatgactggggctggagaaagcccaagcagttggagaacagcctccttcacaaggtggttggcagttctcagtttctcattagctgttggtcacaaggtggacctcttcatagggctgttcatgacatagcagctgacttgtcccagagtatgatccaagagagacagacaggaagacaagcagacagacagacaccaagatcgaagctgcagtatgctttgtaacctaatcttggaagtgacatgccatattctaccatattctgttggtcacatagactaaccttggtacagtgtgggaggggactttacagggatataaattccataaagtggggatcactggggacaatcttagaggctgactaccacaacccaccctctcattcccagtgactcacatgcaaaatagtctcacccctcccaatgtctcatttgattatagcatcagctccaagtccaaagtctcatcatctagatcatgttcagatgcagatgacgctctttgggtgtatctccttaagtacagcacctcaggtacagttcactcttgatctgtaggcctgagatttaaggaggcaagttagctgcacacacacacacacacacacacacacacacacacgtagccaacatacaattgtgggacaggcatagggtaacagccttagatacacttattcaagaagaggggaaacaagaagcacatagacattgttggtccatagcagttctgaaatccagccaggcagatattggaagtttcttgattagaactcagttctgttcctgcccaggaattattctacaaggctgtctccgccctctgcattcagggtctttcatgagattgcagcaagtcatgagcccagtgaatactctgggctcttggttctgcctctgagtcatccttccttttctatgaaaggtagcatgtctttgcagctgatttgttgctcagatagcttcctgctggtagaatttgggaggtccaagagcttctttatattttgtactgtgtctctcccttccagtccaagttgttgtgtttccactgaaataatcctttgaaaaactttatgggtcttctgtgatcctattgagtctgttccaccaaataaaagcccacccacacatctcttcaagaccatcccttctctccgctgggcttctgctgagggacaatgcccttaagcttcttagaagctctgttgtttgactgagaagatctttaacatctcttaaaatctttacagagcttttggtctgactgaatagtactctgaggcagcaccgctgaactttctaagatcttgacaaagacttcatagccacaccctccacctcatctttggactatgctttcctgagagtgcctggatttgatctttacgcagaagtcatttcctaattttagcatcatttgccatctggacagtctgggactcttcaaaactagcaagtcctggatttttttttattgtgacagcccttcttttaacttgtctctctcttctcacattttacctagcaagaagaaaccaggcagcccctgcaggaccctggctaaaaacttcttccttagataatgcaagtcattaagtacattttctgcttttcacatatctgtaggagacaatgttgctaaacattttggggctacataataaaaatcctccttcctctaattcccaataatatatttttcacctcccttaaagcccccatcaccagtctcctcaaagtccatatttctaccagtggtctcttcatggcatttgaagttttcactaagaatcaccccagaatgcttctggctccggcccactgcccagtaccaaagccactctcacattgcagagtttcactatggcagcaccctacttccaagtacccaaagctgtattagttatctcttgctgtgtaacaaattactccccaaatttagcagcttaaaataagcacttatgatctcacacagtttatgacggtcaagcatccagaagctatatagctggggagttctggctcagggtctctcgtgagattgtggtcaggctgttggccaggattgcggtcatctgacacttgactcagatgggactggaagagccacttcccagctcacggatgtggttgctggcaggccttggctcctcactggctgttggctggaggcttcatttccttgcaacgtgggcctctctgtagggtgctcatgacagagtgagtggcctgtgaaggagggagggggagagtgagagagagagagagagagagagaaggaaagagagagataagctgttggatcttttgtaacctggtctcaaagcaacataccatcccttctgccatattccattggtcacagactaaccgtgatgtggcaagggactaaacaagagtttgagtgtcaggaggtggggaccactgggagccacctttatctgttttgagttccttcctgtaccattgctttttccccccactttaaatgatctagtgaaactcaccggtagctttgaatgggttgagggtttttgtgtgttctgattcaacttcaaacctctctacaaatgccctcctcatcctgtcctcccctctgcgcttccatccttcctgcccatggcccctctccatggtggggcatcagtgaagacgcttcctgcctggggaagatttgaagccaggggatgctgttgccagaactttggaacacccctcttacccagggggtccagcagatagttctgggaaaaggaaactttccaagatacacacccacgttccccccaccaccactaccacacacacagacacacactcacacatgtaattattttcccttaaactctataatctcaatgattataaaaagtttgggctttaattggaagcgtattgaaatccttgcatctgtcagacactgacagagaaggcttccttgcttaggtgggaaaataacccaaatattaacaacacaaataaagatggctcccccagcctttctcacagcagccgccagtggtctgggaggcagtaggatgagagctggcgtccccatgagaagagtgagatcagcgagactcagaaaggtgatgcgatttactccaggccttgcagagctgaggctggtcccagacatccagacgtctggattcttttccacagggttctggaatgttggtcctgtggtggaaaacacgtgctcctttttcacccacttggggatccgtggtgatctggagttgtcttcctgtctggggagggtggtcctgcctcgggtagaggaccagatatggtgggggttcagaatgctgtggagagaagtccctcagaaacggaaatattttggcaggcatgaggaaagattgtgagggagcacccagtggtgggacagtggcgatggacagaagaggactcctgttaatccgctctttccaatccacccagatgcccttccctgcattttgaggcatccctgggaggactgcctcaggaggcttcacctccaggtggagtctcaggtgaagtaatagtagccggctttgtccacagctgtgctgcccagcgcagtcaccacgagctgcctgtggtgatttacacccattacaattaaataaagccacaagttcagttctgcagtcatattggccacattcagggctagccacatgtggtgaagggcctccacagtgtgaggggcccccgaggtgtgaggggctcctgtggtgtgaggagcccccgaagtgtgaggggcctccgcggtgtgaggggcccccgcagtgtgagggcctcctggggtgtgaggggcccctgaggtgtgaggggcttctgcggtgtgaggggcccctgcggtgtgaggggctcctgctgtgtgaggggcccctgcggtgtgaggggctcctgctgtgtgaggggcttccacggtgtgtggggcccctgcgctgtgaggggcccctgtggtgtgaggggcttccgcggtgtgaggggcttccgcggtgtgaggggcttctgcggtgtgaggggcttctgcggtgtgaggggcccctgtggtgtgaggggcttctgctgtgtgaggggcttctgcggtgtgaggggcccctgtggtgtgaggggcttctgctgtgtgaggggctcctgcggtgtgaggggcccctgtggtgtgaggggcttctgcggtgtgaggggcttctgcggtgtgaggagcccctgaggtgtgaggggcttccgcggtgtgaggggcttccgtggtgtgaggagcccccgcagcttgaggggcccccacgatgaacgcagtgtgaagggccccctgtggtgtgaggggcctctggcagtgtgaggggcttccgtggtgtgagggacccccgcagcatgaggggcctcccgcagtgtgaggggcttccacagtggaccatgctgctctaggacgttttcatcatggcaaaaatcctgtcagatgaccctgctctggggaaactctcccagcccagagaggcaggcatggggcagttgggggagaagagaaaagtggagaaccatttggaagggtctgggggccagggaaaaggcatgaggatgagaaagaagaagctgagaaagagaaggggtgctcatggagcagtgtgtggcccctttgggtgctcaggaaatggtcattcctctttgatctggggctcagagaggcagacagtgcctaccctgttggggtttaaaacccacaagggaggaccacctcctgcagcaccttctctcaaaagctccaggcccactctgcagaccaccaggacccccaagagctgtgcagcctcaccagcagctgatgggcatcactgggagggagtagagaaggctcattatgatggtcaattcaggacaaatcctttggaatagggagagatgcctggaagcttctggagaatggagaggtccccatttcctaacccaccattggtcctttgtcaccatattccccaccctctatgcctgagtggaactccgttaaccctctcattcctggagaactgcacaaaccacatctcaacaatgtcttcccagtggccacctaactcagcttagggacctagtaagggcttggtttgtctgtgataagtgaaaggtgtgtggatggatgggatttcttcaaagtcttatatggaaattatccatataaaccactgaataaagaagacctctttagtttttagcgggttgggaccagaaacccaatggtcccttaccactgcagtgacttcattcccgcttattataacagcaattattgaagctgctttttatgggacacctcctaggctgtgcattctatctggattaggggtcagcaaagttttctacaaaggaccagagaataaatctttcaggttttgcaggccatagggtctctatcataactcctcagctctgccattgtagcacagaagcagttatagaaatatataaatgaatgaaagtgactgcttgccaataaaactctgtttccataaccagatagcggctccattcggcccacaggccaccattggccaattcttgttgtaggttatcatgaatcttccaacaccccgaagagaatgaagtttccattcctaccttacagccgaggagaccatgctgcagcagtgcattcacctggccgccgggctcacatgccttttgaggcagacctaggcctatccaagcaggactcccattccctggggtacgttttgatgtggaactgcagaaggccttgccagaggctgccacgggagacctcaggattcggggtacccaggagtagccagtgatgcctcaggggtaacagaagaacctggaaggctgtaggaaaaatagaagcctgtttcccctgcttcactgaggttgtaaggcaaccccgagaaggcagaaggggaccagcagggcagtgcacacccaggagacagctcttaccttgatgacggggctgaccagccggacactgccctgcttggaccttttttatgcccaccacagggcaaccactgcctccagcatcccccctggagaagctgctgcaaagccgtccccttctatgggagccacagcttgaagctaaaacaagagcccaaagcatcttcaggtgtaagaagaggtctctttctttcttgttctcggcagcccatccttccccagctccttctggacatgaggtttcttgttaccctcttcaagttcctttggctcgcagcattgcctctcctccagacaatatggcctggccagtgtgacctgctcctgtatgccctccagccctccccagccatgccacggagggacagagctgtccagatcccagccagggtctccaatttgtgcaaggcaggaggaggcacatgtcactgatgtgagagctgtctaagggtttcattcattcgcgttttcaatagaggccgtggtgtgccttgcagatatttgatctacatcaccataatcagacaagattgggcatgttcagggtggtgtggctgtagacaacatcaccatcatcagaaaaagaaggaggaggaggagcgttattttgagaggcatcgggggcctggttgcctggactttcatcattagtgcatgcttatttgggttaaaaattcataatccctgtggtcccttccaaagcgtagctgccctggggaggcagtatcccaaggcactcggacacctctgtcactaactttttcaagtttgtggattatagataagggaggaggcgaggaggggccgagagggaagtgggaaactgtgtgggagggggtgggtgctcagagtggaagtgaagatcaagctgagtcctctaatgatggtgctgggcccctgcctgtctcttctgggagtcactgcctccatgtgcattaaccctgcagatccagccgcagcctgagtgttgaatagggctagctgagctctttgctgaccactgtctccagtggaaaccactgagtgcagggtcaggagtggggtgctctcagacactgatggagccatgcccaagacccagggaacatcctgtggctggggaggagttacagggaaacagattgtcgggcaagggtctctggcccccctccctggcagtcgagggcacaccagtgtctggagacagtgtgggtgctgagctggcacatccaccacagagcaactaggattattgaggagaaggaggaaaattatctgagcccacctagggttttcatttgcagcccgtgatgaagtcagctggccaagaggtcagcttcaggccacgcctgtggggaccctcctggctcttcacactcagctcccaccagcccaccccagagtgcttgctcccaactcaccctcgcagcccttccccctggaaatcataactaagccctcccttcccccagtctctcagggctgtctcagaactaagctttccagccggagaatgctcggagcatttcagcaggggtcttcattctcaaggaggcgggtacaatttggggctcaataaaagggatatttgaaaataaagctgggcatccacccagcaaagccagttggcaatgccatgagggacgctgtgttcttctaactctgctaagcctgccctgtgagccgtggctcaaacccagcatgggaacttcctgtaggggaagaggccaggctgtttggaaaagagacctcgagtccccacccacttcccctgggacaaggagtggggagaccctcggctgcaccttctgtcccccacccccagcattgctgtggtcagagataataccaggttagctacattaaaattatttgggctgggctcagtggctcacgcctgtaatcctagcactttgggatgccgaggcaggtggatcacttgaggccaggagttcaagacaggcttggccaacatggtgaaaccccgtctctactaaaaatacaaaaattagccgggtttggtggcacaggcatgtagtccccgctactcgggaggctgaggcaggagaatcgctagaacgcgggaggcagaggttgcagtgagccaagattgcaccactgcactctagcctgggtgacagagtgagtgagactctgtctcaaaaaataaaataaaattatttgaatcccaggattcattggggttcatttgcatcctgttcatcatcacggcaacattctgggagagaaagggaagacttccaagaggctgaatcactttgcagtgttgacctcacccacctcatgaccccagggtggtgggagcaatgcccttcaccagcccctgtatggataggaagcaggggctggagaggaggttttggtcaggaagggaggctctgtgaatgcttctcgcaagcctagactgagccaggcattagaggagcatcccgtctagttggagtgaggtgattaagatatactgaacaatttacacttaatatcatattgctgtgtgtgtactcctgtgtacatatacatatatggtatatatgcacatgtgtgtttatatgcatttatatgcacacatgtatgcatgcatattgcatgtgtgcaatatgtgtacaagtatgtatatgcatgtgttatgtgcctatgcatatgtgcatgtatgtccagtttgtgtgcgtgtgtgtgtgtgtgtgtgtgatggcacagtgcagcccataaggccctgtaacttcagagaaaggaaaggctttgcagtttagagtagccaagaagccttcctggaggaggtggaacctgatccgtctctgcaatggggccagcagagggcaaggggagagcattcctgataagtgactgagcagagacaaaggcccagaggtaggagcagagaacactgttaggaaagaggccaagccagggaggaaggtgtgagaagccagtgaagaattagagccagtgcgccaattcttcactgcatctgtggctgcatctttggatgtcttgcatgcagatgtacaggcagcaagtccaagagagcgtgttgctggagggacagccggcgcacaggcacgtggcaggaagcacgtggcaggtggaggatgtggaggaagcaagtgcatgcttgagagaaggagactggaagactggaagctaaaaggggaaagagggaaggaggtgaggacagggtgtttgaacagattctgtatctccaagtgtccagtggagccttggattttgtcttgagtcccagagcccagttcctacccatttagttggagtcttgaggattcttgccagtgattaagtttcccccatcaaaataggctatgatggagacttgagattcccttacccaaaggtgcctgggtctggtgagaaggaggaggcgctcccattccatctccagtcctccctgcgagctgcagccatcaatctgggacagagatactaaacactccgtaaatgtttgtggatggcctcttggggagggctgggctggttgtgatcctgtatgtcatgggaagcggaggagttggaaagggcacacccgggtggtctggtggttaggatggccccgttcctgggaatggttgccacgaagcattttccctggcttctccatagaagcgactgttccttcccggagtgttatgaaaacctgcaattaccaagccgcctctgggtgcgagcattcagacctcctcttctttcttccaagatacactgagtcaagacctggtcagtgcagaaagcgggttcctctcccacattccgtcccgcatagccccatggggctgtggttaatgagcttggtgattatgtatttcatgtctgggatgaggaaggtgaagggcttgagtgaatgcctgtgcctctccaagttctggagcaagctgccttctgcactcggcatgctctgggaccactcagcagataccaccatgtctctggggtttggggtccccttcttcctccagctgcactgagtggaagccagagctgtgcatagaagctgggagaggactcaagcaggaatgtgcaatgcagggcttcatggaacgctccacccagactgccgccttgggatgcccagagtttagctctatcctgttcctccgatgattttccttctgggcatatatatttcctggcctcttgcctttgcatgtgtgagtcgtgatgggggttgggggaagaaggaaaaacatatagaatgggtggctccagacttgaaattttcacagtggaagagagaataaaagcaactcttgtgggtcaggaagtttctggacctgccgcgccatggccagtgagcccctaggccccacatggccctcctggggaagctgacattggcccggcctcaggcgggcaaaacataaggagcctcctgtcagggcaggccaggcacgggggcatggcctcttttttcctgggagagcagtcacccctctgtcacctgaccagctgcccagtcacttgctgctgcactcacgttcacacagccgtgaactccctagaactgcatctgctcaaactgctgcttgacccctgctttgcatgctttcttctgcctcctgctcacagtcctgtctccctgattctccacatggctccatgtcacccagcagtcctgtgccccactgctgtgcagagaagccagtgatggcccctgcatgatgagagactcctgtgtctacatccttcctccaaggagaagttggctagttctgtggcttggccgggagtgggtttgggtcagcttctgcacagtgtccattttaaggccaatggtcaacatcttgtccaaggtcctcattttgcagcaagagctgggctccccaaggtgggacccttgccattagtagagcctgactcctaagtctccagctcctgccctggtgctgctcccagcatctcacaagaccccactctgtcacgaagaagcagtgaggtcatgatgttcagaagaggaagaaaccacaaaatagcctattctcttgcaagctgctgcacatggaattctaggggctctttgccccttacccagagtggtaggccttgctggaaagcagaattgaaccaccttggaacaggcaatttttagaaatcaatcagatggatcaattcattaaaaaaggtcattcctaaaaatcaaaagcagaaggaaatacatgaaccttactaatgttaactgaaaaaaaaaagcaaagtaagaaaaagtatatgtagtatgctactgtttctctctgaaaagacagatagaaatatatattcctgcttacttatattaacgataatgaatggatgggtaaacataaaaccagtaaagtggttatttatgggacacaggggagttagtagcactagatatctctgaacaccctgttttgcagatctgaccttacaaccatgttaaatgtttcacataattgtaagtagaagttagattgatacaaaaacaaaccttttgctatgcctgagagggcaggcacctgcatgagctaaggcatccagaccggctccttgggtagcagagggtcccccagccttctcaacatcccacggtggggtgtctaatacacttctcaaagttgcatttccaaaaccaagcttccatctgccccaagcctgccccactccctctgtcttccccatctcagacaacacagcttcatccttcttgcagtcgctgaggccagacaccttgcagacattcttgactccagcccttctctccacccgcagtggaccatcagcagttcctgcgggtcccatcttcaaagcagatccaggatctccacctcttactccctctactcctgcccgctgggccaaggcagtgtgggctctcaccgggattactcctataacattactatctttgatctcacctttttcaatgtcatttcttagctcagaaccctccagtggttcccaatttcatccagataagggccaaagtcctttcaatggtctgcaaggccccagatgatctagctctcaccacctctctgacctcaccatctgccctcccccttcacactctgcactcccgccaccctgccttcctgggtgccagaagttccacctcggggactttgcactggctgttccccctccccggattgctcttctcctgggtatttgcatggcttctccctcccctccctcaagccttggctgctccatgtcaccttctcagggaggcctgtcttaaccattccacctaaaaaggcagtctccaccaggggtgcccccaccatacaccagcattcccagttcttccagcttcccacttccgtaggccttcccacgctctggcattctccatggtgcatttgttctgtttatcttctgcatctccccgctgggtgatgagctgagcctggcatgagtaaatgctcactaaaccactgtcgagtaagtgaatgaatggacaagaaggtagccagccctgctcaaaagcacttactttatcctctcagggcctttcagcacctcgcttagggacctgcccagctccttgggctacctcccatcctgcagttcccctcctgagaccagacataagacaccccaggaagtcttagcctcagagtccagatttgaagcagaaggaaaggtcagctcccactgtccaccctgaatagctggtccccctgtctctaagtcttctcccacctcccagggcctgtgacattgcagagatgtgagtgtcctcatctgggtgggagtcattactcttcatactccccatcaccagtgggacagccaagattcctcccggcataggagccttcaggacagagcagagggagttgtggggcagagttagcacaggccacagtgggttattgagggaaactggggtgtcagaaggacagacctaacccccaagctggatgtcaggcaaatgcactcccgtgtcgtggcccatgacgcctttgtgaaggacggaacccctgcctgatgggccactgcggggaggttttcagttggacttgacggcccttcactcacctggtggggtgtggtgggacgcgccacagtacaaaccctgctctggccctggctctgcccttgctcactctctggcctgtggacgaacctctctgcctcttcccagtcacttcatctttgaagagactgtcatcaccgccactcacagggcagcagtggagactgagtgagcctgtgctgagggtgctgcacccatactgggtggttagcatttcaaaatggcggcccggcagattggcccttggcggggcccttcccaggggccactggaagctgagaggcctgtggggcacagctctgtcatacgttgtggtttcaaagctcacaaattcctttagtaattcctctgctctggaatcataggagggagttgtgctggtagttggaatatttacccgtcggctcctctccctcccgtcttcctccctttccctggatgtctgcctggccatctgcagtggcccaggtgaccttctgcttatgtgctgtggggtctaccaggctattgcatttaataaactcttaagagcatgtctcctgtgtttgaaggactctacaaatatcaatgcacattgtcagtacaaccaccctttaaggtaggtgctattatgttcacatcttacaggtgagagaagtgaggcagagagcagttctgtaacttgcctggggttatacagcaagtcagaggcaaagccagggcctggatgcaggcaggctgccatagagtccaggctcgggcaattccccttctttctctctctgctcagccccttgggacctctcttggcagcctgtgacccagccgtagccctgcccctgaagcccagttctgaccatccagcttccaaactaagagatggccccctgtagccaggttcctgcccttccccctaccatcgacctccagagtcctccaaaacctggcccaacctaactttccagaacctcttcctgcaaccccaccctcactggccatgcacctggtgtctccatcggctgggcctccgtactctctgaccatgcctgggccttccctgctggactgtcctttctccagaaacctcacccaggctgcaagtcccagatctgctcttagcagaatggtcagggtgagactggtgttcctcagtttactctggcagttttatgcctgaggaccaggagcaagaagtattttatatccatcactcaggatgtcctgggctactcaggccttgcccttgtcctgccttgactgtcacctcttcccccaccacgcaccttgttcttttgtgtccccagggagcagagatgctctggctttggaaggagtggactccagctcctgggacctctgcctacccgtggtcaactcattaaaaccattaaaaaaattcctcatgggttctagaaatattacagtgttttatttgtaatatttatctagccctgcatgccccgaccctgccaagtccagaaatatagcatcgtggttaagagtgtaggctctcctcagcttccagctttctagctgtgtgacctggggcaagttacttcacttctttatgcctgtttcatcagctataaaatgaggacaataatgccactgtctaccccatagaattgtggtgatgattgaataagcacatttgtgttcttagaatagtgccttggacagagaaagcaccatgcacgtcattcattatcatggtggttgttgttattattgttagagaagagaactggggcccagagaggtgtttcctctaagccagtgtcacacagctaacagccacaggttggagtggagccagcagcctgcctctccagccagggtctgctctttactctgcccccgccccccctccttggtacatgttgccaggcagtgggtactccgtgagcttaaaatacccaggtgctaccctaccccaccctgtgtcctgccagctctgccagcactgacctggcccactccatcagccaagtgaccagggcttttttttttttttttttttgaggcggagtcttgttctgtcatccaggcttggagtgcagtgttgcagtctcggctcactgcaacctccgccccccaggttcaagtattcttctgcctcagcctcctgaagagctgggattacaggcatataccaccatgcctggctaatttttttgtatttttagtagggatgagattttgccatgttggccaggctggtctcaaactcctgacctcaggtgatcctcctgccttggcctcccaacctgctgggattacaggtatgaaccaccatgcccggccgaccaaggccatctttaagaggcctggctcagtttcccacccaaaagaagtggacttatggggctgagagcctcccactctgctgtcctctcgtcatcttcatcttcccttgggccacactcagcacaagaagggagcacagggcgcctcccggggaacagagagccagcgagtgccactgggaccaagggcttgacacctgcctccttgtcccccagctcagaaaccacttaccagggctcctgacccacagcaaaaatctaaacattcatttccagtggagctcaataccatctgcagaaagccaggcaggggcagaagaacaggatgtggtccctgcctgcctccagggatgagctgtggacataggccataaacaaggagacatttactctcaacactaggaaaaggtcctgggacagacagggcttttctcatgggccagggtgaccaggaccgtttcccgaaggagacaacacacgagctcctcaagaaccaagagaagatgtgttgaggcaaagatgagtggggtgggagttcctgcaggggaatggcgtgggtgctcataggggaaaagaaaggagcagggcaggttacagcacagtgtgcagggtgccccgggattcttctcaagtcttgaggctccccagagggcaagcagaggaatccaaacccttgtggatgctccccaaaggggctgcagacccgcctctaagaggctgaacctgccacaggaaccgtagcaatgccagaggaggcaccttctgcattcgggcctccttggttcacacgcagacagcgagagcaccatgcccagagtcctgacttatcactgctgccatttcccgagtgagtgatgacagcagcagcgggatcaacttattgagccttgctctgtgtcagagccaaggcgcagctcatttaaccctcagaagccagtgcaatagactttatcatcattatttcacaaatggagaaactgaggcatggacagtaagcaccttgcccaggggcccatgctagaaagtaactgggtccagagtctgtctgggtccagtgtctggctctccctgcttctgccaggggtattggggtgttttttcatctttaaacagtgcagtgtgagtccttgcctatggtcatggggtgagcatcggggcttcacggagatgggagcagcacacccaggacttggcccctccaccagtctatcactcagcagcccagagagccactctggtggttttgcccattacacattttaaattatttttattcttagtcaaatatttaattttttacccataatggacagttggttaaaggcaggaagcattaaagaacactgatattaaaaggctggttcatgaggaacacgtaagtggtaataattctgcacatatgcctcagggtgctctggccggatctgcaagcctcattcatctggtcagagttctcgtgtggcagctcctgcagcttgcagagcttcacaaccccgggctggaggcagacagagcccaacacccatctgactctgtgtccacacggagccaaggccctcctcactcacgtcgtgcaatttggacagaagcacttcctaaaaactctcgggtctcagcatttagaaacaaagcaagaatattacaaaatcaaaccagttgactttcatttttttagaaaaacataaaattcaagaattccaaacagcgggccatgaaatcagtttttgctttttgtttctttttatgccttatatagtcaaactttagcctgcagtttagtgtgtactgatgccaaagccacagtgtaatggtaatatgtcattttgaaatttctttgtagaaaatcatgcttttgcttttacaactcgtttacaataaatgaagaagaatgcatcacttgataattggcagaaggctaaattttgcctgtattcataaatgttattaaagatcgggttaaacacaaaccttgtaattcacttccaataacatatcaatctaaaaactgtatttgacataaaataacttctttatctggtagtaccaaaaataacaattttttttttaacacttaagagtgtttccaagagaaactattatggtgagaggaattctcaaatcccaaagagtcaagcaagattcagctgtggcagccctctaaactgccccagttttcatgaaggtaaaaataagaataatgagaattcatccttttccctcccgttgaggggctaagtctcctggtaagtgccttataggcccacccctgagaggaggggcgtactttgagaaatttgaccacaagtgctttccagaaggtcaaactgacttgcttatggtgagtgctggtacacaggccctcccaagttccccaagatgtgggagggtttggccacccttcagactgtgcccagacactcaagttccattagggattctattggttccaagtacacagatgcacaatgagctctgtgttcaaccctggtagcgccatcctacggtgaggggtctctgcagtttcacctcctgctaggtgcagcaggacccccttgtgtcaattttattgtatttcatttggtttgcctggtgcgtaagaaattgacttaagaaaaattgccaccaagcctttgttgagattggcatttcttctcgaatggcctcttccctcctcccttttaactaaatcctgcttatttttaaaaacttttgattctgacaaaatttcagactctcagaaaagttgcaggaatagtacaaagaattcttatatatccatcacccagtttcctgtgatgttaacattttatccttctctctctcgtatacatttttttctgacccgtctgaaagtaagttgccaaaatgatgcccttttactgctaaatatttcacagtgtgtttctttaaaacaaagactttttttcataaccacaatacaattctcaaaatcaggaaactgatatagatacgatactgtaattgagtctgtagaccttattcatatttctccagcgatcgatcctagactgtgggctgcattcgattgtcatgacttgttagtatcttttatcctggggcagttctttcttcttctttttttttttttcttttgaggtggagtctcacgctgttgcccaggctggagtgcagtggcgcaatcttggctcactgcaagctccgcctcccggattcatgccattctcctgcctcagccttcccagcagctgggactataggtgcacaccaccacacccggctaattttttgtatttttagtagagacagggtttcaccgtgttagctaggatggtctcgatctcctgaccatgtgatccgcctgcctcggcctcccaaagtgctgggattacaggcatgagccactgtgcccagccaacctggggcagttcttaagtctctgtatttcatgacattggcctttttttaaagagtgaccagttatttttgtagaaggtccctcagcgtcggtttctctggcatttcttcatgattggacttgggttataggcactgtagtgatgtgaccttcccagtgcaccatgtcaggaggtacgtgctgttctttaatcccctgcctggtgatgttaactatgattacctggcaaaggtggtgactgccaagtttctccactgtaaagttacaagttttccctttgtaattaagaaatatctttggggagatatttagaggctacgccaatgttctgtttttcttcaaaactttcatccactgacttccattgatgattcttgcttgaaacaattgttcttatggtggttgccaaatgattttctaattccatcattccttctaaatgtactagttgtcttttatcataagggaaagcctttcattgacttttaactcactgctctaagcctcaggacctcagcatttgggaactaggagagcaggtccttgtcccagaatacacgggctgtctcctagctgagtggtgtttaatgtgaaggttatcagcgtcctgctacaagtcccttgtattttggaaggttctagacaaagaaactatctgctggggagccatgtcccaagatggctgggctgggggttccactatgcatgaagccttgaggagtcctctctgtgataacgtctcaccatggccccatcagttccaccagccctggctcaaaaacgtggcccaggggaggccctactccagctaactccgtttcacatttcctctccttcccaggatggaaaaacagcccttcagggacaagcgaacctgtcagtaattaagtcatgagtggaggaggcagtcccagaagggtggctgggctgtgaggcctaatggagtgaggcggctggcggcgttctccgccaagagcctggaggctccacagcccaggaagcccaaccggctcctctgtgtcccatctgtggggccatctttgcttcacgtaggggcctttccccaagaagggctggacaaggtttatcatcatcctgtggtcagcacttttagcttgggctgttacctgttttccagcccccaggcacacccatgacacctgcctgctctcagaggtgccccaggctccacactttccctcttgaaaagtgtctctcttgtgctgccctcctctgagatgcttatgtttgggacaccagggtcacagcttgctggcctgatgaagtactccgtgcatactgattgaagtgagaacgtgtggggagggtcttgatggatggggaagatcaggcgcagggacaagcagatgcggcactatgatggtggcaccacctctctagctcttgcctggtagacaggaggtccaggctggccaggaggagtcaggaattaggtgagagggagcattgtcaccaaaggtttcaggtcagagcgtggcaagatgatagtcacggccacatagcaggatggaggggagaggcctcagtgtggcatggtctcttcatccagaaacagagactttgaaggtctgggtcaaaaatgccaagtccagccccctggcccctgacccaggagggagctgagttcccctgcagtcttagggggatcctcccatccccactacttctctgtctccatcccacctgcaaccactgctggtgtctctactcttctcctttttaagggtattcctctcagttatgtgggtccttccactacctcacgtcctccaggaagccctccctaacctcaccccgagaactcaccagaccccatgtctcgccacatgctgtcgtagatggttctttgagtagacatagcaattttgccgctagattttaagatccccaagggcgggaaccatatgttatgttgctttgtggctacctgagccccgacacgtaacaaatacaccagagtttgatcagattttaggattgcaaaggaagactccaaagctggtatgtggctctacccagatctcaggggagaggccagcctgagaagcaatattcttcattcgttagctcaaacgtggttttcaatgaatcaagaataaactatgatggatgaggaagccaccatcggccagcttgccaactggtgctgagcctccagcgccccatcttctgccccagcaagctccccagtaggttcctggctaagaaacttgggaaaccccagtaggcaggcttgcatggagggcctgtagccagaagtagagaggtacgctgggcaggggaagggcctgcactggagccaacagggtggcggcccacatgcagctcaggccactgaggcatgttcattgtcctagggaagctcccgacaacttggagtcctggggtcactactcagtttcatgcccaggccttgaagtgaaacacttcattcagaaagtttaggagaagagaaattggcttgttcaagaggattttgctaccaggggctgcggctcacacttgtaatcccagcgctctgagaggccaaggtagaaggattgcttcagcccaggagttcaagaccagcatgggcaacatagcaaaactcctgtctctacaaaaattaaaaaaaaaaaaaaaaattagccagtcatgatgtcacgagcctgtagtcctcgctacttgggacgctgaggtgggaggatcacctgagccctggaggtcaaggttgcatgaactgtgatcatgccactgcactccagcctgggtaacagagcaaaaaccaaaaccctgactctaagaaataataataattattattattattatttaacaaaaaaaaggaggtttttgtcatcagctgcaagtcacccccattgacggccaaagtaatggagaaagcagccctttccaccagtcccaagatggactttgacgaattaaaatgcccaatcctttgcattttctcagctattcctactagattattttaaatagcagtgaggaagttcttctagaagagcgcagatgggtcagtctcttggagtgaagagcataggggcgagacgggggttcgggccctggtcctggatgggctttctgctcaacctctcccaagggggaaaggctcccctagggttgctgtgaggatcaagggtgagcatgtgtgcccccagcaggtgggggccactcagtgtttgttaaatctgagtaccatggtgacttgggatgaagggagggagggaaggagggagggataatgatggtgctaaattgagtatcactatacctttactccaccttcactccagccctgagagtggaaggaaagccagaagcctagaggtgtgggacagcatgggataatggaggcaggcccattccctgggaaggcacctcccgaagatcagcgcaccccatcctcacagctaccatgtgcatagctgttgtgaggtccgtttgattgataagataacagaggggcagagaagttaagtgacttgtccaagaccacccagctagaccaaggcaaaaccagcatatgaacccaagggtgtccagctttcaagtttttaccacatcaggctttctctccagatgagaacttcttagagggctgctgaggtccaggagggcttcctggatgaggtgctggttgcagaatgggcaacagctaactagtgaggtatagggcactgcagtttctaactgttggtcagtgatcagacacctcccatgacaggaagctcaccatgtccccagacagacccctctgttgcggggcagccctccccatgagaaagttccttcattaagtgagcccaggctgcatctctgcatctctgagccttccctccactggccccttctccccagccctcttttattagacaggctccatgattggtcgcacctgggattttaaataacttttaggcgactttctgtccatgtgccttcctcttggtcctagcttttctagtttaagggctgttccaccacaccaaggtggtaagattaaaacaggcaaggaaagagtgacttccgggagagcaacttccaggtcaatcaactcgtagggtgagtgagacagcagagggccagctaaggcccatcagccagggtgccgaggccagctgtggtggattcgaatggccaggctttgggctggggataaaggaagtcactgaaggtggaccccaagctgcgaggaccccatcacagtatttccctcgggatgatggtagtgaatgttgggtgatgaagactttcatggtgggaaactatgcccaaagctcagcccttagagcccaaaatcagaacagaagccaggcatcctgaggtctcttccttgacctaacatttgaaacagcccctgtcttcccatctgtactatgggtgcacagtgtgatccctccctctgcatagctggaggattcatgctctgttgcttggaaaacccatggcataataatattacaaacaaacactaatatagcacttgtatcaagtcctttaaaactcacaagaaccctatgagatgggtgttctatttgttcccattttataggggaagaagctaaggcacagagcagttaaggaacttgcccaaagttgcacagctaaaagtgtagcgtcaggatttgaactctggggatctggctccaaagtccacacttcaaactaccacgaactactgtgaagctcgggggatgcccagagccaccagcaggctgtagtgagggtccatgggccggatctgggagactgcagggcttggcaggccgagcggaagggcgagggccttcccctggaaacactccaccaggttcacgcggagcctggcgactccccagggcagccgcgtgctcttcccatgacatcacactgcctcagaacttttgaggctgaggattcttggaatgctggattcaccctggaacaaaaataatacctcgtattcataacgtgcttttgttccccacaggctttcctgggcttcatttcattgtagcctcagactagccttgtgatccaggcaggagtcctgtaggtgggaggccaccctaagaacctgagtcggggttggtctccccattctgcaggtgggcatactgagccacggggagttgagtggttggccaaagctgcacagcaaactggttctgggcaatgtgggccaagagccctggatttccagtggggttgaggggaggcctcagaaatgggtccgcagttgagtgaagctcagaaccccatagagtatccccaagaaagcctttttcccttggccttctgtgctgccgcaagatggaggaaggtggcaggagtctgcacgctttcctcccttccccacgaggcagcaatgaagccagaggggccacccgaaaaacaatccccgagccctgccccacaggccccagccacaggaaccagcagactgtggtgggaaagggctgttcccagcacagatggaaaccaagggctgcagtggcttctgtggttttcccgagacgcagtggagccaaggctggctggccggatctccaaccctcccatccagagccctcccaggctctcccctcaccagccccggcctccccattcccagcgggccctggctcagccctccgcctttgcttctgcaccacacgctgccataggacagcccacagctccctccttgctgactttggctgaggcctgtggtcctctgaatttgggtttagtggctcagcaatggtgtgcaagctgccctacactctcagaacactcagtgtggtggctgagggcacacattcggggccaaactatataagttcaaacccaggctctgcttggtgcaagttgtgtgtccttgggcaagtttcttaccctttctgtgccttgaagacctctctggaaaatggagtgaacaatagttcctctcttggggttgaacgaaagccatgcctggcttactgtaactgcttcctacatgctagctatgaaccattcttctgcatccctgtgatgtgagtttgagtcctgtggcctcaggaccaccctcagagtgtgtgaactgcccgagtccagggcctgcgtttggtttatgctccaatatggctgtcttgactttctcaatagcttttgaaccaggggcccacattttcatcttgcactgggttccgctcattatgtggccagtcctgcctccaggccagagtagaacataggcctgtgctgctctctgcttcctttccttcgtgattcttgtcctgggataaagctagagacctgtttctgtaactaatagattcacatctgtctctccaaatggaccctcagcttcatgaaggcagcagccctgtgcgctggagtcatcgctacctcccctccccagaccacaaggaagatagagagaaggttctgcctcatctgaaggaagtggatgctttgggagcagttcagaggcacacacaagacactctggtggcagagacgtgggtgtgatgtagggcattccagactgtaatcatatcaggagtctggagggctcgggcaggaccctgggagctggggaaggctcctgctcaggtctggaccttaagacctggataggattaggggagtgctgaaggactctgtagggacagctgaacagctttgtcacacaaacaccctgcctccaccccaacttctctcagagggctgcaggagctatgtggcctcaggcaaacccactgacatctctgattaacctctgggcagaacagagtctcagcatgtgtttaattaatgaaacaataatgaaccagcctttctctgcatcatttattattcattcattcattcattcattcattcattcattcattctacagttagtgagaaaagtctttgcctgtagggtgcagaggtaccaatcagacctttcatctattccagagcatcgtttggcgaggtaaacatctgatttctaaagcttttagtccatgcagtgagctaccacacttcttacatgaacttttgcctaggctggcaaagacctcaatcttgaattgttttctacccaactctgagcaaagagagccacaaaatctattggagtgggggagtctgcagcttggctggccgcccacggtggcaggagtgtttctgatgcatgctggccctctcctctcagcgttgttaggagggagtgctcaggaagtagctggcccagtgctgctgttgccgccatcatgataatgatggctctggcaattacagggcccgtgtgttgcctaagctttgtagcgatgcccccagttctccaaagagcactgagatctccaataagtaattgttaaatccagtcatatggcgtgttacagcaaaaacacaaatctgagttccagtgagggctttgccactaactagcggggcgaccctagaaggacaaagcaacctctctggaccttggttttctcatccgtcatgctgtgactcatgtaatccttacaactgcccctcaggtggggactggcacatctggaaacagagacacagagaggtgagatcacccagcccatgcaactgtgagtggcacagtgccaggctctgtgcaggctgccataccccagacagacctggcaaggagtgtcctgcgggggacacccatcatccgaatcagccctgcgcgcaccatgggtgctccgttagtataggtcactgtgatccttgtctctgagtgttcatcagccaataccatgatgtcccttggttgactccctcatgagggaagaaaacctcccctcccttatacttttcctttttaagcttccccatcattctgcaaactggggtgggtgtgtgtggcgacttttgttcctgggtcctatatgccatcgctcgactaagcagcccctgagctgcagagaaattgttggtgcctgtgcctccgagcctcaccgcaacccttgcgttgtcccaggtgactgggccagggcaggcagagctcactcagggcatgtgtaggtgggcaggagtggaggtgcctacgctggtaataagcagtcatcacttttcctgaaggcaagaaatatgagcccatgcatagttttaaaaccacttgccctaggaattttgctttcagaaatttttaagcagacctacaaattatgtggtaaaatgtccgacatggagagaaccataataagtcagtggcactcagaatatctagttgggaacgattatgaaataaaaaacgaacagagggacatttgtctccatttggactgctgttaaaaccatttttttaaacaaaatttgaagttattctccctacacccacctcccaaaatgcagctgtggtgttccgagaacatttttgtctttttgtataaaagagagcagtcttagagtaaaacaagacatctgatttcagaacccaaagaataaagaataaactaaatgaacgatggaaaaagcataaaccgacaatttccattctccaaaaaaaaaaagcattattttcctaacagcaggtgttgccagtagcacaaatggaatattaatcttatctcctgtgctgttcttcctcacccgaagaagacttccccagaaataaagaggcagagagttgggtttttgcccttcttacttgcagggctgcaaaactgggtgtccagtatgtttcccaacccaggacccacatgtccatgtgtctgagaccaagtgcagcctccttgccgggttgctgggagcaaaagcggctcatccctggcccagccaaaccccaaacccgcaggtttcgtggggagcagccagctggcccctgaatgaaggtatcgacgaaacccagcgccagcaaatacagaagagagaggagctggttttggctggcccagccaacgaccgctgacaaatatttgtgaatggccagagcagggaagcctaggtctccattgctggggaacgaggcctaactccaagtctgttccagtgcccttagcagccctcttggctccttctcaggcaaagaatttggacctcatgcagttatcaccaccgaggtctcagtggccattcagccctttgtctccattactacaggtcactgcggtccttgtccctgagtgttcatcagccaaggaggctgtgtctaaaggcgaatgggagacagatgggaggtggctgcaaggtgctgtgattagttgacaggcttagctcactcctggagcccctggcaggccctctgctgtaggagtgcacctcacggagcctcggttgtcttatctgtcgaatggaaagaaaggttcttggcctgcctgcacacagaggccagtcccagcaatcactcaccctgagaactaagcaaggccttgtgcaggaagaaggaaaagggaggacagagggacagtcttagtgcctcttcctccagtggcatctgggttcttccctgccctcccagggctcacccagctgattccatctgccatttagctccatatcaagacctccttattttgaacctgttagtctttcctacccaattaggagggaacacttgaggtggactccctggcttccctcccacctacggatggctttccacatgtgcaaaggagccgccgcccagcaagggtgagcctgagaacgcccactaatgccaagtggcctggggcattcttggccattgctatattgtcagggctggctggctccaagctctttcgaaccagaaagacatggaattccaggtccctccagatttccaggaatgaacagcagaagccctgcaggagccagctgatttctttctggagcccctgaccactagccatatagcaattacttccttccccctccaggtagatagaagttgttttcttttctgggggtggaggagtgcactgggtagagagagggaaatccctgtatggcaagtgggaaaccaggcagtttcaagacggatgttgggaagggcttggtcaaccatcctttggggacatttcttgggccatagctgcaggcgccacaaaaattctaaataaggatgacgaaagttgtgagaatcaattattatctgccagggaatttccaaggttcctctctgggcttaaaaataactcacattgaaagaacaaagagaatggaaggagcaattagttgaaagtaactgagaagttaaaggagggagaattcacaaaaagtcacaggcacgaggcaccctggagagtggtctgtgggccacagtttcttctgggctttccaatgggggttgccttacactctgcagaatgagggctgcagccctccccgctgactcaggcatttggggctgggctgggctgggtagtcggaaggccagttggtggtagaatcactgggaggaacctgactcaagggccccacttttctcatggggcccaactcttctccaggtgctggtgctgatagctcctacctgccatggggagtgaaactgaatatttcagcaatgccagtgaggaggggggtgtgtttgggaatggaggggctgcctctcccacccaagtgtcaaggcaacagtgcttttgcccaggaatgtatatcagaaaccaacaagattgaacttggacaccaaggatgaaaaatgccacacaggcctcctgagaagggcccagggtatgcctagtcagcaggattcagttcagggtaccagatttttacagatattttaataatgactcttaaattattgaaataaatatagacaaccccaaaccttggacactgtatataaaaagaaacctaagaagactctgaaaggtagaaagaagacagacaggccagggaccttgggaactgaagaatgacacactggtgagttcctggggttttcctcttggctcagatatcccagacttggagctaaagaaactggagacccagaaacaccatgaggcctgagcagacaaacggagccccaacaaaagtccactctttctagccagaggaccagggaaggggcagcctagcaagacagaaaactcgagacagtagctactttcctccagccaaacacctctgcaggaactgtagccacacccccacccaccactccagcggaggcccaatgaggggcctagacagtgacaaggtacccagcaccccaacagggtggtgtcaaagggactgtcatccccattggggataatgagctactaagcttttcaatggaggcttttcagtgaaaaaaaaaattttattcattttagtggaaaaaaataatgcatttaaccccaacccaggataccctcaatttttcacagataaaaatgtatcaagtaaatattaaaattgaatttatataagtaataagcaataagttgtaagtaaataaatacaatttgttcataacatgcaatgcaatgaaggtctgtggtacccaagataggtcacggaggaggtgcagcgcttattctttagaagctaacattatctttctgcaaaatctttccactattttacaacctttgcagaattcatgcttatcttgtgctccaactgcacttccagtaaagttgtggcatggaaaacaccctgagggtaaaatggagtttgaacatagtagtgctttcagtggcaggaagcagcctttgagccagccagaagggtcatgagaatgtccctcaccaccccttcacttgccttttggccacaactcaaaagtttggggtttgttcctgctgcacaactcacacctgttccctgtgcttagaaagtgttgtcagatgagcctgtcttgacctacacccatcatgttaaatattccttctgtatctgtttgctaggttgctgtaacagagtaccactgactgggctgcataaacaagaggcattttattttctgacacttctggaggctggaagtccaagatgaaggtgtcggtggggttggtttcttctgaggcctgtctccttggtttgcagatggtcaccttcttgctgtgtctccatgtggtctttcttctgggcatgcagcctccctggtgtctctgtgtgtcaaaggttcctcttgttataaggccattagtcagttcagattagggcccatcctaacagcctcgtttaatttaatcacctctttaaaggtgatccatcatgtcttatctccaaatacagtcacattctgaagtattgggggttaaggcttcaacatatgaagttttgcggggtggatgggggacacaatttagcccatgaaaacttgttatagcatatgtagtttgtgggtttgggggtgaaaatgacaatgttccaaaaaaaaaaaagttgtttgaaagggatataacttttcaaaaaacattatggtgaacagtcattcataggaaggtgcttgtaagaagcaggtctgcgtatgcatctttgctggtacatgcatagaatatgtctggaagattcacacacgtggaacggctgcttccaaaggccatatgtgatgacagagtcagaggcaggagggttcactgttatctgctactggatctttttaattttgttccacatgcttgcattcacacatattctagtaagcgaataaagtactgattttaaggaaagaattggctttggtcctctgcagtagcaaggaccggtctgcctgttctcggctgtatccccaggggctgtcacagactctggcacgtagaaggtgctcaggaagtgtttgttggaagaatgaatatatggacaaggcaatgacttcctgttctggcggctgggcacagggactctgaccagcccgcccagtgatcgccttctctgtctttcctcttccgtttgcaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagccttgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggtaccggtaattgaatttttgttcttctcttgcaccagggaggacagcaagaggtaggcactttggtaggtgggcacagtgcagagccttgtgggtttgagggtctagggagccatgtacagggaagcaggggcttcggtcactgtggggaccaaccacactggtccaccactgccagcaggtagggccatcatgaacccctccagcacacttgggcttttcaccttccaaactccaagaggcccagggtgggcacttggaaccagcccccagcccaagggagtagggggaagagatgcatgcctgggagtgatgggggaggtgcagggagcatattctagggttagatattgtttgtgctgaagagcacttggggaaacatggagcttatgaaataagaactgaagcttttctacaggtgagtaccatccaggcagtggtctctgccagaatggggagcagaggtgagttgttcagagtgggggcaggctgattccagccttcctgtttcccgccttcatcacccagaggccagggagtgctctacagtgcacaccgtaaggtggctccattctcagcatcacgcaggtgcctacctgtgccagcatgaacccgagagtgaggcctccttacttttgctcccaggaggctctttctgcaccctggtcctggcctggcctgtagcttcaggagatgaccctaaacctccagaagagggatggggatttgtacttgcagcagtaagtccattgtgctcaccccagtgccaccacccccgaccccactgcccagcaggggcacaggaaaggtcaccctggagaggaactgtcccaagaaaggccaacttgcccacagccattcccacacagcagcagggcctacagaggcttcctcctggggcttccgcagagctccatgttctgggcttctcctccatcctcccctactgccgactctcctcaagctcttgccccagaggccaggcccagggtccacactcaggcaggataaggcaggtcagacctcttcttggatccactcttgaagatgagatgctgctcccagtatcctctccaccgagtcctctagagttctgctaaatgtaactgcagggcagcagagtggaaacagcacgggctttagagcgcagctgagcaggctcagacctcactttgcctttgactggatgggtggtcttgggcaagtcacctaatctccctgagccccagttactcatctgtaaaatgggtgttaatactacacaccttgctgagagactgtgaaggttaaatgaaataacgtgtacagatatgttcttgtgggtattcctattctatatgcagaccactgttcctgccctggggcccagatggtcggaagagaggggtacatgggggaatggaacagagaaggtagatctatagcacctatagatcagtttcaaggactccactcaggtgaggcctcctgaactcctggaccaagaagacatgggctcaggctcaggctgggtcactccccactctgctagttgctcactctaaaaaagggtaaatcctaggtggccaaccagccacatcctaaacattttcatcagggagagcaacactttccttctctctttcaagagacaggtaaagcgtgagatgtctcttggggtggggatttgtgtcctgttaactttacccagggactcagagtagccttccctgaagaggtggttgggtttgaggagaagaactaggccaccctattccttcacccaggattcagccctttcttttttttttttttttttttgagatggagtctcgctctgtcacccaggctggagtgcagtggcccaatctcggctcactgcaagctccgcctcccgggttcatgccattctcctgcctcagcctcctgagtgtttggttctcaagccagagactagctgcccttggaacttgatcccaccatggaagggctcaaggaaagctatagattttctcgtctaacctcactgtgttacctatgaggaaactgaggcccagagagtgaaatcacttacccaaagccacacagctagaggcagagagtgggatctagagccttggtctgtgccttctaggccagagcttctattgtcagggacagaagaccaagcttggatctcatttcatgaccctgaccctgcccttccagccagatctcacttccttgcagttaagttgttcccattcttggccaccaagaatgagtcaatacaataagatgacatttttttcttcttcaagcccctggtctggtcctagttgcagtgaaatctcataaggctgtagggctttttacttgtaatatccctcctagaagcccaactgttttagtggcacatgggaggattccttggtgtgtggcatatgtctacagaagaccagcacagtctccacaggacaaaaagccagggctgtgcccacagggggccctatgcccagagaacaagtcatcattgggcatttggagctgagggtgtaggggacaaggtggccactgcctgggccgcttttaaccaccactgcaggcattttggatctgacctgccttcctgaccaagtcttcctaccctcattttctctttggcccgatttcatatttgttatcttatttcctctttcataatttccattaaatcttttctagattaagatatttgatggacaaataaacaaaaaaagccaatgtatatgagaatcctgggtaggagctagaacccaaaaacagtatcagccctggatgtcataggggccaagaaaaaaggcaacaaggagcttttggcgcatgaggggtctttggtggaggttcccagagggaccagccctcagatccagggaagtaggcctggtcctgctttctgggggtggccaccctctttccaccaggccacccctgcacagagacctcggcttcactcaggcacattcatttgtctccgacacccccaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcaggtaactggacgccggccaccaccgccccgcgccccctgcccctctgcgttcggtgagttattcctagcgagaaggctgcgagttctggccacagttggacttttcccaagttccgcccttgcccgattaattatagaaaacacaaaggcagttaaggggccaggaatgagcggctggatttgtgtgtgtttatgtgtgggctccctggttacaatggaccaatataattttataggtgctttatgtttaaccagcctttcccactttctattttcataagaggctggctcttggtctcaacctggctatgtgctttgacctctctacatccaagcagacatgaacttgctgtggacttctcttttcctcctccttccacccagggctaggtccttagacctttgcagatatgcagttgatcatcactggtagtgagatgggtttgagtaaagccacacatgagcagaaaagggatagtctgtttaccaacacactatggctcctgggcagagggaagtcacggtgatgcaagactgtcttcatccttgctctttccctcttaatatcccttcacctctgacagtgtaaccccacccctgatcattgcttcctccatgaaggcccacgtccagtggttctatcagcatgagtgtgtcgtgggagtaggcgcgtgcacttggacggagcttagcaatgtttcatctcacaagtacctgcttgcctgtatgggcagtagcagatgagctggtggccccaaaactggtgacgtcagggagagatagcagggtcatgggatggtggccacatcaggtcctgggactgtccttggagactcttggctgggggagagccatgtctcctttcctcctattttgtattttagagactagttaagatacaaagtgagtttctggtccagatgagataaaatggtagtttccaagtaatgaagtagaatggcaggctatagggccatcttaactagggtgaccatacaatagatcatccaaactgcaacacttgtgaaagtcaaagggggttcagttcataattatgcctagacaacaggtgtaaacaagggcatatggccaccctcaccttaaccatgtggttcgcagtctgccgtcttccctaaaagctgggaggaagttgccgctaaggccacctctacatgcagccggcagggctccatccccacccaccctctcctctgcatgtgagttgcactcactgcaacatgagccctccctggccagcctgggctgcttctctcctgctccaggccctgatcaggttcccattcctggatcgcccgcactcccctggtgacgaattcccgcattacctgagggatttgcacatggggcatgttcctcgcgggccggaatgtcctgggagcgtgtggagagtggcgggcagagaagcctgtctgccagagagcacccggcacaggggagtcagggacagcatcagcctatggtctcggctttgggttttgtttttcaaaaaagggccaggatggggcaagagttctagacagtggttgccagctccaagtaacccagccagacccggtggcagacaggcacccagggcatggggcacttggggagggcagctggctgcaggggccatctcagatcgggtatttcttccaacctgccgtggtaagggtggcctcacccacaagtgtccagcggaccatcaatcctggggaacagtcagccacaaagggggccctatggcccctgcactcacctctcaatcaaccacaacgtgcactggtttaggacaggctccagatgtcccagcaggaagggaacctgtttggctccgtttaactcaacaaagtcctctgcattccccagttaagaactacttgtgggattagtgtgctgagagacagtttggcaaacactacagcagggaagaaaacacaaaattgaaagctgggaagcaaggattccagacctgattcgtttgtcatccgttggagcttggcctctatagttccctgggaaagtgcaagcaacagccttcatcagtgtaccctcgattttgcactactggagatgagccggggtctcgggcaggggcacgagggaccccgtgtgagcctttccctttctcatgctcctgaggccttgccactagtaggaaactgtcctgggtccccctgagtcctcacaaacccactcaccccatatagtggctccatagtaggtctgtcatgagtgatgcaggctttgggaccagcccaagagacctagttctgcaggtgccaccttgtctctggagcagagaactggcactccacatcctgctccccaccccccatcagccaggctgaacctcccagtacaccctgcatggacgaactctcccccagaattcacttctctgtcccactctgagcatgcacctccccctgaagcatctcacactcctacttcaggtggtgctagggccccactttccaggaaacactggcccttctcctgtcccagcacctctcatcctgcagccacaatgttcagtcaccctcctagtattcactgagtatttctagtgtgccaggcaccagcctggggactgaggatacagcagtcagtcactgggcacagctttgtccttaaaaggtttgcagtgaaggagttgaacttaaaccaatggccacatgaatccacagtgacaaactggggtgcgtgccgttactgccccccatcttgggctctgggaggtgggaacccctctactttctgcacctctgtatcccaggggctgcatagtgcctggtgctggagggccctcggtcgtcaaggagaaatggatgtctgaaaaggaaggcgctggaagcctcccttctcccgggctaggggcctgcagggacagctgaagtccagggcaagaagggaaccccccacccaaggcagtcatggctcacattctgaggtttcagagcagctcctcctctcctcccccacagtggaggaagccagccatttgcctgggtggagtatctgcgggtcaggtctttagaaatctaaatgtccacataggccaccactcacccctgtttaccacctgcagtcccagctttcatgtgagccgaggagggagccccttgagagtataaccagaggcttgatctgcgttctcagacctcctgggtggctagacaaggccctttcagctgccatgggaaggcgggtggactgtgctggtgcggggctgccctgatcccacaatggccccctgactccaaggcccagaggacacctgaaccacatctggctgagcctcctcaggccctgtgccttctctctgcagccaaggagacagaggtggagtgggcttttctggacagcataattcatggcccctcaccacccaaacccgagaggtgcaagaaaagaaagcgatgggctgggctcagcaaaacctgctttccctcttaacacctccagggatgtcttttttcacctgacttcattttctggcaaactatgtttgcatcccttcctggcaggcagttctagacccggcctgcacagccctgccccctgcttcctccctgaggtttgcactcagctccatccactcaaggcccatctggctctcggtccccaaccagcacctggttgggtttggcagcctccgagatgcccccataggatcaggttcagctaccacttccacacacaagttctgggccccggcttagcaatgcaggctacaaaggggccagggtgtgaagtgcctccttagcacagctcccagcagtggtctttacacttggttctccctggctgacttctcttgctgccagggcttcagtgatgggagccggcagcatggagggagaggggcaaccgcagatgtggtaaacattctgcagcagaggtctgagggctcttgccaagctggggtgcagcccccatggagtgggaagtgcagggtgggagaagggagaaggtttaaggtcctttaacccttcccagccagactcaacactgctatctcaaggaacccagaagcaccattctcatgagccatgacagtgctggagaccttggggtctcagaggaccccgtcaccaatcccacagctccaaaatggtcttcagtttttacatccaagccaattcctttttacctgaaatgtggcccttttattagtagtgtccttgtaagtaaaattctatttattaaacagacatttctttttttttttactttttattttattttattttttaatcattttttcttttttttatatactttaagttttagggtacatgtgcacaacatgcaggttagttacatatgtatacatgtgccatgttggtgtgctgcacccattaactcgtcatttaacattaggtatatctcctaatgctatccctcccccctccccccaccccacaacaaaacagacatttcttaatgtgccaagcatgttgtctttattaggtcaggggttctcaaaccggaatgtgcatatgaatcacgtgggattttgtttaaatgcagattctgatgcaagaggcctgggatgggcttgagattctgcgtttcaaacatgctcctggtagatgctagtgctctagtccagggaccacagtgggaagtcacaaggcattgaatgactgatggtttgtaggtggtggctctgtttcatagatgggcaaactaaggcacagtctgtcatcagtgtgatggtcagagtggaggtctggcctgggaatattgcatttcagatactggctcttctttaggtcagtggttctcagcctcgctatgcatgagaatcatgagaacacagcaggcagggggcctacccctaatcagttgaattagattctccaaggacgcaacctgggcattcgttagccagggtggaacaccactgttgaggagacaccccagagacaccgaactggttcatcgcggccacttatgaatcagctggctctgcctgtcatgccgcgaaccagtcaagaaatacctgccaggtgttgggctctctgctgagccatgggggaaaactccgagtctgagctggcaggagaaccccattacacaggaggcctcagctgctgagaacatgccttccactcccccagcctcaggctcttcttgtcatcaccctgaacctcctccttgatgagatgaaagccacctcttctctcccgctgcctccatttctctctgtcctcagctccttttcccattttccttttccttggcctgggatgtgtgtcggaacagctatcacatgttttaggaaaagggcctcattctcacccacggtgccaggctgtaccagaggctgggccacacttcgcagttcagcctgtctccccatacaccttcccaccaaggttcccaacttctctggctttgcagggtcctgactgcagactagactgactaactagatgatgtgcattgattgtttccgacttccaggagaatgtggggtgcccagggtgcctgggttagagaaggaaccaaaagtttccttggatcctcatcagggaattgtggtgtgatacagggcggtgaaggggctccagtttcacagagaagtgaagaacgagtgtgcctctttttatgggacctttggaatgacaggaatggaagcctgagccctctccacccagcactgccctgtcactgccccgggacgtccacgtgggctctgggaatgctcctttgctgagacaggcttgggtagtacaagttcaagccctcctctgttgaaatgtgtgtgctctgtttagccaagaggtgtctgcatccgagctatgcagagcaaagtattattagagccggcatcagtgtgtctgtaactgaacccagctctccctagcaaccgttgccaacaacacatctaacagaaggatgcgatacctttttttgaaaaaaaaaagtttgtctcaaccaagtcataaacacagcaggcctgttgtgaaaagacaacacaaaatcagaatctggtgtgtgaccagatttcaaaataaattgctcttctctagcaccttctagaagacagcctgttaaaaagctgaccttgagctaaagagcggagaaactcttcagagtttctggctgggtcatcatcaagcattgtgttttgggcttttcatacatagacgctcagttgagtggtgactctgtgggatctctgggaatgactttagcacagaaggggcactcaagattttctggcttggctttccttatcagtgaatctctcaagtgtgagacaagcctgaagatgtatcttacccatacctcatcctggatgtgtgtgttgcccccacttctacccgtttctcccatcctcctgcccttctccttgtcccatgttttcaggcttgggaagaaaactgggccattcctctaactctcttcctaaggggaaaacctcgttctcttgtgattctctcaaggtctctggaaaatcaagtcattcccctttgtcagaagtttgaagttcctaactcttatcttttacataggaagggaggagggagactgatatcgattcctggagtctaagttttaaactcctagatggccagaatcctggctgagttatcggctgtccccagctcctggcttcatggttcatagtagatgctcaggaaatggctgtggaagggaggcatggagccatcagtcatgggtaccaatgctctctggggcatgaggggctttgaaactcttctgagcactttcctgtgtgtgaatcggaggtaggttccagggcagggatccctccccaggcttatacatggggaaagtggctcagtgaggctgcaagattgacccagcatcacgaggctagctggagcttctggatgccatgccacatcctaaatagggtgtaaggctcaaaaacttgggaaaatcaagaatccatatcatggttgggagcaatggctcatgcctgtaatcccagcactttgcaaggccaaggcaggaggattgcttgaggccaggagtttgagaccagcctgggcaacataaaaagaccccatctttgaaaaaaaaaataggcaggtgtggcagcattgctactgaagccccagctactccagaggctgaggcaggaggatccattcaggccaggagtcaaggctgcagagagctaggtccctgctgttgcgctccagtgtgagcgacagagtgagactctaaaaaacaaaaaagaatccatctcaggaagtcatcaattgggatttcaaaatccaccctgtggaataatcccactgtgtttccaggggtcgctgagtctctgagctttctgggcctctggaggtcaagggtacctgaagaaacccctgcactctccattcgccctagtccctgtgaaaccacacaggctgctggccccagttcccatctcctccttgcatcctctccctcttctcagaccccctccctcatttctgcacacccaccgctgagccgatgtgcactccaggcatgtaaactaattttaatgttggcccaagccaggcacacccagggatagaagcacattgttctgtgcattccaaagcttgagcaaaagccctggccatacccacatcgagctcccctccactagttgctagaaatcagaaaggctgaagcaaagggccagaggcagtgcaagccgctttccccgtgggcaggctgcacggaagcttgcaaaagcccagaaaagggctgtttttctaaaaatggctggcatctgagctcccgccctgccccctgtgggccatctgtccccatgctgaagcccgtgccctgcaagggacatgcagagttggcacacacatttccctgaaggtgggcaccaacaggcctcgtcaggctggcctggcatcacaggaggccagcagtcacaggagcttgacccctgcccaggattctgtggcagccctgggctcccccaacaggaagagccaatgcctgactcctatccatgttctttgcccctgcggccagagccacagtggataggagccgtgtgcctcgttgccaatcttgttgtctgcacttgctttgggatgagtaaatatgacctgcttttctccaatctttatttcttctcaacgcttattgagcacctgctatataccatgcactgtggcaggtcctgtatgtctctgttcatttgccctccactgtggtctttcaatctgtttgtgcaaatcttaagcattgcattcaaggacccaggtgggatacctcaatgtcagtgcttagaccagatcgccctgactgttcagtttgggtggggcgggggaacatgtggcttccaggagtgctaagcctgtggttctctctggagctttgaagtgctcagtgagacagagcagccgatgaccggatcataaacaagcattttgatttttgaatctgaaaataagcgaggaaagaaaatgaccactgatcctcagccagtcctggaaagtgcccagaacagcagcatgccaggtgtccagtcatcatatcatcaggggggcctgggtgctgctgctgtgccaactactgccccaggcccccagggaccagtgagcttcctgcaaaaccaagtgcccagcttcctgcctctttgccactgcgccactgtgccactgcgccactgcgccactactgtgttcttcaaaatcacagagagccccgctcctgagaaagcccaaagtgcctttctgtgcacggcatgggcttttacaagtctcatgggcagtctactgcaggccttgtcagagactctagatgtgcagaggctgagggagccttggacaaaagtcactcctttcccgtgaaaagtggccattgccctgtgttgttaggagcgtgggtggctcaggaggggagagcaagaccagcctgcagcttcatgaatcaggtcagctgggccatctggagcagacaggtgtgggtcgtgcccccgaatctcatttctctagacaggatttcttgccctgaggcagcaacgctgaggcctgaggagtagcaaacctgtgcagtagcatcgattgctgcctcgatgctgatcttgagcatttaaaacatgtctctgcacccacgtttccgtcctgcaagggatgattgggttgtggtagagcttaaatgaggtaatgcatgcacggaccccagctctgagccacaccactcggatggctccatcagtgtgggtgccctgccctggtgggatgaactgggaggcccttctaactttatcccatcctagattcccaaagaccaccccatgcctcagtcttgggcagcatttccatttcccccccctacgctgattaaatgtggaacaatgagggcaggcaatgagtgcttttagactattgtcttcctgggcggtgggcccaggattgacaggtgtactcttcctcctagtcaaatctgcctcctccaggaaaccttccctgatctcccagcccagggacctcaccttcctctgactcttgaacatttaccatgtgtccctttcatgaagtcttctgggctcccctgtttaagcttttcttatctgagacttgtatctgtggatgtcttggggcaaagaatgcgtctgggtcatctttgtgtcccaccaccatactggtacccacaaggtattcatcaggcatcagctggctggctccaggagcttccttcactggggaggaaggagcatggataggcaggcatgggaatagcacaggccacagccacaaaagggaatggcctggggttttctccctctcgcttctgggccaggagagctttacccaggtcaggaattatttcaccatcacccgtgtcccttgccagaccgtgtccccttccctgcatgccctcaccccccacccagggttcattttccctgctaaatcccctgatagaacttggccgggcactgccctgtctgaggctgccacgccgaagcaggccctgcagataagtgggttaccggagaaggccagctcgggtgtcccaggccccagagggtcacccctggctggctggcagctcacccccagcacctcctcctcctccttccccggagccaggcaggcaggagacagcagatccttccccccagctctgtgagcggccggcccccagccgccgcggggaatctgagctatgctaagcggctccagatcgcagcatctctgccctgcccgggcacggccggcccagacagggcgcctctacctgccgtggctgccgctggaaagctggcaccgcctgggctgatggaaaaaatctccctgcgggttatgtaactgctcaccgccctgtccctggctccccagggaggctcccagccactaccaagagagagcagtggcccctgggcaggaaggagaccacagagggtcactctttcaaaaggaagaaaatagtgttgcgttatctgaggtcctcctctggaaccagcctgtgcatggcgccaaggtgtttcctgaaaatgcttaaggagctcagaggcctgccccagtattatagcaagaagagagctaaacctagcgggagggagtggccacagaggaggaagagggcaggacagctttgttactgtttttcttttcttttctttttggcaaattattattgcagtaaaatataccataaaattcaccatctgaactagttttaagtgcacagttcagcagtaccccgcatacctacaatgttggacaatgcccatgaccatcccccggcaccccaccaaaccctctcatcaccccaaacaaaagccatgtacccaccataactcccctacagcaataactcccctacagcaataactcccctacagcaatgcctcccctccatcttccatctccatgaattcacccactctacaaatagcacacatgggatatcatacaatatttttctttttgtgcctggcttatttcacttcacatcatggtttccaggtttattcatgtgtcagaattcccttctttttcatggctgactaatattccattttatgtctataccacattttgtttatccatttatctgtcaatgggcacttgattttcttccaccttttgactattgtgattcatgctgataggagcatgcatgcacaaatatctgtttgagtccctgcttttgattctttggggtatatacctagaagtggaattgctggatcatatggaaattttatctttagctttttgagtatctgccaaactgtttccaggaagggtgtttttgatgggggaaatatcatgaaccaagagccaaagaaatgacacaactgagggacaataaggacactgccttactgaaattcagctgagagctggaggaagtctataagggggaccgactaagaggcagaaggatctggactttataaagtgggactcagggagccattgtgggttcttgagatgtagagttccaggatcaattaaaaatcatagaccagtgtagacttgcaggaaggatctatagatcatccagtccaaccccctcgtattacagttgagagacttgaggcctggagaggttgaaagaggccatgaagacatgttgataggtcataggatgttggacttaaagatgttttacatcagagaaccaggggttctaggtagccacgtggtctcttgtggagagggagcatatccaggcttaagcctgcccctcaaagacctgagctgtgatggcaggcctcatttccctgccctactctcaggatcctgctctctggcccctggcacatggaactgtggcatttccaccaccacccccaccagccagagccaggagctggggttgcctgccatggggaactgtgctcccctagcgctggtccccttccttcagtaagtgccatggtgggctccaagagcttctgggacaagtcagtgggcatcttcgaaccagagcccctgggtgagcaggcttccccaggggtacatagcctgcattccagagagggcccctaacattggcctgtgggccgctgataggaagaatggatagagactccgcacagggtgccccacccccggccctggtgcccctcaccatgctgctgtgggcttatctccttgttgcccttcgcccataccaacctgcctgagctgcgtttctgatgcctataatgaaccagaagggagttgaggggacagagggggagaggaacaggaagaggagatgacaggacaactctttcaacagccagcaggaatgccacacttggccttcaaccctccgctctaagagtatttatacccacagtgttcagggtggccaggttccaccttgtctagataaagagcaggcccccttacggagacagaggtctccccagctcccctccagacagccaccaagaggtcaggaacacacagagtgcacggcgcagtgcatggaagggaggcgctgttgcaggggcagccatcagtgcctgggttactctgaggccaatcggcatcatgtgagcaatttaaacccatggtgtgcccaaaggccagcttttcctacttctaggtcttccctctctgggcccctctgtccaggagaggcggatacactcgaccagaagcagaaccatgggcacagggagtctgcgtcatgctggctcagcatggctctgcccttgaaacccagagcctagaataaggggtccctgtacaccgccagagtgcctcactgcctcccacctagagctcaggtttaaaggccttcactcggtatcagggtgcagagctctgagtcttcagggaaaaacagcggcctctttgggggggacagggaggaacctgcagggaacgaccctcccttaaccctctgctggcccttccaggacagatcccaggtcccagagtgagagaagcttcaggccactttgaagtatgaggacaggcatgctcaaaatcgtcccccctccagcacccccttgacagtgccgagcctgagaccaagtgtattccagagaagtctgtatgcacccaggtcattcacacctagacccattaagcagagagggcttgggagccagcacgtcaccatgtcatgcccctgcctcccagttttccgtagagcaaaggccatacgaaagaagggggtagcttaggaggtatttggggaaagccagactccagctaaagctggtgaatagctataatcggaataagtgcattcttgagcagctgcgtattggagcgccacatattggacccatacttagcatggaccccattaggcaaccgtcattgcattattctgagtattaaaaaaaaaaatgtggcaaggggagtaatatctctaaagtggggttcgaagcacagtcacctggaatcagccttccctgccatagacccttcctttaatgccttaccacctgtggcataagaaataactcaagcggccaagagccagccacctccccctggctctagttgtggcgccatgcaactggttgactctgggtggatctcaagcgtggcagccctacacttactcttctgttaaatggggtcataatacccatctcctcctcctgcctactgcactgacattatcattgttaaaatccactgaaatgcctgacttttacctgtgttcccttaagactcctcctccaggagaaacttgtgaatttcatagcagcatgtttttccttttccttttgatgattccattcattcaaggttcttaggggaggtcccaggcagggaaagcgccatgagatgcccacgcagagattcttccacaagtccaggggcccccggcacagtaggacttgaggtttgggtgcagcactgtagacagcccaggatccagccacaaggaaagctctccaaggggccctgggactggcctggaggccccacagggttccctgagctcagtactgtgaaaccccagtgaaacaggcactggcctctgcctgacacataaaggggggcagggccagctcagccagagggcagtttaggaacatcagaggaaggggcaagccctgtaagtggagtaggttgaggaaggcttcctggaggaggaagcatgaaggaagaggcaggatctgggtggaaggaagacaacaagaggatctgtaagtggcaggaccctttgagggactgggggttgcagaggaggattggggaaggaggtaccgccagcctggcggagggtgtcaatcagcaagcccagggctgaggctgcccagccgggccgtgaccccaggtcactgtaaccacactggcccgttcattttgctggcgcctgcttcttgccatttcaggccaagaccatattttcatccaaaactaaaacttctacctcaagaggcgtgagtttcctgccagccttgggccgtcttttgcaggtggcagagtgggctgctgaatctgcgaccctggccaggctccagggcctctgaaccctggggttttgctgaggcaggtggtgtggcaccaagggcctggcatctgaggccagaagatacccgccacccctccctggtgaggttactgccttgtaggagagggtagggatgcccacctccatatgcccccatgtgccccaaccagcccctctttgtgcaccagctgcttccagagctatatggagatgggcgcccaccgcccaaccaggcacagaggtgcagtgctcgctgtgggggagggggagcatgatgccacccccaggagctctgcaggagccagagcagggttgtgcaggaggctgccatggggcgggtctgcacagcaacacttgctgctttcacctcactcccctctgcagaagccccttttcctcccctccctcaagtggtggagcaggaggcagaaagtctgaagccagcccctcaactaatgtcaccgtctgagcctcagcatccccataggggaaacgagggcactgggtcgggtgtggtctgtgggtcaggtctccccagccaggcaccaggccctctccagcagagcctgtggcacctctgtctgcctcgcacagcccctcaagtgccttgagcctgtgaaggttgcaaggaggtctaggactagggagaggctggaacccactgcgggtgggaagagaagatgggagctgctctgtctgcaatctggcagttgtttatcccaaacagggaaccagaagctgaggatttaaaggctcggcgtgggaggaggtgctctgggctgcaggagatccggtggggagccccagccctgcctttccctggctgggcgacctcaggccaggccttctaccctgatggtggcttcctcacccataaaacatggagaggttagaagtcatttcagacattccttccagctttgttatcccaaagcagatgcgctaggcaaacagagggtgcctgctaaaatgcctgttgctgactgattggttagcgggttgaccagtgcagagcaggacccatccccaactctccccacccggcgggtctggccggctccttcccacccgcctggccccatttacagagtctggggcctgcttggcttgtgtgtgctggcggcagcacctgctgggtgggcagggcggcctgcagggggcaccagtgtgcaaggccagcccttcctgcctgcggccacctcccagcatcttggcatcctgggggctgtcccacagggaagatttaaactatatgatggtgaccgccaccaagccaccctcctatgtgcaattttcagaccccttggggtcccagccctgagtccagaaacctcaggctgagagttggactagaacccacagcaagggtcccctccagacctccaaaacgggccagtgtagtactcattcccattttatacccaagacaaccagggctcttggaggccacaggagggccaccgaggtctcaggtagcttagaaggaggacagagcatgggtcctggattccctgggaacagtgcctgcccagagacccagctgcccttaggaacgaatgagtatcaaccagctgaggctgcattttcttaaaatgcattggtttgtctagtgttgtttatgttctttctcaaacagcaggaagaggttgtgggaagagccctggctgtcaacaggcttctcccatgcagtaggggtggacagagggactgcagccagggtcaagggcaggccatggggcggtgggacagagagcaggccgcagcctcatctggcctcagtagccttgtacagaggcaaaggggcttccgtgtggggtgtcagctccttccacacctgcctggacccggaaacaggcatgccttgagtcaccagcagtgggcagccgtagagtcactgtttcaacaccgccaatttgttggtcccacgcctggggcccctgtggtcattgcagtatgttttatggaacattctgtgaggattcctcttggggttttttagcagccacccgttaggatgttcctaaagtagaaggcaaacagcccacagggcctcagaattctagaaaaaatgtctgtgcacagcatgggagcctgagccaggagggcattctcagccatcttctaaggagccaggtagaaaaatggggtcgattctattgtagttacttccttattttagctattcattcagaaatgttagctgttcaaagggtatgtcatttatcaatcaggaggcgggagccccaggtctgcaggagtgcaggggaggatgtgagcaggtcagtcacaagctaacttagaacaagcattcaatcccccagaaaatgcaccggggaaagccacaggcattcccttttggtagaaaaggtccctggtctatcttcatcgatgggactctcatccggggtttgtaccaggggaacctggccaggggatggccgttcagcctctgggcatgttggcagaaggggtagttcatggtgtgccctgggcaccccatttctgatttctacccctgagccaggaaggcctctcccatcaaccaccgtgggactgtgaagcaggtaacaggcagaggtggtgggggtgtccaggggcctgaggtggcggtgaggatgggcatggagtactacacttcattgaaatgccagcagccaggaggtgagcaccttgggttgggagtgctccctgaaccccagaactggaggcgttctgggggcattctcactagcaccgcatcgggacacatcagtccagcaggtcgcgctggtccctggggagcccagaatgacagtttgtttctttttgttctggctgacaatgatgccacaaagctgtttcagccctgactgagagtacaggatctggacagccccgatttgaatcctaagtttaatacttcgtagctgtgtggcctgggcaagtggttttccctctcggggccccagttttccatttataaactggggtaatagataatacctgcctcctttgggtggatgaggcttgaatggtggggacgatggtgttagtataaacacaacattgactggtgtcgctcatgtctgggggttcctgtcaggggtccaacaggaacaccagttactcctcctttgccattgggccagctctctgcagtcactggctggataccagctgtatgcatacactgtgggccataagtatcccttagacctttgtgggtgggggttaacagccccattttatacatggggaaagaaagttccagagagcttaggaggtatacgtcaagtcacgcagctggtcagtgacagacagaactggagccaagtccctggtaccccacactctgtctcctcagaacacactgccacctgcatgccctgattggtcaggagtgcatctggagggggtcagttataaggctgaggagaggtgacagggaaacgagataagaaacatgccatttaggtggccatgctttcagagcctcctccccacaggccaggccttgggctctccccactgccatcttatgaccaaaagaattgagagacagcttcccggccagcgcttagcagcgggcttgggtctgctgcctcctttcctgtcttgccgggggtgggggagagtctccaccaagctgcagacagacagaagaatggttccttgtcctcccaagggggacaagacttctccatgtccttccttcccactgggctggtttccaacccaccaccttcatgattcgtgaatgcaaagagaagaccacttagatcggtatgttttgcttccacttggcagccctaggtgctggaggctgcagctctgggtgaaggtgggccctggtctgtggggtatgggcatctgtgagcaccatctgcatgcagccccggaggtcaggtggcagagtctcccatgacaggttccagcagcagaagtcctaaggaagcagcttgtgtctcagatgaggctgtgtacctccgttgcctgtctaggctggaggaagggtgatggcacctttaactggtcccttccttacagatcactaagtgtaagaggccaagcctgcaaagaaaaaaagggagagggagagaggaaaaaaaactagagcctgtgcgctatgtcatttctaacactaaatgattaagaagtgaggaccctggggtgtgagccaaggcagcctgggttgctcagtcctctagaaacccttctaagctttcctcagcacacagcccagagtgctacccggagaaagagccaccttgtaaatcgctttcttcactgtgctgctatgcctttcaaaacaaaagctaaaaactcctcccacccccatacaacttgatttatcatgaccccgtcatctcggtgtcccggtgttagttcaaaatcaggctcaaaactgcaaaggctggagggagactgtgggagggtgagggacactttatccagcacgtggcacacgcacctctgccgcgtcggttcatgcgtgtccctccctgcgagcttggcggggcactgtggacactgggttctctgcctgataaagggggatcctttcatgtagcatgcatcaagatgcatgcatggtgtgctgggctgtctcagccactctcccaggcttccctcctgccggtccgcacacaagaggcagcgtgctggggagccagtggaataagggccccacaggggcaagatggccagaggccatttcagcatgaccagcatttatggatctccttctgtgtacctagcagggcagagtgcaggggtagggcttaaggaggggggcgtgctgatagcctcaggaggcccatctgtccctccctctctccctggactcctctgtcatcccatcccctcctagctggcatgatttttcctgtactcagatcgcaaaagactagcaagccaatatgtttgctgggggagtcacagaaggcgaagacccccccatccctgccttcacggagcttctggctttgtgagcccccctcttcttgttgtcaggctcccaaatgaccccaaagggtttgcttgcaaaagtttgtcctctggactttgtgtttttccccatctgctctaccctcctagtgcctcctggctccggccccagcgccagcccctgtctgtccctgcaaacacaagtcagctgtgtgtgcagacaaagccgtgcgccgcagcgggggccgggcctgcagaagggacatttccagggaactctgggggcggcggctgggagggcagaggcgactgtctgattagcagagactcggcgtcacagtctagggcaaagagggtgcgggggatttggccgggccccaggggccagtggctgtgggtggtgaccaggggaggcagccaggctggaagaaatctgctgtttgagaagtggaggaaacgggctggagaggagagataacagcccgttctctgtgtatctgcatgcgtctgccggcgagggtggctggagccgggcggtctgaggccatatctagcgagatttttgttctgggttgtgaaagtgacctatggagccagcagcagggttcagggcctgggagagaagacacgtggccctcccctctcctccccttgtcttgtgttagtctcccctcctctcccccttgtcaaacagtagaaaagggagggggcatgggggcaggagaggaagcattcttagtgcggtaaaaggcctgggtttcggtctggattgtaccactaatttgacatatgaacttggatacttcccctaatatttctggctgtctctgtctcattggctgtaaaatggggattatttataactgctctgcatagcacgcatgaaataaggacgtgaaaatagtttgtaaactgtaaagtgccacgtaaatgttaaagagttgtactgattcaaactgctttgaagcaggggctggggctgctgattaaagacctgccttagatgaactaggtgctgagtggtgggcaggagggtggggtgggtaggatcaagacttagggacccagaagtttccatggaggcaggggtgggtcacgggcccagccaagtgagccctgccagaaccaggacccagggcaggcgtggagggtgaagtccaagagctctctgggtgggggtgtttggtcatgggcttgcagattcaagtagaaggtggcctgggttgggcatggacttctccagggagacaggggaagccatatgaagccccttgcccatcaagctccagggcccctgcctggcctggagcataaagtcccactgattgcagagggatgggggcagcactctgttttcctctcctgagcctctgccacccaaggaagccaggtccccctgtccccccacccgctccccatcctgacctggaaatcagccctctctgatgtggaaactcaggcaggagctggcaggggtgacaagactgtgagcgggagagaagctgagctatttaaagcgtgcagcgcccaggggacatgaatgccacccacccacaaggccttctcagcattcgctttcccctccttggcccagatcccaggccctcagtgcacccacagggccacaggtcaggtgcccgaggctctgggaagctgcaggcggacaggtcctggggctggcatgagatgtggttcagtccaacctcggcttgggttccctcctctgggcctccgggctgagttggcggggccacacagactccttggctcctgtgccttataaacagggctgagtgtgagtgtggagcttagaagaggaatgcccacgcctgtggcccggggcagctgccaccacccacccccactccactggctaccaagccaccagactcagagagcccatggggcaggagtgggaagtggggagcttcgcctgtagacccttctcccctgcccaggcctggcttcccagaacaccccagattacagatgtttttctccttcatctccaattaacatttacctgtcctgggtcctaacctttagtgaatgacagggtgtactgtccctcccttcctatctgggaaaggctgatgtcttagctgggaagagcaactgggatccaggcctgttagacacagggtcccatgtaggccaccacaggtctggaccacctgggaggcctagctggggggctcccaggggccagtccaccaaccacagctggtctacattgcaccagcacggcttatgtatggaatgacttgaaaagtcgtcgactgccctttctgggaaggactggctactactctgagattgcatccttcctaccatattggcattaagttgtcctttcttttatgatatgacggatgaagctttaaaaaaaaaaatgcttagcaaaataaaatgtgggcaaccctcaaattttaccagtccaataaatcttggagctcaggactctggttccagaacagcacggttcacctggatacccagctctcctggcactgaggagcccggggataagaggaactgttgagtgtgtggggtacagcctggggaggcctccgaccctggggctgcatgcctcaccctgacagtaacttgcagcttgaactgccagttcatctttacacctgggatttccaccccaccccacctcctctatcctctcggctggagacacttcctcccacgtggctgggaattcagtgttttgctgtctgccgcaggctgccaccatcccgtaggccgggggaaacctgcggaggctgcctccaggcaagcgctgcctgccgaccaccgccctctgaccccagtccaccgagccccagaggcacccagtcagcactcactccctccagccttacgtagcgtccacacgtatgctgttacccacacgggccaccaaacctccagtcccctgccctatctcacacacatctttacattgctccatgtgcactctagtggggatggccttttccacaccaagattcattcatttatcagctgagcatgtgctgtgttccaggcagcgagatggtggaaaaatggaaaaggaggtcccctctcctgccattgggcatctcctaatctggtggggaatgcagacagtacccagtaactccagaccagcatgctaggtgctgtcatcgcggcacacccagacggccccgagcatcgagaggagagagaactcacatgagggtgtctcacagagagaggaacacaggcctgagtcccagcacctgggctgggggtgccaaacaaagaaacgtgcagaagggcattgtctaggcgaatacaggagcatgagcagaggcaagaagcagacaagaatcatgtacagcaaaagaaggggttgttcccgagtatagtgtgcactgggggctgaggtgggaggagagagtgtgggccagaaccagcttgggaggggcactgtttgccctacctggtcggagggaccataccctttggtctctggggcaccaccaaaggtttgtaaggatggaggtgatgtctcctggttggcatctttggctctctctctgcagcaggatggaggagggcaggataaggaccctgggaggagcaaagcaccccactgggggtgtcctattggagcctcctgggagagccaggagaggtgtgggcagcctcaactctgtggcagtggggcctaagggtcaggggatgatccatgagtggtcagcaaaaagagagagacagagagagaggtggggggactacctgtagagcagttaacatgcatcagcaccacaagcaggaggaccgctgggcagagaaacatgtatgcacattcatgcacgtgtacatgtgaataactcctctcacacatgctggaggaaaccctcgctgtcatccacactcccaggaatggccacattagacatcttccccctagttcctgagaagcaaacccgggagagcccagccctcagccttgctgcatgcgtgagcatggagttttgcactctggccagttttgcctctagttctttgtttctggaaaaaacaggcactagggtgaatttcttttctcttttcctaccatcccatcttccttcttccttctcttttgtccttccttccttctttctttccttccttccttcctctctcttttccctccttccttccctctctttctttcatgaagaaaagctcacagaaaggcagaaggaaccacagtctattgacgtttctgactcttagaggctccaaaccgaaactcagctgtggttgctctaagtggctacaaaattagaaaaataatttgcagaaatgaaacctgacttgggatgccgtttcacaaaataggctagatggccttgatgtgtcatgaggctcccaccactgcggcctgcactgctggaggaactcctcacatctcaggctggggagcatttccacccctgcagtcaggcatcctacagaaacctgccccctgcctacctgaagacagttcacagtttcctctgaaatgggcggaagagctggacccagccacaagaccatcaaggaaagcaaaaggctttcaaaagtgagactccccagagaccaaacccaggggaagggatctggggattcttaacagactccctgggagtccaaaccaggctgtgagcttggctttgccatgaactagctctgacctccgtgcctttggtaaacagtatcaacagctgccatttaccaaatttctatggggtaccttgcttggctgcacctggggagatttggaaaatgccaatgcccaggctatgccccaagcaaattgtgtcaccatcttatgggtaggacccccgcatcaacattgtttaaagcttcccgagtgagcccaacatgcagccacagctgagaaccactgcccccacccatttggctggagacttacgtaggttcatcctcacagcaaccccgccagggtttatgaataaggaagctgaggctaggagagtttgaatcactcatccgagatccttgaggttctccctcatcccaaagcccatcattcttcctcctttgcagggctggatatacctgtacagaccccgcacagcatcagtgagtgatccaaccagccagctgaaggagctcagagagcactgcagggagacaggggaggtgccggcggagcagtctgcctgttcctggcgtttgggagggggtgcaagcctcaggcctgtttttcagcctccctcccaagtcacgattggtccctagtcctggggatccaggctgtctgggtcagtttgaacctgagcctcactcagcagatgctcttagtgtctaagcccagcggtgggcactgtcaagagcctggactcaggagccgcattcctgcctaggttcaaatcccagctccactacttataagctgtgtgcctttgcaaagtgagtgatctttctgtatgtcagtttcttcatctgcatgatggggtgacgttagagttgttaggagtactaaatgagacagtgcatatcaggattgaaagcagttcctggaacatagaaaacaagaaaatcccaggcactctaaggattacgactgtgaacgtgcagttcattgctgagcagaaactcgatggaacatgggcctgaatcagtcaaggtgataagtttaagtcaatgtttgccctttggccttgcctgttcttagctagatcagaacccctggggtatggagtccacacctggaacttcgaagggaaaggaggaacctgttttccctctttggcctcaccccagcccaggggtccttcctcctctcccaccatggtcattaccacccttccccccacccacccccagtcaaatactgactctggaagcaccttctgcatggggcagggggtggcccggatgacctctggagctcctcaccccaccatggcagtaaatctcccttcccctaccccaccactcagcctgtgccctgctggagcccacagcccatccatatggttcatcagcagcctgggaggggccctgtggctgggagtttgtttgaagcctccagaccattgaggcaggggcggagctgtggtcaggacaacagcagtgcctttcactggctctctgggagcagctgtgtggggggcaccggcccagaaggatgaccgacatccacccgcagtccttactatttgcgagggatagggcaaaggaggggcccagcccaggatggctgtgaccacattggttcacatgttaagtatgaaaggaaaagaaagaagggaaggggaggcggggaaagggaaggaagaaagaaagacagaaagagagggagggaaatagggagaaaggaaggaaggagggcaggaggaagggagagaaggaggaagggatggagagaggagactcacatctcagaagagaaaaagcaccaggagctttccttagtcaatcatctgcctgcaggttgctttacactcagggctgtgcagcccaactctaggcctcagccgcctccattctgagggccttggatacaattgcccccaaaccaggcattccaaccagggaccgtgacgggccccagctccaggcctcctgggtatcctctcatggttgagtctgccccctcctgagaaggaagaagaggcagggtgtgtgtcagcctcatcacgcattccatctcccagacggctgcctctgtctgcctgtgcagtctgcttctcttccaaagggtggtttgcagtgcagattcatggctcccagctagaaacagtattccctctgcccctgcgccaactcctgcccaattcttctgctcctcacccagttccccagcaccctgaggggactggccacacagaaaggcatgagaaagtctgctggctgtgtccacagtgccaagggttggaggtctggcagtcctctgcgtttggtgtctgtcctgattgtctctcctgggggtgacatgggcaggatctcagcgggaggtgaggctggggccaggcacttcttctccctgtaaaacactgctcagggagagcagctttgctgaccttgagctgggaccccccctttcagagtctcccagtgataatccccatggggacaattggatggccgaccctctctagcctttaggctggggggagaagaaacctgaatttggggtttttgtctctttcccagaagaggggtaggaaagaatcagtaacagcaatagcctgagctggaaacatgctcaggggccagtgcgtcccagctttgagtatagagcttcattctgagcacttcccacataaaacacaattggggtgccccaaggaggggcagacaccaacatttcaggccagaattccagacacttgactcctaggagagctttgggtaagctgtctcttcctccctagccttggtttcctcacctgtaaataagtggcctgaagccactgagggccttttagtgccagcagtgaatcctgtgactgtgttcctcctatctccctgtatcccagggccacaccacctgaagcatttttcccctgcctggccacatacctgcccccggaggccttgttactaagaagggctcatggagctggaggaggtcaggggagcagtgggaacagccagaggcacagtggcagcctttgaagataagattcctaagtctgggaaatacagaggtgtggctgtaataggaacaggacacagaccctctcaccatcacagggaaactcaagggtctcccttggggaggtcactacagaaaaaatgagaagaagcacttgtacttctgtacagggtgggtgtgaactcatcaccggcccagaggtgtaggtaggccaacagtggacacggatgctagaaaggtactatgacatcagagtgagcatgactgagtctggttaacgatggccaaaactgtcccattcccaccatccaatagcacacctcttaggcctgggagaccctgggcagactcaggaggacgtgtgctgtgctgagcctgaagaaggtggcaaagagcaggtgtgtgcacgtaggtccctcagcacccatgggacatgttcctggactgcaagcctcatcttcctttagtacagtcactctaggcctctgaaccattgcttccttggcaggaagtaccaaatcacagagaagcctcaaatcattttcttcgggtttagggaaagtcactgattttcattttcctataacatgatgacaataagggctgggttcacatcccagctttgtcacagactagttgtgtaaccttgaatgggtttcttactctctccaagcctcagtttcctcactggtaagatgaggatggtaataatgattgggttggattgctggggattaaatgagataatgtagtaaagggcataatacaaccctggccctcaataagtgctcataatgttggctatggttcaattggactttgcttgggataatagtgaaaggaattttaatttcagtttgattcatcaggtgtgcactaatattataggtctagccctgtctgaaactctagggagatacagtcaagtgtagatcagtgacataccatattcatggactagaatactcagtattggtatgatgtcacttcttcctaaattggtctctagagtcaacagtctcaaatcaagatgccattaagccttttgggcagaaattggcaagctgattctaaaatatatatggaaactcaaacctacaatatccaaaggaatcttgaaaaaagaacaaaattagaagtataaattaagggctttgtttttttgctctcaggaaccttaagactagtggggaagactaataagagaccccatgctgcttcctaggaatgtagggtactggtgaagagtatagatgctagagcctggcccctggctttgaatgctggctttgccacctgctacctcatgaccttgggcagggtacttttcccctctctatgtcctaggtgtctcatctataaaatgggatgatcacagcttcattgccatggggccattgtgaagatgaaaggagctaacccatgttagcctaaggctgcctactaggtgttggggaagggatggaagtagaatgaggacagaggttccgcccccagtaccgtatgtcctttggagaaggaaagcctagaagctgaaccacctttccaaaaagggaaattctggaataaggatctcaggctctgtgagtacagccacctccttttctaagacccagactggggaaatagctcatccagggtcacttggctgaaggttaaatacagaggaagtgtccaacaggcagggagtgtgagcaaaggtccatggcaaggagttacagcggtgcttcttgggccatgggagaaggctgtttctggagtgccgagttcgagggggcatggggctaagggacagccagcaggcatgagtcaccaaggggcaggctgccaaatccaacaggacgccccatggagccctttggcctgggcccagctcagcagccccctccccatcccccggacacacgtaccccaccaggcctggagacatttcctgaaagactaagaaagcactgggagctggacgggcggcctcaacggccagaggcttgaggccaggtctctcatggaggagcagacgaagggaggacgtgaccggcagccttcattctcacaggccagggatttcagaggaacgcggccaagtctagctctgaagttcccacttcagaccccgcccggctggagccacgggcgcctgcagtcgccaccctggaaatcagagaggcacgtcataggccacctcgtgctggggaacacgtcctcctggggcctctgtcagctggctcacctgctggggttcccggatagcccttctccttctgctgggccatggaccctcctctagccagcttcccccaatccctgctctccctcagcccccaaacctgtccaccttctcactccatcttctcaggagagtcctggcacccagaacagacctcctaggaatgtcatgtctctgtctttgaggtcatgagcagacctggggcaggaaggggaggccctgtacaagccctacactgtggctcaggcccagagaggggttgacaccaggccaaaggagggacacatgtccacagatagctcccaggcctcctgcatgctggctggtcagaccatgagagccacactggacaggtgaggaaactgaggcccaagaggaaatgtgatttgcccaaggccctatagcaagatagaggcagagcagaatggaagacctaaggctcccaagccctgagccccaagctcttttaagtcattttcatggtttcacttcattttcttttttcatttccttccttctttaagagaaaggcaggctctggatagacaggcagggacacaggcagggctaccagaaactcagaggaaagaagagagtggcccagggttgggcagcctctacccccagcccccaagctgagtggaagcccctccctcccacccagcctcagcctggccctgggggctccccttagtgggagctaccagtttgtggacacaggaatgtgcctgtggcttgcccagagaccctgagggccagcacctcaatcacagcatctccttgccccaagcagcctgccccgtctcaaccgtagcttttatcaccttcctccatgcctctctagtgagtgtcttccctgagtcagcagaacctgttcatagtcatcccttctcccagattaatctctctctctctgtagccttccctgatcacccaggctgctggagtctatctgtgccctcactgggcactcagcttttgccacctggtgttcttagtgtcatctcttgggtctgttcctgtctctctaaccaaactttaggcaactttgttcattcaacactccatgaattcaaggcctaccacgtgccaggccctgggctatggtgggattcagcagcaaacagacagactcagcaacctgccctcatggagcttacattctagcgaggaggggatgataagcatcaaagcaacagatctgcaaataagtaaatttccaaaaggctgtggagaaggaagcagggcatgttgggggacaattttaaatagggtgattggaaaagagctcacccaggtgacccttggataggcttgaaggagtgagccgtgcagacctggggagcatcctggtcaaagagaaagagcagtgaaaggcccagaggcaggagtgtgcctgccccatgggagaactgcaagaagtccaggtcaggggggtgggtgggagccatgggaaggcatcaggtcagcgggatgctgggatctataggctcacaaggacgagattagctctgagaggggtgggatgcatcagagggtttccagcagggaaggcaaggtctgacctgagttttaatagcgtcactcaggctgctgggttgagaggagtctgaaagggtggagtagatgcagggataccagcctggagcctttagggggacaatgagcataaaagcaatggatccacaaatctgttgagtaaatgtgggagagtaaataagggagagtctaagtaaggggtggtggtgaagtgattagggtgaagggacaggtcagagtctgggtctactttcaaggaagagctgagaggatcctctgaaggactggacgtaggtgcaaaagaatgttggggtcaaggataacctaagatctggggcctggacaactggaagaggggcttaccactaactgaggtggggaagatgcttcaggagggtggaccaggagctcactattggacatgtcatgttggaattgtgcaataggaagtggccaggttgagtggacagttggagcccggcattcagaggggtgatctggatagaaataagcctcagggagctaatttctatccaggtggtatttaggtggtgctattaggtggtatttaaaaccatgagacaggatgccatctccagaggatgaggatctatggtacaaaggccacttggtgtagagcagaagctgtgtctccagttgtctagagttatgaatgggtggctgatgacggggctctgactccaccgctgtcacaacaggccaactgcaggagagaggcttcagcctctgccccctccctgggatccccttgcaggctagcacaagggagggctcaggagagacaagtaattatccttataaatcaggaggctcctgccagggagaagcagggaggggcaggctgcaaccccaccccctctaagtctcttgacatttcctgggaaagtggtgtcattttatcattttattccttggtaaggcttaaatttcagctttgggaaactgacagagaggataggataggtgcctgggggccagctttgctccctgtggctttatataactcaggcctttccccacagccatttacaactctggcttctgtaatgtggtgccagcaggattaagtttttagcgcccactatattttgtgctctgtatttctgacaaaatgtttcctccctcatgatgatagctcagtaaacagaatcccttggcgcaagtgacatgctgggtggccacaggctccagggggcttcttgtgtgcccccttctcctcctctcttttcttaacaattagcccagctcaagtttatcttcatttattgacttttccctaaaattgctcccaaatacttctttgaggctgccataccaatgcccaagcaggaaaatagatgagttcaaaatggcagcccaccccagttttatccgacttgagtgccatttccccaggaaagtgggaaggttttgggggaaaagcctgatttccaggcagccaatacacagaccacaggactgtatcacatagcccagccttgcagatgagatcctgagtctcccagccacccatgcccgcacagtgctggcagtgggatactaaaaattaagcacctgttaccttcgcttctgctctacagatttcatccccatccccatctccccaggggaggcgaggtaatctgtaccaccttgggatcctttgggttttctgactagtagcccaaagggtggctctcagccccccaaagcaatgccccagggccattctacctcactttccccattctagcccccagcttggttcctgctctctgcccattcctcctagagatatgcagtcaataccactcacatcttttgctgctcctttgacagatgtattcctcccagctcagttccaagctgaaggcatgggtgagcctttgaacagtgttaagtcacattaggcacagaatcagtgagggttcggcacagcagtgctggaaagacagggtcggggaaagccagatctaagggccatctgcaactcgagagctaagggcctcagctaaactcccaaacagcaaacctggcctccccagggtgggcgaagggtcttggggccgggggaggggttgctgggctacggctggttctcccacagatggggtggctctggctgagtagtggggattgacatttcagtagccaactgcctgaggtggggggttgaagggaaacttggaatcagagggaagtttgggaacattcttcccagaatagctttaaaaataggacagctttacaaaccacccaggatgattgaaggcaggtgggatcgaagcagatgccctctggagatgccctctggagatgcttgtcagactggaacatgtgggaactctggaggttttcctgattgttcagcagatttcagaaggcagcctcggatcttccttcccccaggccctttgtgtgtattgcattcgagtcagcacctggcagagaggaggcccacaagcatctgtggagggagggatgtgtgtgtggatgcatgggtgatcggtagggggttgcatggatagatgggtcagggtgggtgagtagatggatagatggatgactatagactccacattagctggcgagagtcctgtgtgaggattcatgcagaacatggcaatcctaagtggttagttttgccgtagcttcctgttaaatagatgtcaccttcaccttaggaagaagctatattttggaagcaggtggcattactcctggctttttttgatccttggctggcaagcttaccttttacttgaaggatactgtgtcaaaccatggacttagttgccagagagaggctcatcagagcatggaggctgtcatttcaagagcccccataactgccattctcctctcgctccctagaccccttcagagtgccctacaccctgcaggtgggccttagcctctcccccaacctgatttctccaaggtcacaatttcttgggattctgataatgcagtttttgaaaaatgggccatctcatgggctaccacagatgcaagcctgtacttcaccttctcatctaaccaggagtattttaagggagtcccagataaaaggaagcctgcagtgagctcttccatttaatgaagatgcccattggggaaaaaagtcacttcttagttttatcttattcgggtttcttcaaatggcttgcaaagaggcacctgcatccccaggctctttcagatgggtagtcctattttcccaggagctctttaacctggaaaatagaactagtcctccttcctctggttccccagaatcaagttcaacacttgggtatactttctctgttgtcatcagcctgattactaagaattctgtgttgggaagaatttcagactattaggggaggccatctctcttgagggagggtttagtgtaagaatttaatgtttatagaaaacggctttttttcccccaacacaagtctttgccatccacaccctgggaaagccgagccacctggcacccacagctctcagccaggtaccatctttcctgtgctggaagtcactggaactataggtcaggacagggaagagaagcaatccccaaatgcccaggtgttggttggttggtttgttttttgagatggagtcttgtctgccacccagactggagtgcaatggcatgatctcggctcactgcaacctccacttcccgggttaaagtgattctcctgcctcagcctcccaagtagctgggactacaggcatgtgccaccatgcccggctaattttttaattattttattttattttatttgagatggagtctcactctgtcgcccaggctggagtgcagtggtgtgatctcggctcaccgcaagctccacctcccgggttcatgccattctcctgcctcagcctcccgagtagctgggactacaggcgaccgtcaccatgtccagctaatttttttttgtatttttagtagaaacggggtttcaccatgttagccaggatggtctccatatcctgacctcgcaatctgcccgccttggcctcccaaagtgctgggattacaggtgtgagccaccacacctggcctgaatgcccagttttgaagttggctaacatgtccatcattctgcatgtttatggatcagtgagggcctgtgtgccgacaaagggagcaagctggagatggtgagaacagaaagtagcttatcaacatggacatgatgacaaggaagtggccatccgaacctctgccatcccatcacacctgcccccacactcaaccccacagccacccaagggcagaaggacttagaacaggcaaagccagcccacagctgcccaggggagaaggacttagaatgctcttgcctcttttacatgctcacagcttctggaatatttgtaagtgcactcctactgaaatcgcgtgggtagctgatctgagggacttgtgtgacgagaattgtttcccctatccacactgcttagtgagtctgggctggagatctacagtttccttaagaccatcctttatagagctcaggtcttttttctgacagctggaatcacaggtgcccaccccagagcaaaaaggccatgtcagccatctgcagcactggcctccctctgcccaggtctccaatgtacttgtcagagtcccctgtggactccaaggcctcctgtgatcagccacccggtagatgatttcccagagcactaccctatagggaatatctaaactatccctaatttttctcccttcaaatccaacttgtctcagtcctgtttttctcataaaagggcaactttctggctgggcacgatggctcacacctgtgatcctaacactttgggaggccgaggtgggcagatcacttgaggccaggagttcaagaccagcctggccaacatggtgaaaccctgtctctactaaaaatacaaaaattagctgggggtggtggtgcgtgcctgtaatgccagctccttgggaggctgaggcacgagaatcacttgaacccagtgggcggaggttgcagtgagccaagatcgcaccactgcattccagcctgggtgatagagcaagactccatccaaaaaagaaaaggggtgggggggcaagtttctgagttctgatcccttgaactgtgctggcatgaattgtagctgatattttaccttgtgagttgactggggatttgctggggagacagagccttatcctgatggtgcggtgttaatgggctgacctcaggcactgtggtattctggggtggggggatgctctgaggcagaaagtgcccttccacgtgttcctcagattcatccaatgaggcctgcacttttagtcctccctgggtttctctcctgtaaaacaggaatcaggcagttagatctcatagtacctgtgtgaggtaacagggagcatcttactaacctattctccagatgcagctcagcaaggccgagtgacttgcccaagctctgctggtactctgcactctccttggatgtttgcccaggaagcagagccctcggtggtgggcaaagccagtagcaggtggagagagaccctgccaggcctctctgctcctctgaccacagtcagagtgtctcttatcacctgggtagcacttcctctgcccgcggcagagccagcgccaccaggggcaagcagacgggtgaggaggtgccagacaggattgatagttccagcctcctgtcctttccttctgcagacctgtgagggagctggtgttatttttatctggggacactggcgtgggaggtatttgttaacgtcatctggtaaacgcagttgaattatctgttgtccaaggaaccctcaaataagtagtgttaagcatgctaagccgctcacatttaaagatacagttagactcctgggagagaatttgcttatgctgctgccatcacaactgaagcccagagctgtcagttccagagcccgggctttatttaaccctcttcggtttggggttcatcacacataagggctcgtgcttttttgaaaaccatgcttccctatctgttctctacaagtgggaaagtgcttgcagtctgtgggttcagtgcagggacaggttgtctgcacttgctactgagtgtgtgttaagttagcacagtactgagttccgagtcccatgaagtaactgtgtggcataccggtgtgtgtcctgtgcagcctgcagctttctaaaggcagtttcggggtgcacccccacctgcaggccttacattatagccccctctcttaatgcgctccccagtatttctcaagtgcctctggatcttgctgtgtcctgagaagttgtcccatgggtgggagcattgggcaccattgtcactctcagcagtggttctcaaccaggagtgattttgcctccagcagacacttggcaacgtctggagatattttatctggagctttcacaactgggggtgaggataggggcttctagtggcattgagtgggcagatgcctacggtgcacaggacagcaccccccaagaaccaatgagccgaccgaaaatgtcagtagtgccaagaatgaggcaaggctgctctaatcttgaggcagatggagcctcctctcgctgccaccagcgcgtgacttgacaggaggtggctgggtcagcagggctatgagtggagaaggtgaatggtgccagccagcagcctcgggtcacgcggagcagttcagaaagtcttactgagctctgcaaggccaggatcaagccagattttaaggggatgataagcaaggtgtggtctctggccataaagacaaaccatgcagttttgtagaatactctcagttcacaaggaggttgtatatctcttgcctcattcaatcttcacaacaacttatgggcttgatgggacaagtagaatcagccctattttgtggatgaccaaactgaggcccagtggggtaaataacttgcccaaggtcaaaaagcagccccagatgatggatttctggtctttcactagagcatttggatctctgtgctcctcttccctcttgggtcctactggatcccatgttggtgaggaatcagtcctttcttgtatttttatctggggacactggcatgggacgtatttgttaacatcgtgagtggacacctgaataaggacagaatgaacttcccatcctagatgccaccctttctcctggggaacttctataatagcccaaagccagagtaatttcattttcatgccttctctggccaagctcagatctagccagggacttccccattaatataggggccagaagcccacctctctctgtgcacccagattatttcctccctggggttgccactgccttggagccccccatccatttattcagttaacagatacacactgagggcctccaggggcctagacgcagcaggtacattgccgaataaagcagacagagtttctctgcccttgcagaacttgcaatccgagtgggagaggcaatcactgaacgcataagcttacaggtgtgtcatttccagttatgatggggccacacagaagagccaacacaacacagtgagggatgtcacaagagtggagggcctacttagagaaggcagagggcctctgggaggagaaaacaagtagaccgagacttgaaggaggtgcatgtgcaccagcttttcagcagccggaggaagagggtccccagctctggttagagaagcaccgtggggtgaaggtggggcaccttggtatgcatggtgacaggatggatttttcttccccactctaccagtatttcacagtcagcatccccatcatcagaaatatcttgatggcctccattcacacatcaagtcaacgtgagtccccacactgctgttttatacctggcagttttgtactgttttgtactctctgccagatactcaagagaggaaaagaggaataagatacccaagaggcttacagtctagccaaggaaataaaacatgcaggcaaaactagggccagccggaacatctgcccccatctccagccagcccatcacattccccaccctcagtcccctgatgtcagtagccacctactgttctccctcctgtctgcagagataccttccctcttgctgactccaacacccaccatacactggccaaggtgtgggaggtcagccaggctaccccataacacctggcatggataaccccccacacacccatgtccttggtaagaccaaagaagcaggaggagcaggcatctgcggaggtgctcccctggccaggcattttcatcatcacggtgtttagccgtgtttcccttttctgggtggggaacgtgagacggtagaagacctggggcttgcccaggtccaagggctgagtgggagtcggaccagagtgcctcacccaggcctgtctggcattcaaacccattgtgcatatcttgacacactagtgattttcatgtatttttagcagaagagttgtttttccaaactcaatctcaggcgtgtcctcaaccacatgaaacagacctggcaaagggcctctgcctgggatccaggagctttgagtctgcccactcaactgcccttcacccatccccacaggtggcccaagcctccttgggaacaacacaaggggcccatctagtcttcagaccggatctcagaacgaatggagaaggtctgagcacttccttcagggccacccccacccccggcactgctcagaacagacctcactgagtccagtggggcagaaccacacagaatggcacactgtgagagaggggcccattcagacagagcccggtgcaaacagctgccatccacgtctgcagaaatggcaggcacaacagtcacttcctggtctataaccccatatggtctccagaggcaggcacaggccaggatcaccatttcacagacgcaaacgttggtctcccccaagctccctagactttgtgtccttctctatcctggctccctccgcctccggctgttcctcaactgttgtccagtagacattttgggatacggcttagataaaggatgtgtgcactcccattgcagcttccttgagggataatgccacataaatgttaacatgacttttaaagaccatctgtggcaaagttcaaagttgtgggtggatgtgagcttcaggccgagtcattctggaatccccattataggtcaaatctttttgtgagcatttcaaggggttttctcaaattctataaatagcttagtaacgcctgtgtattcatctatttttaaagccagtcttccggacaatttcagaagtaattgggccactcattgaaagtagggtttcaaaagtcatttcttcagcttccaactgcttccagagcagagggatcccagatgccatttctgcctagggttggggacccaaccttcttagtagaacctggtccaggcagaaaccgtggagaagactctaggaatctccaaaaagctggataagctgaattctggccccagctcccagttcctcccacaggaaaccttggatacaacattcatccaacttatgcttcagtttctcacatagcagaatatgggcacagtcaccctttgctgattaggaagggttattacacctgtttgcgtcactctgtcacctgggtgcaggtcaaaggtctctttcattttatagataaggatgcagaggcacggtgactggcctgacagtcacatggtgactttccattttatagatggggacacagagtcacagcagttggccagtcttgctgtccttttattttgcggttggcctgctcctcaggctgaggcctcagtgagcacagccccactctgtttccacagagagcttcatgtcatggataagacctaccacctgtgcccgggcctaggcctggcaaacacctgtctccaagccctcggcctctctcctgggcaggatggcagccaggcagggaatatccgaattctgcagagacaacaactcagccctctcctctgaggacctggagggaagtgtaaggcaggggtgggtggctgtcatgtctgcatgatgaccttttcaaacttgatgccttggggggtccaaagagcaccaggcccaggatcagagacctgggttccagctctgtcaacctcagaaggtaggcagatcaaggagcctcatcctccagtgagctgctgtgtggggcagagccaggaaagctgcaggaagtgcctagaaaggcagagtgctgtgtagaggtatggcgagacagtgacatgaacatcaggcaggcggcagagaagatcagggcgccagcacgggcaccagctactaagtgtgtaatcactgagggctgcccttgagcctgggaacttcagccccctcacgccccttgacctgacaagtggtactaacgtcctccctgaggctgagtccagtgacaccttgctttgaggaattcctgcttgtcccactggtattcttcatctgtcagacaatccagccttctctctctgctcaggctgaaaggaaaacttccagcctcttctgagggcttttcaaggccacagccacagcaggtgctggctcccttgcctgagaataaggcttcgcgcctgcctaagtgtgagacagaattcctgctggatcagcctgacttctcagcttctctctgctgcaacccagcgccatccccccgcctccctgtcccctcctacggatcagcagagctgagcctacctgacctgattttgccaatagaaatatgctgggtgctcacagcctgggaaacttggaaatgtctccagagtgatccagatttagctggaagtggctgatggctgttcccagccacagtgtgtgccctttgtctagagccaactgctggggagaaagcatttccagccacagtgtcatgaaccatcagtcacagagaatgtgtctggtaattttttattaataatagttaaaggatcggcatttggggcttgattttcatgtccattgattagagcagattcaagataatcctcatcatatcactctctcttcattcttttggatgggacagaaagggcagcaatcacccagtacatcgggaatttgacatgatgctcaggagagtgtcaggcacctgtgacagccacccgatggtcctaggtaaggcctgtgattgcagggggcagctgttatttctgcgtgtggtccagggatctgtcactgagcccacctgccccagctgcagaatgaccacatgacctggttctgtccaatcagggaaccccatcaccacagccacagtgattgggctgagagatagtcatgtgatgagcagggccagtcagaatccttccctgagatttgagggtttgacatttggggagggggggctctgtcttccttttggctcaagaaccattatgagagagaccaggtgctgctgaccgccatcttagccatggcaaagggagaacctgtctgtggcagcagaaaaatcagtcagcatgcaagtcaaagcccagacaagggagagaggggagagaagggaggaccagccctggggttgctgtttgagccctggggacaggctgtgtcctagggcccaccttccatgtaagacagcccaggcctgtgtgcctcttcagctagtctgagatggtttctgtcactggcatccaagaatcctcagtgtctaggggcagagcagagtgaagcagtggaatggtcaggggtcgttggccagggagatcagggatacttggggaaaggttcaagtccacctaaaaagggacacacccaaacccaaggagtagttcagggcccagctggcatcagaactcaagcaaacttgtcccagggcggaggctgcagcccagtgcccacatggtccccgtctccctccagacaagatgtgcagccaccacagactgttgccagagtgcagagtgacatgcaggtcagattctgactgctccagagtctaggtgtggctgagtcctcagggccaggcctcagggctcagcaggactgagccaagactggcagctgtggccaggacgtggcatgatggccagctgtgagtacagcccagcagacatgccccttggctgggctgcatgtgcagactgccaggggtcgggggcggccaggtccgaggcaggctttggtggatggagtaactcaggatacagctaccaggtctctctgccgcttattcagcacctactttgcaccagatacgttgcacatgttactcatttaagccaaggaggtttgcctgacccaatcagactgatgccaagaccttccacgatgctgccctaggtgggtgtgtgagaggcagggtccatgggctgccacccaggacccgggcaataaccagatcaccccttccctgcttctcctcctatcctgactccagctctgctagaagcactgcccacccagcctcagtgcccacttctctgactctgcccctcaccgtccagtccccagcatccaggccccagtctcatcctcatccccagggcctgggaatccattattttgtcacctaggagaagcctgttgtactgatgagttctttttgtcccaagtcacaggaaccaacttgaggtggcttaacattgctaaatccttttctgtaaggattctgaggtttcatggagcccagaagtcccagggaaggacagaagggaacattcagggtcgtctctcaggctgggggtaacctgatgtgtcacagtgtctgtgggttccatgctgcaggccagccctacgcttgggaattcccagccctctgcttcactgttgataggaacaggtgccaaggaaggactgcactgtctctctgagctggaggctcctgtcctgggctcctcccaaatgatgatgactggggtgagaaaagagccttccaggaactacccaaggccaggtctagccatgggggccaggccgcaggccctgggctgtgtgataggaacggaggagtgagggggcttcactggtgggggggaccaaggaggaaagcctgccggggggattgcaactagcctcagcaaagccctgaggggagagtctgacacaggggagactcggggttggggtggagctacattgacgtcaactgtgaccccaccacaccaccaaagggcggctctgcggaatgtcgtggccttacttgaagcaaccctgggaagggggaaaaaaaatccaataagccaagaaacatcactgtatggcaaaaatgttacccacaaaagtgaaacaaatgtcatgagacggtggccttggagcagggactgggactggcccagagaaggtgggaagaaaatatcaggagtgaactgtcagccacaaatgaaagaaaagatgagacaggcatacatgctgactctgtactcttatgtcttagattaacagccccctaccctttggacaggttgtcctcttagagaagagctgtctgaccacgtaccgtgggatatttatgcatccggtccacacacgttcattgaacacctacaacgagccaagtcccattccaggggacatgaagatggctcagaaaacaggattcctgccttcaggaagcccttctagcaaaaagtcaggtcatcaacagacatcagacctagtggaggtgatcagggctgggaaggaagcatagcagagtcggaatgaggagtcccgggggctgtggtggaggggacagccagggaagcctccctaaagagggaatgtgggagcaggaaggtgaaagaaggaaagttggggccaaataaaaaataaagcaccttttatttgaaaattagtttcctcttttcagtataaagaattctgtcaaatatgttttttaagccatgcaaccaattgcccgggagaagaatgcctgggattgactcctggctgctgggctcccacagctccccatggtctgtccctcccacatgtatccagcttctcaaggaaaagaaacttcctgctagcagtaaataaaagtgcactttctcctccccactggagagatggcaacagcagccacctctctggacagaaacaaaccagggtcactgggggcatagcgtttggatgggcaaatttccctaggccattcattttccaagagggagcccgaaatgaaggtgagtttgcagcgattggtaggggctgcccatctccctcaggaagtgtaaaaaatatatgcatcatagtccttgtgcctcgactacccccaaccccaccctccagcagcatctccctgtggtggtttgcgctgctgggtggtgtgggggtgttttttcccctttgcctgtatacagctgtttttggcttggccactgcgctccaccatgccagagctcatgtggttatcccgagtgggaagaatttcccagaatgccttgagaaacctgagacactgaatggctttcagggcttattgatgtggccggtgcaggaaatagcagtacgtcaataaatagttttaggcaggaaacggggcttaaatggtagccttaaagtttggggaaaggcactaggggttgctgggaggtagcctgccaatcagatgagaacctagagccaaataccaggctttgaaatggctgccaccaatctgaggccccttgctgcttttggatacaagaggctgaggttaggggcagagctagaggaatggcttgtttcggttggcagaaaggactccttgttccagaggaaaagctggcaacctataacatgtgtcaagaggagacacacaggctgggttttggtggcctctgggcggggcatgttcacaccccagttccccacccttctcgtgagaatcactgctgactggcagattaccagaagaattccactgtcctaatgcaaaaaatcaaggaaaagggtcacaacctgccagtttcttttaaaatagctgtttttctgattataaagagaaacattcacagagaatcagaaattcagaaagtaatgtagagaataaaggtcatccataattccgctattgagagacaactcctgtgaaacactatttctcctctttctttttaaaaaaaactctattcatggatgagattatatggtaaatgcaatttcagttttgcttttttcatttaacattatataaacattttccccatgctattgtaaacgtttcataaactttttgttgttgtgttttttttttttttttttgagacagagtctcgctctgttgcccaggctggagtgcagtggcgcaatctcggctcactgcaacttccacctccaggtgcaagtgattctcctacctcagcctcctgagtagctgggattataggtatgtgctgctatgcccagctaatttttttgtatttttagtagagatggggtttcaccatgttggccaggttggtcatgagctcctggcctcagatgatctgcccatctcagcctcccaaagtgatgggattacagacgtgagctactgcacctggccacataaacataatttttaatggatgcatgaatcatcatttacttaattgttcccctgttgttgggtgcttaggtttttagatttttatgtgcattaagcttattttttctaatattttaaattgtttccttatgataattaccagaagtgcaactaccagagcaaacaataagaactcttaagacttattttaaggattttcagaaaagtcataccaatgcccatatataagtgcctgtctcactgcatccttaccagcattgacaattaccattttaagttgtccttatatatatagatgggaaaaagacgttttcattcattcaattactactgatattgaattaagttgttttcatatatgtattagtaatttacattttgacacaggatttacctcttaatgccctttccccatttgttcatgagggatttcatacttttattacaaatttgaacacactatttatatattaagaccattgccctttgtcacatttattgcgtgtattttcctgagcatatcaattgtcttttaatattttgatgcattcttccattgtcttagtgaagaaagcccccctccttccagaaatgtgagaaatactctttcattctcttcaaatttttggtcctttttttttttttttttaacatttgactctttattccatctggaatttattttagagcccagtgtgaagtaagattctaaattattttcctcctgatacttagacagctgtccctgcactgttgcttgagtgaataatgcttcctttgccactgatttgtggtcctcaagggatcatgtgataaacctttgtggatgccaaatttgtttctaggctatctgatctagctctccattcggatgtcagctctacagcctcttaatgaataaagctttattaaggataagttaagagtagtgtaactctttccaatgttgttttgtttttagttatttcccttgctattctttcaaattacttttaggattattttttcaagtcttcatttccttttctcccaaaaaagttcacattgggatatggagtacagattgatattaaacctgtgaattatttcaaagagaattaccatcttcacaatgctgtcttctcaataaggaattgtgtgtgtttcttcgctagttgaagacgttctcttaaatctttcagttttgttaggcaattttctttatagaattcttgcatatttcttaataatgtcacttaagtattttattgctttattaaatgagctttgtacattaaaatctcactagttaattctgtcataaaagaaagctgttgattttgtgtattaattttgtatctaaatattcttattaattagtcactgaactctcttgttaatgatactctttattaaaggcttctctcagattttccatatatttaatcaaatcattttatctcttccattctaagggtcataggtgttgctgccgttttttaatcaagcctattgaagtaatacattacatttatagatttcctgatactaagtcatccatgccttcctgataaaaatctacttggttataatggatctgtttgttagtatttcacttgggattttatatctattcacattagcaagattaacttgtagacttccttatttgtaacttactatcatgagattttgtttatagggaactggttggaaagcgtctctttttctatgttctgagtcagtttgcaaaggaaagcagttacctaattttttggaagtttgaatgaacttacctataaaaattgtaagtttagagatttccttataaaggtaattctttcataactttcattttagcttatgaatttttagtttattctggctcatttcttttttagcaaatgttgatttttttaatgaatcacctatttcatcattttttcaaaattatcaacatagagttataaataattttattatactttttttctatatcatatctgttttcatatctaattttatttctgtttcttctttcttgattttatatgtgatttcctttctctatttcctaagtaattaatttgggggttttatctgtattatgtccttatatttccttagctattgttggttttctaattgttttagttaaatgtttagatcaacattgtctggtagaagtataatgtgatctacatatgtaattttaaatttaataatatgtgttataaaatttcataggtaggtaatatttttaaaatatgagacattttacattctagtttttatactaagcctttgaaaagtaatatctgttttacgcttacagcccatatcagtcgggatagccacacttcaagggctcaatatattgtcacatgtggatagtggctaccatattggataacattggtttagatgatatattttcttccattatttagtggccaaaatagttaagactataaattgacctttcattatagttttgaccacatcccacaagtttttatagttatttcctagataatctaatacaggtattgtatatttgagtatgtctttatttcatttttctttagaagaataccttttaagtattcaagcaattggctattttttaattgttgttaattcatagtcccagtatgtaacctgtacaatttctatgttttgaaatttatactgagatcacagcttactatgaagcttgtttcaatttaatcttattaactatattatttaaatcacctaagtcatttgttttttattcatttaatcggccatagaatgttagtggttttatttcctgatataattcttcctttctggtttttttcctatgtttcttttttttttcttatgtttcaatagcttcaggtatattcaaatctatactataaagtctataacattttgtgttatctctttattatggattgtatttttatatataaaaccttataattttatttaataattgttatcttaaaaatacttcccttttactactactttattttcatttgctcactcttgtttttacccatccatttatttttttatatcctgttttcagttctgctagtggttactagtgtttacttttagcattttaaaggcatactttcattttttttctctgattcccaagcttaagaaagatgcaataacctgtgaatccttatggcctaaattaggaaatgttgtgtgctttacagacttctatccccttcccaccagtatttactaatctctagtaatttaatcttggattattaagtcactactactataaaattcttatttaaattacattttaaaattaaatatcttctcttccaaggattatttctggcttttgattccattgtataaccaaaattataatgacttattttaacttaacttaataagtctacctggttgtagtttcagttttcccttctgtttcttctataccatggtttcctcagagttaaatcataaattttgttggccataacatgcattcggaaagttctttttattttttattatttttaattgtagttttaaaataacataaaatatactatttcaagcatttctaagtgtacagttcaatagtgtagagtcacattctcatgcaaccagtctctaaaacttcttcatcttgcaagactgaaactctctacctattaaccccccatgtcccctgctccccagctccttgtaaccaccattctactgtcgtttctgtttatgggtttggctactttagatacctgcataagtgaaatcatgcagtattgtctttttgtgactggcttatttcactttgcataatgtgctgagggttcattcacgttgcagcatgtgtcagaatttctttctgtttttaaggctgaatagtattccactgtatgtatatatcacgtattgttgatccattcatctgtgggtggatgcctgggttgctcccacctcttgtcagtaatgctacatactgacatctctttgaaatcctgatttcatttcctttggatatatacccagaagtggaattgctggatcatatagtaattctgtttttgatttttcgaagaatcaccatactattttgttttttgagatggagtctcactctgtcccccaggctggggtgcagtggcatgatctcagctcactgccacctccgcctcccgggatcaagcagttctcctgcctcagcctcccgagtagcttggattacaggcacccaccaccacacctggctaattttttatatttttagtagaggcggggtttcaccatgttgctcgggctggtctcgaactcctgacctcaagcgatcgacctgccttggcctcccaaagtgctgggattataggtgtgagccaccgcgcccagctggccatactatttttcatagcaactgcagcattgaattttttaagataaacatgtaggagtgatttgttttagaacttgcttatgtaagatctttctctcgctttcactcataggcaggtttgttcttttcccttcaaactcatgaagacgttgccttcatgtctctgaatttttaacctcaaataaagaagtataaggccaaccagatttttcttcctttgtaagaagactgtcttttgttccttcgtagctgtttttaaatttttctttttctgcgaaactaaaaaagaaaattcagcgggggcaacgtagaccttgtctctacaaaaaaatttaaaagttagccaggcatagtgttatatgcctgtagtcccagctactcaggaagctgaggtggaaggatcacttgagcttaagaggtcgaggctgcagtgagccttaatcgcaccactgcactgcagcctgggcaacaaagcgagaccctgtctcaaaaaaaaaaaaaaaaatgaaaaaagaaaagaaaattattccgctaagtaaaactggggcagggcaagggacttccggaacactgtgaacactttttacccaaagagtcaactcatttttattattatttattttcagtgagaaagtttatttctctgctctctttgttctgtgtattctggtatgctttttgaaaacttctctaattcacagactagatgtccactctctatcttctctatcgtttttctttttgtttctagtctatttatctttgtattcagctttctggtctatttatctattctgctctctaggtggtttccaagtttatcttctgcattactttttctgcattatccattctatcctttactgcctccaattcattttgattttgctgttggatttctagtttccattggctctctcctaatcccagttcctgtctcacacttcatttcagcctgagagttgcttagctaatcacaatcccttccttcgaatgcctattcacacatcatagaatctatattgtcattctccttacatacaagcccacatgttttgcacttgagtttttcattttatttatatctggttgattgtcattaatatgttcagagttacacatttccattaagttttcacgacactgctcctttattctgccaggcaggatttttgtgtagatgccatattgctctgcgcctccctcaatcctgaatgagatcacccctgtctggtcttttgtgtttgctgtgcgcatcagccttggactagcttggtgtctgcttaggcagagtctccctctcagacctaaagctggagggtggcttcatgagctcatctcaaatccaatttccaatatttagcaggcattcaatctcctagtaacctttgctagcccaaaacagaatgctctcttgatgccatggatgatcaggaagaaactgagtcaagagctagttctttgatcagatgcaatctattttttaaaacttcagttccttgtacacactgcctccaagttttttcctgccccagagggctttgcctgagagcaccatcccttaaaggacacagcatttcacccagtctcctcctgcccctgcactgccccgaatctccaaggcctggaataagggtggtgcagatgggagctgccttaatacacaggcacagggctttgctagtactgacagatactgtctaccagccagagacagatagaggaaggggctgaagcctcaagctaccccctgtctttggtcttctgggtcccctgggcaaccagaatttgttggtgacagcactttagttaatgatgtcacctcctgagtctgggaggagtctgctggggaactgttatcttccttctcagtgttgctgtgggactttgttctttgatgtgtgccttcatgggtatttttagggaatataaggaaatgacaagctgggggttgatagaggggcaccattttaacacccgagttagcacttgataaaggcctagagttgtggttcagagccatggttgcacgttagaatcagctggggagctgccaaaaattaccagtgtctgagccccaccctgaccagttacacaagactttccggggtggggtcccaacatcagcagcctcagagttcctccaggtgactccaatgtacaaccagggcaagagcgtttaacccagagcagagaaggggcttaatttttcattcaagttctagtactgtgtggccttagtcatgtcttttaatatctttgtgccttagttgtccccattttaaaatgagaatggtaatgcccactcttgctcagatcacataagaatattgtgggataaacaaaggttcatgagaatgaaaccaccaaaagatgtgtgacttcaagcccagtagtgcagggtccttggcaggccctggggtggcaggcaatgtaattcattcattcacaaagaccctgaacagctaggaccccctgtgaacactgcctgctccaggctctggactagggagaagagacaaagctgtcaaagatgctgggcacgcactacttgcggggtccctggagtctcttgtggtcccttttcaccctgggtgaaagataaacagcagaactctacaatcatacccaggtggacaattcagtgagaaaggagtggggaggcaggaggcctgaggggtcaatatgaggcccatgaggtctgcaggcatggctgcacttacaagggaccgtgtggacaaatggcttcgtggaaagtacagacttggagagtgactaagcgtgggctctgatgcactactttccaatttaaaaacaccataagagctgctcttgccacaaaaacaaacaaaacaaaaatgggtaactgtgagatgatggatatgttgtttgcttcactatagtaacctttttactgcctatatgtatcccattgcatcatgttgtataccttaaatatacacaaaaacattttttgaaaaataaaaaacaccataaggagaaaaaatgtttggtctccagagcaggctgacgtcagtttgaatcccagccctgccactggctcatagtcatgggcaagttacacaacttctctatcctcagattctccatctataaaatggggcagtaataggacctgccttataggaccattgtgataactatgtaaaataccacaattaatatccttggctcagtgtctggctcacaaatagcagctgctgctgttactgttttacatataaatatagatatcaaaatagttatagatacacacacaagtatatacttttttgtaactgatgaaactcaggtcattataagctgtggcctaggctcatccaaagctggcactgcagggcttctcagccagcccctgacctgccacctgaggagaccaaggcccaccctctagattgcaccttcatcactcacaagggacagatgttaaccaagtcatctctgagggccttccatctctggagatgctgagattctggtgccaaggatgcttggctgaagtcagcagtggtgtgggggactgggctgtgggaatgctctgagtcacattctacaacctgtcttcccatgttctattttggtggtgacacagtcacccagaccaagaatcttggcgtcatcttggagtctcccctttccatcaacccttacaacccaccacttagcaagtactattgaccttcacaatgtctcttgtgtcactcctgtattggtcagctattgaggctgaacaaacaaccataaaaatctcagtggcacgcagcagtaagcgtgcatgtagatggtgtgtgtgcaggttggttgggggtcacctgacctaggctagacttaggtgaggccctgtcgcatatgttgcccaccttctccctgggaccatcaggctagcccagagagagtcttcttaggatgacagaagaaacatgaaagtcaacataaatatttaacgcctcacatcagaattggcacaccatcactcctgcctcattctattggccaaagcaagacatatggccaaaaccaaagacaagaggtaggggaaatatctttctgaatattatttaagctaccccagattcttatctttcagctctcagagcgctgaggttttaatttcatcctgcctggatgcttgcagtggcctcctgtgtggtctccacaccttagctatattaacctttctgttgagcactggtatgactgtggtatttcatggccccatccccaaaaccttccctagcgaccatcccatggaacccagctccttggttttttatactttcttctcttgtatcacagtgatgaatgaatatgtcttatcttagctcctagtgcagagcctgtcacacaatggggcaataatatttttaaggaggatgaatgaatgaatgaacgaatgaatgcctaggcccctcgagggacgggctgtagctgtgtagcccagtgctggggcgctagcccacatggtcctctgttgccactgctgatgatgtgtgggtgggcagtgttctggttacccccagtccaccacgcagagggcatgacttgggggttagcaaagggagacggtttagccacagggagttaagtggaaaagtgctgagtctggggagggtgtcacctcccgttctacctcatcctcccacatcagcattgctgtcagtgaaggaggatgaccagcaggtctgggcaatgcctagaggcaaggaagctgtgtccccaacctggggacacctgaagaagaggtgttatggccccaggtcagggtggtcccagccacagagagtgcaatcacgcacccccatcctcatttaaaacatggggtttgcctgctgcccaggagcagccccaagacaacagatgctctgcacagcagggtggcacccaggcccctccccagccccgggaggctgacgcggtctctcatgcctccacagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggaggtaagagacctgccgcctgtgccccctgcacagccagacagcaccaggtctggaatgcgtctcagataactgggacaaagctgtgagggtaggctcacttagaaagggacccatccgggccaggcacggtggctcacacctgtaatcccagcactttgggaggccaaggcaggtggatcacctgaggtaaggagatcgagaccatcctggcaaacacgatgaaaccccatctctactaaaaatgcaaaaattaaccaggcgtggtggtgggtgcctgtaatcccagctactcgggaggctgaggcaggagaattgcttgaacctgggaggtggagactgcagtgagccgagatcgcacactgcactccagcctgggcgacagagcgagactcggtctccaaaaaaaaaaaaagggggcccatccttcagcaaagagatgtgcaacagcagtcacttctgctccccaaagccaggtctttcttcgttgggtttatataaagggaaccagcacccccttcccccgtggggtgttgtgaactgaggctccagtcattcccaatcgggagcactggctgcagaggggaggcctatggtaagtgttgtctcaatgagcgatcttggaattggattggactggtttgccactggattatttattctatgaaaacatattttcttctaaatttcatctgaaaaagaaagaaacaagaatgaccaaggaacttttgagaagcaggaatttagcaggtggttgcactgccagatattataactcactttctacacccctctggctgctgtcaggggagagaattgaaagggggcaaagtggaagctggaagccgagtggggctgcttaggctgcgcagcaagaggttggtggcttggaagacagcctcggagtgagggcgaagagcacgtttaggctctagttgaatttctgagttagagccagcaggactcggtaatgtgagttggagggaagggaggaggggacatgggctccccgtttaccagcctggtggccccattttctgagatggaggatactggatgagaaatagaatggggatgaaaagcaagagtcagttatgtttgagtcgcctgttagctgtccctagggaactgcccggaggttggccgggtggaagggtctagagatcctgaagaggtcacgcatggaggtaggggatagagggttctgggaagtatcgatatgcacctggtgctcaaagctggggaccaaatggaaccacgcaggaagagagtatagatggagagggagaggaagggggcgtgtaagaaccctcacagcagcccttcactgggacctggacgcctcccccatgttgtaccctcccaccaccggcaggcctctgcaggggctaccaggacacaaggaggaacagcctcctgagaatcaaaggaccaggacagaaaagtgtcctgggtttggcaacaagcaggtcacgggccctgggtgtcagcggaggtgaggacaggagtgtggacacgtctttcgagaagtttttctgtgaatggcagcagggaaggagagctgtggggtcaaggggcatctttatggttttgaaagaaagacaataatagagcaatttaagagaagggagggagtgtatttatgagtgtttttgaagcatccgtttatagaacaatagcatgctcattccagacaagcacagagcacacagttctctctcgggtgttttgtaaacccatgagcctctgccactccatgtacccaaaccacatttcttaacaaatgcacttgaaatcagatttgtttcgcagattcagacaatggcctctcctgactttgtttcactctcaaagtgccttgagctcagaatgcagctccaggagggctggcagctctgctttttgcaccctttggaatgacatggaggctaggagcgggcctgcgtggcctcttgggtcctcccatccttgcctgcattgccctgtgccctggacaacccacctcgagacagggagcagcactgttctagggcagtgacctgaattgccccaacacgttccctctgcgtgatctggacacctcctggtgttgtcgtcacctgctcctccgagagggaggcaaggctgtagccgagcgccggccctggctgctgggacacttttaacaccgcctgaggtagtgcaaatattccagtgtgagatccggaggtgccaggagatgtgtgcagacaagaacaaagagccacgcctaacgcacacttgttggatgcattcaaattttcgggccagtttgacaaacacagacccatccaatgctcatggtaaacttgaagaataaataaatcacctatggtcttctccaatttgtaaaagaagagggcagagccccatgtaccaagctaactagggccgggctgcagcagggttcacatcctggctctgttgttcatcaactgcaccacgttgggaagcatttacctgctttgagctttggcttcctcatctgtaaatggtgctcatgctgctttctctgcaaggtgcagggagggtggcaaggcatggagagacagctaagtgcactagggacaacgaggccggaggatggaaggaagtgcccggggcacggcgtctggcagagagctagttgtcatctaggctgatggggcctaggggctgagcacatgcctaatcttaaagggctacttgggctgagtgtcctgcccagggacaaacagctggtccatgccagagctggtctggagctcctgaactccaggtagggctctttccaggagaaatcttggcttccctaaaactgggccaaaagaaaagatggggacttaaaggggtgccctacggatctcaacaatccttgtgaacagcctgttgcctttcgcagctccgtagggacccctgaattcttcaagccatttgctgcctcataaccaggcttgacctacatccctaaagcaggttgagccggcttatggaagtttccagagccaaaggcacagctgcagccccctccatgctggaaaagcttaggctttccccctggggccatgtagatgtctgaccccaaatccacagcacccactttgccctgagatccccccaactcccagaaccacccgcaggcccacatttccagctgcccactacacctgtcccaggtcatacctcaggaccctccaaaaggatgtggtcagaactgcaccccaagaccccctgctcagtgcagctctcatgcaggcccccacccatgctgcctgcctccctgcagccaggtagcagccccagaacccacgccacggcctttccgctgtcaagtcactcactccatcccctgcgtctgtacccccggggctcccctgcagtgctttccttgctgcttctgagtaaaacccaaacccacaggccatctctgagtgaagggtcttgctgagggtgaggacaaacccaagggatagatgcaaagtcctcaccatccagcccgtctgggggtccttgtgctcacagaggcccccttcattctgaggtccaagcttactcggtccccacgctcctttagctcaagcatgtgcttagtccccaggcgcctcagcctggaggacacccagctctctgggagtccctggggacatcctttcacaccctgacctcatcaaattaaccattctttaagttactcaagcttgaaactttggagtcatctctgcctctctgtcttcctgtccctgacacttcttcctaggcccagtttgaagtcaccttttctgtgtggcaccccctcagcacaccaacagcttcctcctaagggacctggaagtgtcctctgtccttactgctccatcctcaccccagcctcttcacgttgccttgtagtagtgttcagtaacggtagcagcacatctcactgcatggacgcctccatctcaatcgagtgcctcgtgtgttcttttctcttttaactcagacagcactttgaagattatcatccccatttttcagaggagagcagagaggtcaggcaacttgctcagggccacacagccaccaagcggtagaatcagtcctggaatccagatctgaccaccccatttcactgccttgcaggcagagcaggggctactctgtttgttttcttggtgcataactcagcacctatatggtaggatcccagtagatcttggtggaattgattccatttttgccccaactaacatgccaatcagagatccttcttccagagatgaaaaagaagaattttcaatgtgtgcttttcttgtttaagaacaaatagtttctgccgaggtggttttcaaagtgattgaagaagattattggtcatctgtagctgcaggagtctccttgctctgctatttacaactcatatttgcttagcaagctcctttttattttttaaatatttttgaatttctatttttagttttactgtggtaaggatactgaatatggatctaccctcttcacaggtttctaaggataaagtacagtattgtatccatagccataatgttgtgcagatctccagaacatatgcatcttgcataacttaaactttcacccattgattagcgactccccatctgcacttccccctagcctctggcaaccactattcgttgcttctttgaatttgactattttagatacctcatgtaaatggaattatgcagtattcgttcttctgtgactggcttatttcatttagtaatgtcatcagagttcatccatgttgttgtatattgcagtttccttctttgtaaaggctgaatagtattccatcgtatgtatataccactttaaaatttttttcttggaggttaatatttgtacatatttatggggtacatgtgatattttgttacatgcatagaatgtgtaatgatcaggtcagggaatttaggatatccatcacctcgagtatttatcatttctatgtcttagggacatttcaagtcctctcttctagctattttgaaatatataatgcattgttgttaaccatagtcaccctactgtgctatcaaacattagagctgattccatctaactgtatgtttgtacccattacccaaccactcttcatctccccacccccacccccaacacacacacacacacacacacacacacacacacattgttttatccatttatctgctgatggacatttgggttgtttccgtgtcttggcttattgtgaatagagctgcaatgaacatgagagtgctatatctcttcaaaatcctgattcaagctcttttggataaatactcagaagcgggattgctggatcatatggcagctctatttttaagtttttgaggaccctccattttgttttccacagcagatgcaccattttgcatttctaccaacagtgtacaagggttctaatttctctccatccttaccagtttgtcttttgttttttttgctcacagccattctaacaggtatgaggtgatatctcattgtggctttaattaatttgcatttccctgatgattaatgacattgagcatcttttcatatacctgctggccattttccatgtcttctttggagaaaggtctattccaattcttagactagttttaaattgagttattaggttttttgccattgagttttaggagttccttatatattttggacattaactctttatcagatgtatggtttgcaaatattttctcctgttccatactttgtctttctctctgctgattatttcctttgctgtgcagaagcattttagtttgatgcaatcctacttgtctatttttgcttttgttgcctgtgcttttggagtcatatccaaaaaaaaaaaagtgtccagaccaacgtcaagatgctttttctttatgttttcttctagtagttttacagtttcaggtcttatatttaagtcttcaatccattttgagttgatttttgtatatggtatgaaataagagtataatttcttcttcgtgtggatatccagtcttcccaagaccgtttattgaagagactgtcttttccccattgtgtgttcttggcacctttgttgaagatcagtcgactgtaaatgtgtggatttatttttcgactctctattttgtttcattggtctatatgcctgttttcataccagtaccatactgttttgattgctgtagcttcgggatacattttgaaattaggaagtgtgattgcctcaagctttgttcttcttcactcaagattgctttggctatttgggctcttttatatttccaagtgaatcttagaattgttttctatacttctgtttttaaaatgcccctgggattttgatagggattgcattgaatctgcagattgctttgaatagtgtgaacattttcacaatattaaatcttccaatcaaagatcaggaataacacaaggatccccactcttaccactcctattcaacatagtactggaaatcctagccagaacaattagacaagaaaaggaaataaaaagcatccaaatctgaaaggaagacataaaattgtctctgtttgtagatgacatgatcttatatatagaaaatcctaaagactccacacacacacacacacacacacacacacacacacacaaactgctagaactaataaatgaattcagtaaatttgcaaaaaacataatcaacatacaaaaatcctttctatttctgtgcactatctgaagaggaaattaggaaaacaatcttacaattgcatccaaaagaaatacttaggaatagagtcaaccaaagaagtaaaaaacttgtacactgaaaactataacatattattttaagacatgaaaaaagacacaaacaaatggaaaaacatcccatgagcattttataatagcattctaaggacctctttctcctgcccaggtcctcagcctaactgtgactatgagggctgcacacacaggaggggtgcaattattgtttatggcctgagcaaagggttgtcatctccccatcagctggtatctctgagccaacatgccaggctgtgggtctggcttgtctagagccttcattccctgaccctacaatgctctccacctcctccgcctctccgtgcctctgtgatcccgtggtgttgttgtgaggctcttctaggttatcattgaatgcctctctctgagccccttacttaaagtcctttgttgaaaatttctctggcaggggaattttcttttctctcctttttttttttgttttgttttttgattttttctgagacagagtttcactcttgtcgcccaggctggagtgcagtggtgcaacctctgcccactgcaaccttcttcgcctcccgggttcaagcgattcttctgcctcagcctctcaaggagctgggattacagacgtccgccaccacgcccagctaattttttgtatttttggtagagacggggtttcgccatgttggccaggctagtctcaaactcctgacctcaggtgatctggccacctcggcctcccaaagtgctgagattacaggcgtgagccactgcacccagccaagcaggggaattttcaacaaagttccatgcgcctgttttcctccacttcctctcatcctctctctcccctgaacatcccacctttcttctctccatccaatccccccagctcatccctacccataattccaaccctcctgtctctttggagtccagcagccatagccagaggtcaggagtggagtaaaggaggaaggcagggcgctttctgccaggaatctcccatctctctgtacccacctcctgatccccaccaacctctccctctggttgccccctggctcttctcccctccaggccccagaaatcccatctgcccctccctgccctttccaagggaagggcagggagagggcagatgcctctgaggggtgtctctgaggggtgcccccaagggacacaactggctgcgctcctagaggaggtgggcaggcacaggccagggaggagaacacagaggccagcaagtcaggcttctcaggaaatgaaattgctctgtgcaacaatgagagagccactttttaaactttttgcgtgagtgtgcattcaattgctcacattgttttggctccaggggaaatctgacctcggaaaaggctgagatgaagcgggtgtgggtggagagcctctgctatttcacagagtcaagcaacacattcttcagaggcacctttccaggcggaccattcctcctttcccaagagcagggcattcagctacccagcagaggccagggcaggacccactttggccagaagtgaccaagatagtctgttccccaggggtaacaatgaactctgatggggagcagagatttgctggctggatccatggggaattatcttcagccctgcaacttgagaagcttttactacattacaaactctcagaccccttcttcaaccaattaaaccaaacttcctgaaaatggggtttgctcggcagggatatgtaagctttccaaatgattctaatgtccggccaaggttaaggaacatagtctcagcatcctaggtgcattcagtgagcatccactgaccagccaaaaacccttgggtgaggggcatagccttaggagccagagagacctgagtttgaatcccagctgtgccacttactagccgtgggactttaacctcattcttccgtcttttgaaacctcgattttcttatctgtagcataggaatgagaataatactcatcctgtggctttgttttcaggcttaaaataagcgaggtgtttctgtgaagcaagtggcatatgacagccttgcagggaactgtcagtttgtgtgttgctgttgaatacaaaccgtgttccaggcatggctcaagagaaaaaaaatcgcaacacagtcagccccagaaagtgaggtccattctcccaacggggcatccaaggcctccataagcaaacacaacccctttctccagccaaactgctccacttgtatttccataggtggccttgcattcctcccaccatgagaacaatctttctcctcttcttgcctggctcttgcccaccttcagggccgggctcacttcccaccgcctcctcaccctgcctggattcattcctcttacaacatcctatagaactaatgtccacccggggctgtcaacgtctgtctccagatatgctctttgccaggtggctgtattaatgccttgtgaccctttcttggttgcttttaaatcatttcagtctttcgttgctacctggggacaggctaggtctcatctgtcatggaaccccggctgcatgttgctcggagtctgtgctcattcaacaagcaatgatttagtttgagacaatgcttcttattgaactgcgaagtttcctagtagtaccagaaggagggatataagttgtgatccttcagcgaagagcttgcaatcctcctgaaattaagcagccatgaacacttatgatggattgtaagctggatgaatgtggggaaatggaatggggaaggaggtggggagccgccggggacaaagggcaggggagctggggcttaagggaaagtggattgtggacaggcatgggggaaatggggaaagcctccaggaaggagcctttgagccaaggcgtgggggccagaataagcatggcccatctgggtggtaaagagagggcccgatgagcgagccgtggccagctccggctctcaccagaggtgttctagtgaatgcaggatgactccaagaaccttggaaaggttttaagccagaaagcaacaccatggaaggaacaaaggagcattcctttattcattcaacaaacaatgagaaaaatgctacttccttattaaactggaaagtctcctggacacattgcttgctagaaatgtgctgagataacaaagtcaactaaatctggagcagtctctagccagaggagcccacgggtaactcagtgcccggaggagtgcagtgctccaaataaagcgtgggcaggagagggaaggtgggagcccagatggaggaagaggcgaggaggcaggagagccacctcaaagggcatcccggcagagagcaactccccagctcctgattgcctttaaatttgttctgactgtaacggtcaaacaaaaagacttagcaggaagtgaagggctagaatgcagcttgaaaaatcaggagaacctttctgcatgaacagtttattccagccctaatcttaggcacagaccccgcctggaatgttcctctgagaatgtagccttcctagggccaggtacccagcccctgggcactggcttagcatcggagtccctgcagggccagcagctgctgctatgaataccccagcttaagcgaccattcctgtaacctccgccgaaataacttcccacccgctttgtcccctccagagctttcgttcccctcttccgctcagcacacacagtgaagttaactcagcggggtgacgccgacctacccagacccccacgccccaaacatacacacataaacacacggaagcggccccatctgaagctgcctggatccttgacctcctcaagatagaactggagtctcccacccaccccacctccactcccgaccctctccccagcccccaccctttgactgttctgcttccttagccagactctgcaaactgaaatgtgaaatttgaagccagtgttccccttagcaaccatggtaacacaggatctgatagagagcctagagttataaaaataccagcttccaccagacactggtttccaaagggaaaccagtctccaagccagaaccgtttttaaacagtcttaaaactcaagagatttctaaaccaatctcaacatggctcaggaggacatctctttaatcctgttttggaaggtggtgtgggtgcaagctttgggtattttctctgaaatacagagattcagaatgcatgtgctcacgggggaattaactagccttatgaagggtatatagcagggagcagtttttcctaataaacatcaactatttggcattttttcatagattgagctgccctgctgacccccagtgaaatcttccttccagttccctcccggggagtcctcagctccatccatcctcctaattagggagagagaatgatttcgcctatctccccttgcttgaaaacaatttaaattcacaaaaccattttccagccggaattctactttaaggcttaggtagggaggtaagagatggtgatgtcaaaacttttctgctcaggaccaacaagaaaagtcctacatccctgtccccagccctttctctccccacagacgcaccctcgggcatgggcccagcacgagctataaatccctgttctctgcgttccctgcagagggcacaagcctggcgagtgggggcagtgagggcagtagggggactctccccaggggaggggcaccttcccagcccccagccccgccttcgcagccctggacggcttgccctcccatctccttcccccgcctgctcctcctcctccctcttatctcctggggccatgccttgtaattttgaaaaatcttctgactgggtaattaatgtctgaacttcaagaggcccctgctatctgcagagctgagctgaaggtgggaggggaccggcagctgctgaaggcttggaggagggagggggtgcagattattttttctgagctgtttaatggacgggactggggaggatagaatcgtaccttgccagagttgtgggtacaagatgtatatgtacacaggcacaagcatccgtctagatttttaaatcctttggggtaatcctttggggttaaaatcacacagtaggatgccctcctgctcacacaccctcaccgtcccttagcagtttcccagcaggtggatggcagcaaacactaggggagccaggctgggggactttctgagtgcaggtctggttgggaggactggttgggagggagggacagtgacttacacatttcagagatcataaaccgggcactgggggtgcaaaaaatggccatcagttactccaggtaactcagaagtcaaaatataagcctgcctgtttcccaccttaagggaggatccaggcaactctgcagacgtctgcagagccccccgacctccgtgcttcccagagtgggcccccgccttgcccagcctccgtgctccagcacaggtgccctccatctagcagttggggtgccgagtgctggacccactgctaggccctgggcataagcacgctggggtccctgtcctcacagagctgctgtctcctggggagaggaggagcaaacggtgccctgcactaagagccgagggtgaataaagcacacacagctctccaggacccctgtggatctttctccaaccgactccagctctcaggacctgtagctcaaattagcattgatgatatccacctgctgccattcttgccttcagatgtgaatgatgtttagggaactaacttttctcctcccttctgtccacctcaagaccaagccaggctccagctccttcttgatggctctgctctcattgccgccagcactgaactgtaggtcagagtgtgggcggggccaggccttttgagaaagaacctccaggatcagccttctcttgtagccaggaagaggaggggaatgctaggggaagaaggtgggtttcggaggcagacagtcttctgcagcttaccctctctggcccttgggtagatgtgttaattatttttgtttgtttgtttgtgttttgagacagtgtctcgctctgtcacccaggctggagtgcagtgatgtgatcttggctcactacaacctccgcctgccagagtcaaggattctcctgcctcagcctcctgagtagccgggattacaggcgtgtgccaccacacccagctaattttagtatttttagtagagacggggtttcactatgttggccaggctgatctcaaactcctgacctcaggtgatccgcccaccttggcctcccaaggtgctgggattacaggctacaggcgtgaaccaccgcgcccggccagatttgttgattataaattgacttcctcccttccctgtagctcactgtctgagaggtacaccacccccaaaaaacaaagacatgaaataaaaggatgggttcacagcatattttatattgtataaactgaagtgctgcttactgggaaaaaatgtggaagaacacagtagaataaggctcaggaccttggttcactctctgggagaaggcccttcttctaggtgcctgtccagggctctgctcagaagtcagtttctcagacccccccccgaccacgccccagcctgtccccccaccactgtccccagcctgactgccttctcttcattgccctactagtgcctggcttggagttttctttgttaatcgcttattttctgtctctcaactagcatggaaactctctcaaggcagggaacgtgtctattcacagctgtatccctgtgcctagaatagtgcctggtatatagcaggtcctcagtagatacttattgactgaattaaggaagtagagtgcctagactgagcaaagccagagacaatagtcagcccttctagaattcatctggaatgatttctcagtggagataaatccagaacccttgaaggggcaatgtgagtgagcagagtggggctggctggtagtggtccctggagatgagctcagaacgggaaagggaaaagaaacaccccccatcaccccagcaagcaagcccaaaaggggcatttgtgcccacactgtgagtgaaccagtgcaaacagtgctctcagcctgcgaagctgcctctgttctgtccctgcctttggttaagtggccttttctcaacaaccctccaccgagcttcatatgagattcagtctgtccaaagtcagaatcccacaaaccacaatctttaggagaagtcaggaggagcttctagcaaagctccctggaccaagagcccatggggaagggattgttgtgggggcctgggcacctgctgtacactgtgacagcgctcagcagggccctcctcactgcccctcccatgaggaacggaggaagttaggagtatgtgcagggggcacgaagggtgggagaatggagtgggtgggaaaggacacccacagtcacagaccttgaagatgacggaaaccttgacaattacagcagaattcacctatggagcaacatggccagtaacaatataacgtgagccacgtgtaattttacatggcctagtagccacattttaaaaaactgaaaagggaacaggtgaaattaattttatgctgtctaatatatccaaataatcaccattttaacgtgtaatcaatattaaaaagtaccaatgagatattttttacgttcttctcttttggtacgaagtctttgaaatccagtctgtagtttacactgaaagcagctctcaatttggactcaggcacatttgaagtgcccaagaccacatgtggcctgtggctattacgctggaccaggcggtctggaggcagcttctggaatcctcaggcttttggagcagttctggacccctaaagtaactggattcccaaagtctcaaaagtacttttcatagcctctcatagcaccaggcagcaaaggggcaccatgaatactaaaacctcaagctcacagccagtgtgcgtgtgggggctgcctggctggagagctccctgcagggtctggaaaacgtggtccttcttttttttttttttttaagacagggtctccctttgtcacctaggctggaatgcagtggcacaatcaggactcactgcagcctcaacctcccaggctcaaacaatcatcccacctcagccccccaagtagttgggactccaggtgtgcaccaccacccccggctaattttttgtatttttagtagagacggggtttgccatgtggcccaggctggtctcaaactcctgggctcaagcaatcccgcctcagcctcccaaagtgctaaagagggggaaaaggtaggaaagaagaaacacatagaaagggaagagaagggctgtggcaggggtggccagttgcgtgacagggataagagaatccacggatagggacacagtgctgggcagggctgggcagctgccaccctctcctcacagcagctcgacagaaatcgtggccgagtgtgtggaaggcacaattagctcattcttgcattgccccttgattacacaggactaccatttctgtaattaagaccttctcccttactcagaagtattgaaacatgaaagtatttgctgaatctggtttcccagggttaaaagccagacttaggaaacgcaaacacacttgtggaaatgcaaacacacattcagtaattaattatcctttaattaaggccaaaaccctgctgaaaacaattagctctagaaattgaacagtaggtacagctccactttttgctgattgttctttcctgatagtcaggaagtgctgagtctggggggcggaggtggtagggaatgaattagtctgccgcttttggtctggactggaccaagctctactttttttggaaatgttagtcagaggagagtttgaggtgtggggaagggcaaagaggatgtggtttgggcaaggggaggcgagaggctgccccaggcttggatgcatgccatgggaagtctcagaagctcctgctggccacacagaggtggcttgcctggctggagtggagggcgtgggccagggattagctgactggaaagcaattagatgaggtgcggctggctgggaaaatacctggaatcccagggccagagttgagacttgcttggctaacgctgcaggcgggaggcctcgtggggcctggggagtggaagtgcccaccagtgagggtgggagggtagccgtgtgggctgcgagtcttggatgcctcttgctgatgcggagaagtggatgagtacagatagtgtgggctcggaggtcctgcagccctctgggaaagatgccctctttcccatttcctctctctaaatgcccccctgcccccgccgccctccacctctcctcagactccttggacgttcctaaagcctgcctagtcccatcagatcacctcacccctttcctaggtaggaagatgtaggtgcacagtgtcccccttccggggactttcacattttgaaaggaggggtggggagagaaaaatgtgtgccccaaaggaacaaaaagggtgcttgggatttgggaggggtagggaaggtcactggcgccaccaaactctccccagaaaacacctgcatgcttaaaagcttacctagaacccccgaagcctggcctctggatggggggcttcccaggtaagagcccctgctctagaagtggaatgttaggttttcatacaggcaagagggaaggtctttattggtcagaggggccttccagatcaccctcaaagcaactgtgcaaaagattccaaatgttggcccagcgcagagcaggactctctcagattccaaaagcccctgacagctcattttttccccagaagggaccccagctcttgcacaaaccccttctctccccttccccctcctttcccctcccctcccctcccgttctcttcctttcccttctctctgtagatgagggtcggcaaatgtctggtatgaagggccagatagtaaatattttaggctctgcaggccaagaggcaaagccgagtttaaccacatccctgcgaggtgtagggcgtgagcagcagcatgtaaccaggagagcaagcgcctccactctgtcttcatagcggaaaaagcagccgtagacgatatgcaaatgactgagagtgactgtgtgccaacgaaaccttatttatggacactgagatttgaatttcatataatttgtatatgtcacaaaatattctttgatttttttccccaactactgaaaaatggaaaaaactattcttagctcatgggccataaaaagcaggccatggccagatttggccggtggactatagttcgcccctccctgatcccgctgtgtggttctcaagtgggaaacgctcctctcctccagatggtttcaatgcacattaaagtttgagagccactgtcataaaggagaatttgcagtttcccaggtgatgctgatgccgtcattagggggatcccacactgaatatgcccaatctagtctgaccttcaccctattttacagatggcaaaactgaggcccagaggcaacgtacctctatcatatgagcccagggaaaggcttctttgtctcaggatgcagagctgggtggttttctatctctagccgccttcagcgatctgccctgccagctcacactgcccaaggctctagccgagatacaggaaatgtggatgtgtcccccggagcccgagagcagcagggctgcagtgagtcatttcccgtgagtggagctggcatgcgctgagccttcctcgtgctgtcagttcgctcccttctgaccactccaacctgcgctttagaggaactccctgccagcttccgggaagcgaaaagcaccctctgtgagaagggaaaaaggaaagaaccaaggtttgcgtgtcagacttgcgtgatttcaaatcccatgttcgtggtactgcctgggacttgaaacaaattccttcacttccttgagcctcagtttccatcagtaaaatgagaaaacagcccctgcctctgcggggttcccagaagacctggagattaaatctgtccagtgtcaggcacacggcagggaatttttatggtgtctttattggccatcctggcattatgcattagccacaagggtacccagcctcaacctcaaaagccacagaaaaaggccacctgatcctccagacaacatgtgtggccatggctgtgctgatggtcttacagaggcagtcactgtcctacactcctgagacattgccattgacgatttaggttgtgctgtgtaaggctcatgtacttgggtcccttggtggccttcagggtctgagaaccctgaaattgtatgcagacatctgtgaacctgtgcagaggtgcatttttctgggagaggtgcagatttttcatcgagatcctcaaagggatccatgctcccaagaaagctaaggatcccacatctataagcacagtgcagaagggagccccagactttcaaggcatattcctggatttgagaatcagctccctgacccccatgagtggccttgggcacactggagatcatctgatctcccccctctggcgtggtccataaagcagtgatgggactatgtgaggatcaagtaggacatgtcaggccaggtgtggagaggggactgtgtgggagctgtcggtcatggtcccttcccaccaagccccccacctgccctcacccctgacttggctgccccctactcaacctttgggtttcctctgcagagaagcctgccctgatcacctcatccatccaaagggggctccctcccagctccctgtttgcatttgtcattctacccctctgccccccactgtaggtggcctggggacaggcaccgggctgtttggtccccatggccccaggccctctagcccatgaacatttgctgcaggaaggcacaaatgcatacccccgccctaggagccactgccttggagcccacccacctccaggccccacctccctcctcccccagcagctgcttctctaaagaggcagctcccactgtgctctggagcattcaagatcccagcaacaaagtcagagttaaaaagtatattctgtgcttctcctggagctgacgtggtcccatcaggtgccccctcttgagcacagccagcagcccccagagaggccctgggctgcccttcagggtccccatgctcagcctggtctttttcaaggcctgattctaagggctgtgtgggccctgcttgctctgcctggaggacagtggggtcaccactggcatctaggggacccctccaccaccctgctgccccctaagatgcgtatggggcaggccctccagcttctcacacctcaactccaaaggcctgggcgattatgaggcaccagtgagtgagatccccaaccaaccccatcacttcagccctccaggtcccaacatcccaccaggtccccctggactgccagcacctgccattcccctagaggggcaaggaagcagggtgggaagccccaggagactgccgttggtcatgcccaggtaaggattagccaggccttcctcctccactcctctcctctttgcctggtgcaggaacaaccagctaggagtcaggaaatctgagttctggtgctggctctgctgccacccaagctgtgcctctggtttcctcctgggcaccgcacatagatgccatctgtgagtgtgtcccctgcttagtccacatcacctgccatcagcctgctgagagggcgccggggcccagtgggacaccctgggaaattgtcagctactagtcctgcatccctgcccacatttgggctgtttgtcccttcccatcgcataaggagcggggaagggcaggaaactgaggcagccagggtttgacagcaaagcctgcactgcctggcctgggggcaaaggagtgaggtccagaggttacgagctgccaaggactggggacctcatctttctcctcctggctcccatccaatgcccaggggctggggggtctcctttcccggggcctcccatacacacattggtaaagggaggaacaacagcctcatggtctcggatccaaatcctcatccctgtgctcacgagagcccctccctagagcaagggagcactggtgcctgcctcacagggtgggggcgagaagggggctgtctaaggcccatcaagcatttagcaggggcctggcacacatccccactcagaggacaccgagaccactgttcatgtcacatccggggttcaaattctcagtgctgcaggaactcagaggaggaggagtggcctgggagctggggagggctgaggtctgggctgggggaagcacctgaaggcaggggtggaagctatgggcctaggggcacctgagcctgggtgagcccagcccaaactgaacaaaggcgattagagctaagaagagggtctcagtcatttatggagcctctgccactcccatccacctgaagagacatttttctcagtggtgcccactctgactgcaccagaaacacccagagatcttactatacagattcctaggcccccacagccctacatagccctaaaatcaaagagtgagggctggatctgtttctctcctaggtggatccagtacaaacacagggctgggaactacccactggatgcatccctctccctgctcccagatgccctgagcccctgccccccaccaacctgtcccagcagccctgggcaactgggtgactgcgaggctaagaatcccccacacccacaccctccctggtgggaagggagtggggctgtctctggaactctgatttggttttgctgtccaatgccagaacgggggcacactgaggaagagagacttttaaaaacaaagtccgtcttccctggggttttattttaccttggaaaatagaagaactgatttttttttttctactttcccccaaacttgctccctatcagtgtccctaaagtaggaagagttctcacttctccaagtgtgtagtcttggcattaattaaaatccagaaatgacagcaacaaagcacctgctttttcttcctgcttttctcccaacaccccggcacatcaacagcccgtcagcttgtgggtagactcacataggagctggagcctacactgaactttcatcccaggcgaaatgcctatcagaaggcaggtgcgctgccttcccaagccagtgccctcctagagttgagcgtgctgggctgcccacgcctcacgtgagcctctcggtgcagtggccgcctggaagatgtctcacctgggtccttgcacaggcagatactggagaaaatctgaggaaatatatagattgatttttgtccgcccccctgaaacgagtcccctttatagtcacacttcatagaaagcacaacacagacagcatgtctgtgcttgaggctgtggctgtgcacacttgggtgggctcaaagtatatgcattactgcacaacctttgtctccctcggggccaacacagagtttagtgtaggagccttcacttaggcactgtgttcacctttacagccttctccaacacttcatttatttggtggccccttaaccagaagcatatggagaagttgagggatttgccaagggacaggcagcaatagtgatttgccagggcaggccctgaagcctgtgttggtcacaggcagattcaagggcagcagcagcccccaaactctagatctgcatctcaggcccaggcacatctccctgacacctccccgggcctgcccaccagcccctcaatctctaagtgtcctagtggaacctgtcttctgctccccaagcctgcacctcctcccggagaaggacctccaggctgtgccggctacagccccgaggccatccctgactcaccaccaaccgccaccctgctgccagttcccagggtctgtgagcagcagctcttgcagattttcttgaatctggccaccacttttctgcctctccacggctcggctaggccactgtttcctttcccctgaattaccccaccagccctctcactggctcacccctcctgttctcagtctcaccctgccaccctctctctgagcactcctgactcacttttctccctgcctgtggtgtccttccctctcttcctctcctcaccccactctcctggctgtagcttcaaaggtttcttcccaggaagctgtccctgagcctcctctcctgacccaggtgagaacagttcttcccgtcactgaccccacagcacactctacactgtgccacttgcagcccactcagttctaagagccaccactgaccgagctcactgtgtgccagatactatcctaaacaccccacatcctcttctttaatccttgcaactacccttggcgggaggtaatattagtatcaccactttacaggtaaggaaactgagacacagaggggttgcctgtattgcacaacatgactggtggggcggctgaatcaggattagaatccaggcagtctcactttacagccttagttccaaatgctgatctgcttatgcaacatctgtcttccctcctagactcataaatctataaggccaggatctgtgcctccttgttgaatgagtgaatgaatgaaaagttgttactacccccttcagacaccctggagaagttggacttgttgtgctccaaggctttatgtcactggggggctgcatcccagggaacagaggcccttccgaatggcctcaccccagccagcagaaagccatgctttctttcaaatccaatcttcaggtcttccgagaggcccaggtggactcaagtgcctgtgtgagcagtgtgaagaaaagctagtctaggtagatgctagactagacctagaactaggtagaagcaacagttgctcccaggctgggagtggtgagtcttctggctacggaggtcagagaagatcagggaaggcttcctggatgaggctcttaccattgttcttaagggatctggtcaatggagccaagatcagaaaaggcatgctcagccaagagaattgtcagcaaaacccagaggcagataagggcaggatgcatccttagacctgtgaacagacgagtttgggtggattggaggtctgtgaagggggcaaggtgggaagactgtagggcccagagcagaagtggcccagcgagccgcctgaatgccaggctaagccctcatccccatgcagcctggtcagttgaacacagtgagaatgcacaggtgataacagaatattgactcacatgctcattcatccaaaaagatcatctcgacttagaaaaagagttgccccattattaaaatttatattctgctaagggtaaggctctaaagccaaacaaacttccaggtgccaattaacttctcttatctccgagtctcttagacttggcaaagagtacttaccaaatccctactgacaccctgggcagccccaggcccttttctcagcccaggcctgtctgctcctccaatgggtggctgctcctctgagcacaatgctaattatgcccttagcacagcccgattcttctctgaacagtaacagagcttaattgtctccggcccagctgtccctacccagttggtccttggttactgcattctgcccaaacccactgcagaaccagctgcactccctcacccaaaggatagccctccaacccagctcctgccacaaggcttcactccacccccacccccacccccaccccagaagatgggcacctctgtctggaaaccaggctactacaagtgttgatccttcttcaatacagcatgccaagattatcatgcaaaaaagaacatggtttaagcaaaggtttcttcaaaattccgtgcttggtggcagaggagtgggccagtgtgtcccttttctaagtcctccaatgacccttgctcgttatttatgccctccctgactcatgctctgtaaagtctgaggttggtaaaagccccctacatttaagagggcacctggttaatgtaggcatcccataaacaatcttctaagaagcttcttcccagtctcagggaactgtaggttggcatagccttgcagataatcttgtgcccagttggtgagcaagcaggggccagtggctggagcggcccctgggctctgggcatggggaggccctccttctgagctgatgggtggcctctgcagccgggccctccctgagcttccctctgggacagcagagaactcaacctctctgcctagggcagcgccctcgtggccccggctcagcccagctcctctagggaattgagtggctggactgtggtttagtcgcccccagggaagcttacccagaggaggaaaggactgtttcgcaagccaggcccggcgttctgagctggcctgtccgcccctggcatatggctgggcctgttaggaaatcaaggagacgctctgtctctttccagcaggcgccacttctgtcttgccactgctttgctcgattcaagacgctggctcgggggccaggctggtgggcaggcaggcgggcaggcgggcaggcccctctcccaccagcccggtgcctgggaagcgctcactgtctcctcagccggtgttatcccaggggtcccgcacctggctgataaggccaggcggctatcagtggccatctcgggtgggagggcagggtggctctcagggaaggattccagactgtttccttctggggctgagctccaacgcccttatctcctttcctgccaggcagggactcctcagcgctcacacacaaaagagaactccacccaagacgcacagcccctacctactggaaggtggaggaggctttgcctccggtttcattaaatctacctggttctcaatcgggggcagttaagtgtgcactcagctaatatcaatgtatttggtcctgccagggggtgggagggttggagagacggggacgttcaagtaatggagctgccttggtggctgttttcgaagctcctggacttgtcagtcaactgaaacgtctcttggaagagaaacaaccaggggatgggccaatgccaattacaagattcaggggctgcggggatggggaggtcaggcctcatgggactgagtagaacgagggtggtggggcctgagtgtgaaaaaccaggcctcgctcagccccgctcttggctgccttgaagcctgtgaggcaggaggcctggtgagtattattcccgtttcatagaacgcaggcctgtgggtgggagtgctagagggaatacgggaatatattatagaagatgggtcaacggaatccttgagaggtcagccgagcgcccattcctgttagcgcggaagggagagccctggcctcacagtgttcccaggattaatgttccgcctcagaagagcagcctacccccaagactctcagacttactgctgggcaatgctttccagaggccagggctggcctaggtgaccccacagggccttgttccagcccagcagtcgctgattctacaggcaagttactatgggaactataactttgaatttcctggctctggggctgtgaaaatcacaacctgaaccttccgttgatgtgggtttctcgattaatttcctgtttgattgtttactttagagagcggaaaatgcctttgcaggcagctagctccctccacggagacacttatcacaccctgcccccacagccagcaaggtcaagtccaggcctcaggtgggtggaggtaggggccagaagcaggggcagggactgggggaaggggctggagctgggggcagggaggaggctcagccagaagcagatggcagcctgagccccctgccctacccttctgcttgcccggggtcccagcctggtggatgtcggggctgtggagggacctgtgatttcagagacctgtgagcctttgaggggagcctcccacccaccccaagccccaggactggcccctggctgcccaaactatcccctgtctcaaggagctctgttgtgcagagtcagacatacagtgcagtccttcctggagagggtggcctcagtggggagggtcagagatttccccctaggccaggcactgctgactgggctgcccagtgcggggctgggcgtaactgctcttctacccttctctcctccatctgccctccccagggccctgcgctccagcagggagctgtgcccagtgttcccagtgaccataactccatcctgttccctgcggagtggggagggcttgcaggctcaggtgccgcctgcgagccaggagttctgatctcctgtgatgataaccacccatctctaggccatgggacactcggtagcctctcgagccctcctccccaccccagctacccagcccctagatggccctgaggccccatttataatgggggccctgaggcacggggaagggaaatggaataggccagagggctgtggactacccaggggatctgggaggcctgggaaaaactcccaacctcccagcacccctcccttatctaggtgaccgtatatgatccacatcagggcagtttggagagtggaaaggatgcttttactaatgactttgagatgacaggtgaaaactggaactattccaggcaaacgagatgtgccatcaccccacctttggccggcctctccccatcagcctatttatgtgggcactcactggggagcaggagtgaagctatttttctacctacttgtgtgctcttggagaaatcatttccttccctgtgcctcagtttctgtagctgtgacatgaagagcgttgcagtggtgcctaactcagatcatctggtagaaagatcaaatggatctttaaaaacacacagagcacatagaacaaccactcaaaatatgtaagccaggtgagcatgaggattccgaaggtgctgttcaccctcagaggccccctctcaaaaggggaacctcagagctgccttaggcatttcctgttcactcctcaggagggatcttggactgggggcagtgagcacagaagaagcttccagaagggatggggagggcctaaaggggaagctgggaggcactggctgcaggcacagctgcttccctggagtctcaaacccaccccagggtcctggggattcctggctgcaggcactgtgaacagaactagcccctgtctaggccactagctggagcttggtccacaggagaagccgctggagttgtagccctgccttctggatccaatgtctccagaagaatttggtgtctaccctgagccccaaattatatttccagcccccgggccagctgtgggatgaagcatcccccatgtgacatccactgtcgctactttgtacggggtggtttgcaagcccggcaggaaggaggctaattattccctctggggcgcctggtccgcagctagggtgcccgcccgccttagttaggagggctggcagccagaccacagggcacaagcttggactgaaggccaggtcagaaccacaaatttcctgacatctgaccataaccaccataccaaggctccatgttagactggtggaaaagtggcatgggggcccattcccctctgctgaaggtgtctgcactgtgggcaggcaagagcgattaacataaaacagcactaattttgtagctttggtgccaggctaggcaacattagcatctacacaagcacctatatccatggccacaccagcccttcctcccacttcagagggcgacactactcttctttaaggcagatctatgtacttgatcctttcctcctttctgattatcctcttctcctgcactctggcacctcacctctacctttaaactggctcaagactctcctactttaaccacaccagattcccagaccattctaggtgaccctgtgccagtgtctttcccctagcatcctccccttttcttcttccataggcaagttccaaaaacaaagaaaagagggaaaggaaggaagagaagaagggggttggggttgggggtgggggagagagagagagaagaaagtacagaaattcattccaaagaaaaagaaagaaatggtgtgctctttctgtctgcacttctggacctccttcacactctccaaccctgcggggcccagcccaggcttccactgccccagtagcagcactgaagtcatcatggcaaaggtcacccatgctcttctaatcaccaaatccaggggaccttggtcattgttcgttttacttgacctctctgagctttgacactggtgaccttgtacttcttggaactcttggccctcatgacgccatttcctcctgttctgcttaactctctgaccacccttttcttccttctttggggattcctcttcctcctctctcaccctttaggcattgctgtgttcaggttgggagcccctgccgtcttctcttctcattccatgtgttctccaggtcacctcactcacaccaacggcttgactaatccctgggtgctgatgatcccagattaccattctcccattagtcatcttccctggtcatccccaaggaccctggactcagtatttctaacactgaactcattcactttccctaaaaccacctccacctgccttcccaatattgttgatggcatcatcacttacgcagttgaccaaaccccaaacctgggggctggccatcttctacctcatccttttcctcactctcacttctgcctcttaacatattctgcctcttaaatatcctcctcccttcctgccagccttaattcaagccaccccaattttgcacagcaaccttctaacggtccccctgcctccagtccaaacaccaccctacctacatctccatgctatgcaagataggatctttctaaactacaggtattactatgctactctccagtttaaaatctttcagtggctctccagtcccttgggataaaatccaaactcagtaccatggcatctagagcccttaaatatgtggcctttgccttctttataagcacattccacccccagcaccatatattttaggcatcttgaaatacttattcatcattgtactctgctagtgcacattttttgcttttttacatctttctcatgccatatgcctggagttctccaccaccgctattccttcttatgctgcaatgccatatacctagcaagtctcttgctttccccctactagactataaattataagtcttattgttcctcttgttatccctgtacttacgtagcatttaacacaccatagatatttcataaatgttgccgagtggatggatggatggatagatgagtagatgggtagatagatggatgaaaggatagatggatggatggatggatggatggatggatggatggatggataggtgaatagacagatgaatgaaaggatggatgggtaggtgggtgggtgggtggatgaatggatggatggatggatgagtaggtgagtagatagatggatgaaagaatggatgggtgggtggatggatggatggatgaataggtgagtagatagatggatgaaaggatggatagatgggcggatggatggatggatggatggatgagtaggtgagtagatggatgaaaggatgaatggatggatggatggatagatacatggatgaaaggatggatggatggatagatagatgaatgaaagaatggatgggtggatggatggatggatggatgagtaggcaagtagacagatggataaaagggtggatgagtggatggagggataggtagtggccaatacagacaaagaataggtaaaatcagttcaattttgtgaaggctcaggttgacctgtcaccagtcaacacaattaaaaattatgagctccagccggacatggtggctcacacctgtaataccagcactttgggaggctgaggcaggcaaatcacgaggtcaagagatggagaccatcccggccaacatggtgaaaccccatctctactaaaaatacaaaaattagctggtcgtggtggtgcgtgcctgtagtcccagctcctcaggaggctgaggcaggagaatcgcttgaacccgggaagcagaggttgcagtgagccgagatcacgctactgcattccagcctggtgacagagcaagactccgtctcaaaaaaaaaaaaaaaaaaaaattatgagctccaaccagcaaaataagaattagctaatgtgggaaattaatatcattccgtaaaggagagagcacagatccaggactctccagcaccttccatttccacttagacctgctgtctgtctgggttgtgcaagccacttaactactgagcctcagtttctctaccaattaagcagatatgataatacctgtggcctttccctgtctccacaggagtgtcatgagggtaaaaggaatggtgcatacaaagcatgttgagatcttcagggaagatacatgtttataaagatagaaacatcataacaataataacaccttacgtttgaatcaagctttgcacttatcaaagctctttcacatacgttatttcaattgactctccaaacaatcctaggcagatactatccctgttctcaggtgaggaagctgagatgcagagtgattaagtggcatgccaggggctggtcttagtgtgtagcaggtcttctgactccaagcctgatgcccatttttgatgatagcctttcttggatagattatctacttccctgcctccctgaacggagacctagacataattggcccttttcttgatgactcgtcattaccataggcacagtccctgggctgtcctccaggtttggctgtaggtacaggtccaggtcccgcagaggcacagggtggatgggccagctgtcccggagggtactcctgacgtgtaggtggcaaccatcctagagccctgcaggtgtggttcttctgactctgcctcattcttccccctgtcccctttgtctccactgtcagcatgtgtgcccatttctgtggcttcctccgccaccacggcctttacccgtcactatcttttcttctttgtttccctctctcctgccctacaattctttccacaccttcagcttgtccccccacagccctggctcatccaccggcccagccagccaacctcagctcccaggctggctttgttctcccgccaatcacagccctctgcaaacctcccactttggctccctcatggctgcccctgtggccacctccagtcgctaccaaaggaaggaggctcctccaggcaggggctgggctgagctttttctgcagctgcattaggtggcttgggtttgctctcccacagtagaaggctgtgctgtgggtgagctgaggtggtcaaggtgggctggccagcccggcttggatggacactgcacccctcactagcaaggcaagatgttgggattgccagtgctcatccctccctgcacagcgaggctgccccatgagttctcagcaccccctttccctccctgcagggtggcatcccaagctaccagcctggttacatcctgggcatgccttgggcagcctgcctgtgcccgtggcccttcccccagggactccaggagactcccaccaggctgcctttctccctggctgctgtggggcctcccacagccacagcctgactggagcaccttggtttctccctgagggaggatatgatgggcgtgcccacaacaagtctccgccagagacaataggacaggaatgcattcgcttccgaacaaacactgtgtgggctcgcacaattgccttggattcttgtccaagaaacacattttgccgttcgagggcacgggaggcttgcctgccccagcccgcccacatccccgtcagtgccagagactctgatgagtgggctgctcctcccccgaccccagggcctctgacccccaggtagagcaggctggtctccttcatggatgcagctcgtcttccagaggtgacagcagaggagagggacagtcctgcccacacagagggtgcctgctcctaccaatgccttttttttttttttttttttttttgagacagagtcttactctgtcggtcaggcaggagtgcagtcgtgagatctcggctcactgcaacctctgcgacctgggttcaagcgattctcctgcctcagcatcccaagtagctagaattacaggcgtctgccaccatgcctggcaaatttttgtatttttagtagagatggggttttgccatgttgtccaggctggtcttaaactcctggactcaagtgatccacccaccttggcctcccaaagtgctaggattacaggcatgagccaccccgctcagcctgccatttttttaaaaaccattttttattggttaataaatacatacatatacatataacattatgtaaagcttaccattttaaacttttttttttttttttttttttgagacagagtttcactctatcgccaggctggaatgcagtggcacgatctcagctcactgcaacctctgcctcctgggttcaagcaattctcctgcctcagcctcccgagtagctgggactacaggcccgcaccaccacacccagctaatttttgtatttttaatagagacggggtttcaccatgttggccaggttgatcttgatctcttgacatcgtgatccacccgtctcgacctcccaaagtgctgggattacaggcgtgagccaccgtgcccggcccattttaaccatttttaagggtgcacttctttggcattaagcgtattcacactgttgggcaaccatccccaccgtccatctccagaactgtttcaccttccccagctgaaactctgtccccatgaaacactccccatcctccctcttcccagttcctggcacccaccattctgctccctgtctgtatgaatttgactactctagggacctcatagaagtggaatcatacagtgtttgttcttctgtgcctgacttatttcacttagcataatgtcttcggggctcgtccgtgttgtggcatgtgtctcaatggccttcctttttaagactgggtgatattccccttgtatggatttaccacttgtttatttattcatctttcagtgaacacttgggttgttccgcctcttgctattgtcagtaatgctgctgggaacatgagtgtccaagtcactgttcaagatgccgctaatttttgagatctgtgtttgagctaagtgaagctgttgtctcctggcgatcccaaatagaacatacataaatgagagagctagtcggccctctccgtactggcagggattcgtttatccccaaaatgagctgtctcttaggaaatcagagccctgaagaaatgggacataggacaggtcatttaggccaagatagacaagactggaaaggttcttcccttgggatgatacccactaaaggcaagttcagtagggatttctgggcagccattggtcaccctgaagcatggagagcccgggagggcaatggcactgacggggccccagggaggaagcctgtggagttgtgccaagggccccctggaagaggcaggccagacccttgttctgacacagagcagcaggtggggccttcagctgtgtgccccatccaagggaggctgagggagcatcctccaccatcccttcaccccgaagggtctgagaatccactctcaaaagccagcaaccaagcaggtgtgtgtggggaggacaggacatggtctgcagccaccaaggcccttcctgtgctctctgcgttccagcaactgggagggacaagtaagatgagaaactccttccctgacttccttgagaaaacccagcaggccgtttgcaagagggcctctcgcacaatgtggtttttggcttcatgcagactttcccaaacaacccagagaaagataaggttggaagggggggctctagggttgagaacccgcccccagctctgccttagggccctgggcagtctgtcctctgccctgacaggagttgggggagtagggggagcaggggcagtggccccaggagcctgcctgcggggagtttgggcgtgcccagggaagaaggcatgggaaggggaagtcacaaagatacgagaagggaagaaaaagagcagggagactgtggaaccgctctgcaggcccaagcagccccatcacagaaagtggaaggcacgcaggctgtgggctgcagaagagacgaggaggagacccttgattgtcagggcaaagcgctcactgtcaacacccctgggactccgggaggcttccacgcagccctgtcagcgtctccctctctcctcggagggagatgcagccacattgagagcctctagtgcctggcaggccctggctcttctcgaaatttctcatattattacttcacttgtccctaaacctcagaacctggcaggcacaggcaagggaccagagccccctgagaagctagtctcaggacacaccagggccccaggcgcacttccctccccgggagaagcattgactgagcagccccactgtgtcagccagcgacatccgcctgcggctgcttccccagctgccctcccttccttcgcatcagctcccgggttctgcctcttccccacccagggccaccacccactctgtctggagtttcattcccaccagatacttaccttccccctttcctgtgatttctaccagcaatttttattttaaggatttttttttcctgctaagcaccctagggaagcatatgagggaaatttactataagaaagaagttccagcctaggtggggtggttcatgcctataatttacctagcactttggaaggccaaggtgggaggatcacttgagctcaggagttcaaaaccagcctgggcaacatagtgagatctcgtctctagtaaaaaattttttaaaaattagccagacatggtggtgcacccctgctcccagttacttgggaggctgaggctggaagattgcttaagcccagcaggttgaggctatagtgagctatgattgtatcactgcactctgccctgggggacagagtgagaccctgtcttaaaaaaaaaaaaaaaaaaaaaaaaaaaaagttccagcaagaccacacagaattctcctgatgttaatccccattttccctgctgagtaagtgtggctaggcccacctttccctccgatcccagtcccagacagtcacaggaccctcccaggccctgaaccagcccctcgcagttggatgttggaccccatgactcaggtaggcttgctgcaggatgagtcacaccccccacctccaactttttctagaacctgcttactaatctttatcccggcctcttgggtcctctagatgagggagaccgttgcctgtggcccaagaaagtcccccaggcactgactggtggaagcctcccttggctctccttggggatccgcagaccccagtgcgggagaggggtcactgccccagagtagcccacatgggcatactgtaactacttaaccagtccccttgttgggagaggtccaggttactttcaatcttttgctctaaaaatagtatagcaactagtgtacacgtgttgtatggcatgtgtgtggttatatgtgtgggataaattcctagaagtaatattgctgggtcagagggttttggacacttctgttgttgatgattatcaccaaattgccatctatagagtgataccagcttgtatttctacaagcactctatgtttgcagacgcatcgataataattctgtgccatgtcccttctggtgacaggggtatggggaggggtaggtaaccacatccccctcactctcatcttttcaaaggtacgtgcatcagagggccttgcaagcagtctctctgggtgagcattttcctttcctgtcacagactctcagctgggcgagttttctccctgcctcccaaagcatgtttctgagcaaatattttccagtgtgtgccagatgttggggagagcagtggaccgacatcgccctaccctcatggagcttgccttctagagcggggagacgggcaataggcaaacaagtatataatatgtcaggggccgcagaaaagggtgagctgggaggtaggtgggggatggtggctgctcagggaaggcctgtctgccctggggatgtttgggcagagccctgcataggatgagggagtgaggtctgtggatctgcggtggccaagaatttccagcgacaagtatgcagaggcccagagttggaaatatgtgggtgggatgcgagaccccgagggtcctcagtgcctgtcacgtgtgcagcccatactgttccctcccctgggttgaccgttgctctccacctgctcatcatttgagcagtttaaggcccacctctgctcactcatcccaaaacgatttcttttctgtgtatctgctgcaaacccagttctcaggccagttctgaccaagttaccaaggagaatgaggtctggtccctgaaagtggctctggccaatcaagcactcctacggccctggagcctgcaccctagtttggcctgcagccaagcctgccgtgggtcctcagctcctgtggtgaatgctgtagctcctgctgcggggcccctaggctgggtggatggatgcaacgtgacaggagacaggaagaattaaggatgtgcagaatgcagattttgagccagcaacatgaccagtccccagggttggctgggcatgattttgcctctccttcttgactatatcatgcccagattaaaactttggctccagctctccgtgagtaaatgaggatgtgccctcagaatgccatcttttaccctcttctcaccttctacccttccttttaaaaatgcaaaaaagaaatgcataaatcatgttgaccaacagttcatgaatccccactgttgccaggggctttgcttggggttaaagggcagcagagatgaatttggcactgtccctgacttcaagaagccgacagttcaccctggaaaatgtcttaacttgtgtggaatgtgcatgggggggaaagcaggagtgcctgggagtgagaagcagggagggcagggactggggtggtcaggaagggtccgaggaacagctgggaagtgacccagccttaaaggatggagagaggatggagagccccaaagatacaaagtcatttggagtctaaacaccagctatggagtgcggccctttaacctgcatgggaagaagtcatggaaacccatggctttaaccaaagaggggcctgaagtagaaatgatttctccctggccccaagctctcaccttccccatccactctagaggcaaacgtgtgcaggcctgacccgtcttgctctctgcccctgctgctgccctaggccacactgccaccatgcctggccaggtccctcaatgtccacccttccctcctacagcaggcagaatggtccccttaagacataaaccaggccaagcatggtggctcacacctataatctcagtgctttgggaggccaaggcaggaggatcacttgaggccaggagttcaagatcagcctgggcaacatagagagaccctgtctctacaaaaaataaaaaaaaattagcagggcatgatggcctgcacctgtggtcccatctacgcaggaggctgaggacagaggattgctcgagcctaagagtttgaggttacagtgagctgtgatcaagatgtatacaatgtggagtgattcaaccacactcattgacatattcatcacctcacaagtgctgctttgcatcacagtgcttaccgccatctgatagagatgtttattggtttgttttctgcatttccaccgccccggagctgcatttccaccgccctggagcagggcctggtctgtcttgttctctgcagtgaactgtgctggcctggcgcaggcgctcggcaggtacttgtgactttgtctcttttgttttggtagatctgtgctgctttcgaagtgccacctcggcatctctctacagtgtgatcaaggagacctggcatctggaacaggactgtgttgagatcagagagacccagtctgtagtctgattgatctctactgactttgaggttatggaagttgtaggaaggttgttgttatggtttatacagcatgtagtatattttcattcattccacattccactcaatatttgagtacctactagacatagttcaaggatttctgtacatgaaatgtgccaaaatgcttctccataaaagcagtgaatcacctttgcatgaattgagttagatgttggttactgggctcccttgagttgtgggttaggagttaactgtggcctgacctggatccctgtgactaggtgatgctctcgagtttgccagcaacagaaccgtctctgcgtccaacatctcctaagcgggacagtagcgtgggctgtggcatgctaggaagatcactctggccagttgtgtacaagataaattgcaggggaaggaagtggggaccaggatgacgcatcaggacgcgggacagtcctccatgagggaagcaacaaaacctcacctttgagtaaggccagggacctggaaaagtgggactaaaatgtctccaggacgttttaccaggaaaactaccagaacctggtaccttcttggttatggatggtaaggggagagcaaaatgactgaggttttgagctggaggtgacatggagctgctttgaggcaaagatgataaagccatagtgtcatccagaaagtgaagcccaatgagtgtgggaaggttcgtgcagacgagctagatgtggggtccctgagagtcgtgatgatcgacatggcaggaggggacggcattgagaagagcagaagcttgacaataactatttggggaggaaaatattggaggaatgcctgttttaggaactgagagaaaaagcattagccagcaaagagggctgtggtaggagtggtccgtggggcttggtgagcttctcggaagccacgcccagagagggtttcaggcactcggtgtcagcacaccagtgctgctggggcttcaagagagagtgaatcagaaaactgggacatagcaagcattggtgaggctgtagagaaaccagaaccctcatgcattgctagtgagagtgtaaaatgatggagccattgtgggaaaacagtcttgcagctactcaaaaagctgaacatagagttaccacatgacccagaaattctaatcctatgtaatatccaggagaattgaaaacatgcatccaggaaaagcctggtacacgaaggttcatagcagcactattcctaatagctaaaaggtggaaacaacgcaaaagtccattaacagatgaatggataaacaaaatgtgacatatccttacaatggaatattagtcagccacagaaaggaatgagatactggtatatgctacaacatgaatgaaccctgaaaacattaagtgaaagaagtcaatcacaaaaggccacatattgtgtgattctatttctataaaatgtccagcacgggcaactccatagagacatagaatcggggggagttgccagaggctggagtgaggaggaacagggaatggctgctagtgggtatgggtttgtatggggagtgatgaaaatgttcagaacttaaatagtggtgatggttgcacaattctggggatatcctaaaaagcactgcattatatactttaaaatggtggattttgtgttatgtgaatggtatctcaatttaaaagagacagagagattgagagaatgagccaggcaagtcgggggaagcatggactgtagcacggcaggactgagcgctgagcagcccagccatggccctagttaggaaacagttccagcccctgagtaagtccacaggtttgtgggtttgaaagtctacagcactgggccagtggagaagagggctttgactcctggacttcctcctgtggccagggcccaggggtgcctgagtcaatggctgaacctcctcacccatagaggagttaccaattatacgtctctaagctaatttcatttccctgaggacttctgctgaccagttgttaacactggatgatcccagcgcactcactgctgcaggctttctcttcagtggcctcttgaatcacggtgttcagacctggcccaggggctccacatcgcaccatcacactgacctccagctgctctaaccctgtcggagaaatcacggccacccggcgcaactgactttctgctctctgacttttgtgggctctcactctagcctgaaccttggagatgtttgttacaggccgcatcagggctggggctgcaggtcggcgggggctgcagggagctacagggcccagtagccggcatgtctccttcagtggtgctctctgcccctctcttccacagctcttgcaatctcaggatgtgaaggaagatgctgtcctttgctgctctatggaggtaagctttggggcttcgacatccccaacctcaaagccggtgcatctctcatgccttaacagttctaggggcacgagggttgttggaggcatttacaagtccaggggaaggtaggtggatggcttcaggagtgggcatggacttctgcatccagaattatccaccccaagccagagtgaacactgatggtgagagcagctcacccctgactgaagggagagagaagtgattcccagtggcattgcctacttccctgtcccccaaagaccccctgcgccccagctcaggcatgccacacaaatgacttaagaagttcctgattacctctgccctcaaatatttccctttgctttgctaatgcttggcaatgcagtgctggcacagcccacccgaaagcacacctcttgggaggtgccactcctgtccctaagctgtggcccctgctaatggagactcttcctctgggctctccctttagcgcctggctttggcccagtccctgggcagatctctgccctctgcagatggtccagagtcactcagagtgggatgcaggcaggagaggggcttccagacgaggacctgggcctggcagctgtcataagcatactcaggtggcttccgcctggctgcaaaggcctcactgaggagctcagaggccagaagcactgggagccagatggcagtcttgggtctgtgggactcagtttgtttgttggcctccagctgggcaccctacagggggcttgggattaggggggaattagggagaaggagaaagcctggtccttgccctcaggcagcttccagtctggttaggaatagctctcagagagtagatagaataagtgtaagtacagagacatccctgaagagtcaggggagagaggtcaggaagggctcaggggttcaagggaggctttgtgaagaaggcagagactagaaaaatgaatgggacaaggctggggaccgagacggggactgagattctatagagagggcctggggggcactggccaggggtgtgctggtccaggaataggggctccttcccagtgggcttttcaagattatctagggctctcctgacggcctctggctggccttcttccccagtttgtatttctctcccccacttcctgtcacaagcatgagcagaggtcacttctgggggctgggagatgggatcaggatcaggagaaaaggagagcgagagaaacaggaggcatcacccctgctctcaagttccaatggacacatgtaataatgactaagctcattgccagagagacgccccagcaagtgaaaatgaccacagggccccctgatcaccaaggggcacagatcatggagccatttgagggtgcggatgtagtcagggaaggcttcctggaagagggaggctcttgggtaaaagggacaagaggcatgttcctggtgacagctctttcagccctgggcagtaggcaatattcggatccctctggatcctgctggcagattggttggtaaatgtgagctctcactcttggctactccaccttccactctccctgtcctcattccagctgtggcacaggggtctgggcctgtgtgtccttaagacaacccagctatttcctatccctgcccacctaatcagggtggccagtgggccactgtgggacccgaggccatcctaaccccacatctctgtctgcagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatgtaaatgttggccgagtcggtatttattctgattgatttttattttattctattattttctccgagggatgagggtggggggtgtgggaagggtaccacagatcaggccggggcagctgtaggggcgggggcccagacagccaggccgccaccagagcagccccatggggtgccccagacgcgggcctccaagaagccaagtcccagtctgttttctggcatcagacaccggcccgtgttccttgtcagacagacagactctcaggcctgcctggggagtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaccaccaccaaaaacaaaa

SEQ ID NO: 551 - DNA, 58692 bp, Homo sapiens
ggattggccgcgccgctcttgccgtgggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcggtgagcgcccgcccactcactcgcccggggctccgcagccaggagtccggcccggcgcttctccaaggcctgagttggggcccccctcggcgcgatgggactgatggcggggggcgtgcgaagctgggcctgtcatctcccgagggccagcatttggaatttcccgcgtgttggcggcgcggggagtagcactgagatcggcagcggaagggttaagtcagtgtagacattttccaagggctgtgtcctcaacgccgcgggggctcggaaagagttaaattgaactcgtcacatttttaaagcgcttggggattggggtttcccttgggtttgcccagtaggggcagccaaagagttaagtccagtctgtcactttcccaaagggtgggatttggcaaatccgtcagccgtacgagaaagcgtaagcattaagagcctctcttaagttgccactttggaccaatagacccattgtgaaagcgggagaccagtgtgagcgccttcctgaattctgtgggccgctggtcccatctaattcagttacttgttttcacccgtcccccaggcgcggagaccaagctcattgctgagctccagctagcccacaatacatagtatttattaagctaagagttaattgtcttaagcgactagataagatggatctgcagttagcataaagttaactaccctgcgaaagaggagttggtctttaaatggtgtttttcacttgaagagaaaagaaggtactgggcaggaacatagcttagcaggcctagggaatgggtggaaggaaaattgcactgaggacttacatagaatgtggtgtttgttcagcaatgattgagtagaaaggtgattgtttcgttttgcttgtttggttggttgggaaataaataggagtgaaagatttcgcctcgatctttatttagagcccaagagttgttgtgactcagttttagctggtagtggcttgtacacgccaggggagttttagaactgttctgaagagagatggcagcagttcttccaccttttcgatgactgttgaaatcctgaagattagctgtccgactggttaggttacacaagatgattcaaacacagctttcatgtttgagaaaataggtaacttgtgattcttagtccttgcactaataaagcaacaggaatgagtaagtcttggagaaaaagagattagcagaaaccccaaagtcctttgaagaatgatgtatataaggaagatttacctgcttgttgttcggctccttttctagtagtattattattaattttttttcttgagacggagtctcgctttgtcccccaggctggagtgcagtggcgagatctcagctcactgcaacctccacctcccaggttcaagcgattttcctgcctccacctcctgcgtagctgggattacagacgtcctccaccacgcccggctaattacttttagtagagatgggttttgctttgttgctcaggctagtctcaaaactcctgacctcatgtgatccgcccgactcggcctcttaaaatgctgggattgcaggtgtgagccaccgcgcctggcctcctattgtaatattatgattttttgcgcttggaatgactatctttccgcaggaatagaagagtggaatgtgtatctaataccactaattttttttttttttttttttttttttttctggtagagacaagatcttcctatgttgccaggccagccttgaactcctgggctcaagcgagcctcctgcctcggcctcccaaagtgctggcattacaggcatgagccaccgttcctggcctaataccactaaaattaatgaggaaacatgaacttcgggttacatatttatattagaatttttttcttttcttttttggagacagggtcttgagctttcacccagactggagtgcagtggtgcagtcgtagctcactgcagcctccaactcctgggcttatgtgatcttccctgtctcagcctcccaagtagctgggactacaggcatgtgctaccaccatggctcgctatttatttttaatttttattttttataaagacgggctcttgctatgttgccagggctggtcttgagctcctggcctcaagcagtcttcctgccttggcctcccagcatactgggattataagcctgctagagcttttatataatatggaaaagatgaggcataagcttgagtgaagttgagctcagttaactgtaaattttctcatatccccttgagatgagaattggagtcatcttgtaaaacttgctctttgacaacatggaattaatgtttcatgtggataggtgtattaatacagccagttgtatttgttgcagttgagttgttatgcttgggaactctaaaaagttgagcaaatctttgagaaacttcttggtgatttttatgcttctgttttcagtagacagtgtagcttaatgagcatgacctttgaagtcagacagccctggatttgaaatctggctctgccgcttagcagccttacatcctctttgagtccttactttcccatctattaaatggaggtaatgatatgtttcttacagagttgctctagggattaaatgacatgaaagatgttaagtggctagcactcatactggcccacagaaggggataggtagatggtaactgttgttatttgtaattgggcgtacctgtttaatgcaggaacgatggcttgaaaaatactgagaagggactcaactggtatcattttctactttgaatcactgtatctatccagatgtgggctgcagtagtggatttatggattggggaaagtaatcgcatcatgtgttcccccctgccccgcccccaccattagattattatatttaacaacaacaaaacttctgcaaagctgttgaagtcaaagtgaaccagtggctccaccattatcttttttttttttttgagacggagtcccgctgtgttgcccaggctggagtgcagtggcatgatcttggctcactgcaacctctgcctcctgggttcaagctattctcgtgcctcagcctcccgagtagctgggactacaggcgactgccaccatgcccagctaatttttgtatttttagtagagacggggtttcaccatgttgggcaggctgttctcgaactcctggtctcaagtaatatgcctgccttggtctcccaaaatgctgggattacaggcgtgagccactgtgcccagcccactgttatcattagactattctttttaaaattgtaatggtgtgggtagcttcagttaagaaaaaaaaagtcacaaagataaggtgatggatgtgtaattggcttgaattagtcattccacactgtaaacatgtatcagaacatctcattgtactccataaatgtatacaattatgatttgtcaattaaaagtaatattaatttaaaaaagaaaaaagacatctgggctgtaattggctgtggcttttaagatgctgaaagggaccccctcagtgaatttcatacttttttttttttttaacctcaaggctctaacctaacccctgattcttatagaatatgttgaggatgtagtgattaaaatccaagttagtgattaaagatgattttagagatttttaggtagaaacaatgtgtccaaaatagtaagtttagccttttaaaaaatcagctgcactttttgtattgtatataaaatagttgctttatagaatcagaaatacagatgtattgagtactatgtgtcactctagaaaggtgaccatttacttattcacatttaagaagcgacttctcaggtatgaaaagcttcagctgaagccaattttctttttgtaaaaatcaacattttgtaaacattaaaatgtcactacatgtgccttaaacattaaggaagatttaatagatgtcatttaacttactcaaaaggttcatgagactgaattactattatatgtagggtttggtttgagtctaaaagataatgcagcttagttacagaatgctcagacttagaatgcctttccttaggattttaaaactgaaatgatacctaatttaatccagttttatgtagagacacttgatatatgtagtgttctcttttgttttgaacattataaaaaagaaacaccctagtcttgtcttttctgattagtgtcaaggaatgaagtattttttccattgctaactgttctggcagttattgcacaataagtcatgtgcctatatgtgtaatgtatattgagtaatctttatttttaactggggcttttagatatgttatagttattaaaaaatatctaataggatttgccaaaataatataggataaatcttatggacattatgtattttttaaatggaagtataaaaatttgtctacacttttgcacattgttgatacctgaaaggttaatccaagggaaagtttattactgctgagaattaggaaaagaagatatttgggaagactgtagaaatatgaacctagaatcattttttaaagagtttgtagaaaccttgattaagtagtctaattttcccctcattttttagatgtggctagcagatccagtgaggttaagtggaattccaaggcaacaaagctaattcgtagcagagatagaattagaatctggggccagtgtactttctacttttcccacctctttagatccagctgaggttagaaccatagaactgtggattgggagatcttaatccattaaacatcttttttgtatttaatttaatttaaaaaatcagctgcagtttttgtatcgtatatgaaatgtttgctttatagaataagaaatacagacgtaatgagtactgtgtgtctctctagagagagcattttaaatccaggcatcttaagcatactgactaacatttgaggactatatatttatctatgaacatgaattaggagaaggaatgataatctgtggaaagtaagagtggaatattatgtttggatatttaaataactggctaacaggcattactgagttgttgaactacttttagtatctttaaaaagcagagggagatcaagaccatcctggctaatgcggtgaaaccccgtctctactaaaaatacaaataattagctgggtgtggtggtgggcacctgtagtcccagctactcgggaggctgaggtaggagaatggcgtgaaccttggaggcagagcttgcagtgagccaagattgcgccactgcactccagcctgggcaacagagcgagactccgtctcaaaaaaaaaaaaaaaaaaaaaaaaaaaaagcggagggccaggcgcaatggcttacgcctgtaatcccagcactttgggaggccaaggcggccggatcatgaggtcaggagtttgagaccagcctgaccaacatgatgaaaccccatctgtactaaaaatacaaaaattagcctggcgttactcaggaggctgaggcaggagaattgcttgaacctgggaggcggaggttgcgttgagccgaaattgagcgactgcactccagcctgggcaacagagtgaaaatccgtctcaaaaaaaaaaaaaaaaaaaaagcagaaataattttgtatttgattgtattgcttattatttaatttctttggaggtaagaatggcaaaaaccatttttaaagaaaatgggctgtggttcaagtctagatgttttacacatctgaaacttgactggagaagctagtcttccaataaggtggtcttcaagtatagattctgagttgtggaaaatgaggcatcttacaaaggaacatctctaccttccataaagttttctacccttcatccccgctccaattatttgtttttccttgcagaccaagaatcttgaaagccaaatgttctcattaagaagctgttagagtgcaataatgcattctaaatgcctgtcttagaagatatttcacaagttaatggattttttaagtttttcaaagatatagtaagtggatggttactgaacatggatacaaaatacattgaacctataaaaaagttactcaaatattattaaaaaattttttttctgaaattttttttgtgttatcaaaacaatacaggctcattagcggagatgtgaaaagaatagtataaggtagaagaagccacttatttctaccatccaagattaactactgtcaacattaaaagcatttcgtttttgtcttcttaatgtgtatatccagatgtcttttaaaaagttctgagataatattacttataatgctttatattctggtttaattgttacagtgtatgcatttttctatctaaaacatttttcatgtcttcatagtttattccattgtggtatgtcttgtggatatgccataacatatttggtaattcccttattggacatttgagggatttttcctatgttttcctattgtactcaatttgatctgcacttcctgaggatgtgttccagagttggtatttctgggtcaaaaacgcattttatgtcatatggccaaattgctttccagaaagtgtacactcccactgagaaggtctgaacagtttttgttttttgttttttgtttttccagatagagtctcgctcttgttgcccaggctggagtgcagtggtgtgatcttggcacactgcaacctccacctctcgggttcaagcaattctcctgcctcagcttcccaagtagctgggattacaggtgtttgccacctcgcccagctaatactgagcagatttcatatataaagttggactttggttaagcactttgtcctctggtattttttaggacaaacatagttttgttgatgaagtagaacggtattttaaaattatcctattagatactgctctgtttgtgtttaatatattttaagaagttcctttttatatttcagcaactgccaagactgataactatagagaacataattctttctgagacaagttcttgctctgttgcccatgctggagtgtagtggcatgatcatggcttattgcagcctccacctcctgggccctggctcaagagatccccccaccatagcctcccaagtagtagggaccacaggcgtatgtcactacgcctggctaatttttttaaacaagatttttgctgctgggtgtggtggctcacgcttgtaatctcagcatttagggaggcagagacaggaggattacttgaagccaggagttgaagaccagcctgggcaacatagtgaggccacattctccacattctctctctctcttttttgtttttcagacagagtcttgctctatcacccaggctgtagtatagtggcatgatcttggctcactgcaacctctgcctcctgggttcaagtgattctcctgcctcagcctcccaagtaggtgggactacaggcacgtgccaccacacacagctagtttttgtatttttagtagagacagggtttcaccatgttggcaaggctgacctcgaactcctgacctcaggtgatctgcctgccttggcctcccaaagtactgggattacaggcgtgagccactgcacctgaccaaggtcatattctcttaaaaaaaaatatatattttttttttgtagagacttcatctcactgtgttgctcagcctggtcccggaactcctgggctcaagagattctcctgcctcagcctcccaaagtgctgagattacaggcaggagccaccacgcctgcccctgagaacatagttcttttttgttgagcttcccaggcaagccatgtaaatataaatacagctcatcccctttacttatcatgctgctattttgttttagaagtattggtagattgcatattccataaccctgatatatttcagtataatccttacctaatcttggacctattatagtgggatgctgcttgcttgcttgtgtgtgtgtgtgtttttttttttggcggggggatggaatcttgctttgttgtccaggctgaagggcagtggcatgatctcggttgactgtaacctctgcctcctgggttcagatgattctcctgcctcagcctctccccagtagctgggattacaggcttgcgccactacgcctggctattttttgtatttttagtagagatggggtttcgctacgttggccaggcgagtcttgaacttctgacgtcaagtgatccgcccgcctcggcccaggcatgagccaccacgcccagcctatgaacctatattcttacttcagtatgcaaaatgtagcataatgttaagaatgaggttgcttaaaatctaggctacacacatagttaggcctgccttttcttcgctcttttcttttttttctttttctttttttgtttttgagatggagtctcactctgtcatccatgctgggagtgcagtggcacggggattcaagtgattctcctgcctcagcctcccgaatagctaggactacaggcacccgccaccacgcccagctaatttttgtatttttagtagagacgaggtttcaccatgtgggccaggctggtgtcaaactcctgtgatctgtccgccttagcctcccaaagtactgggattacaggtgtgagccaccgtgcccggccaccattttcttgaaagctcattttgtccggagaatgttttaatgccaatacatggacttcatcatttgtaaatagttcttatcagaggaaaatctaggaaaagaaaggaaacctacatttctctccttcataatttagctatttcgtttctagcttttggcaatcttatttcaataaaaaaattaaaaaattttttttttttttgagacagagtctcactctgtcacccaggctggagtgcagtggcgcgatctcggctcactgcaacctccgcctcccgagttcaagcgattctcctgcctcagcctcctgagtagctagggttacaggcgcacgccaccatggccagataatttttgtatttttagtagagacagggtttcacgatgttggccacactggtcttgaactcctgacctcaagtgatccacccacctcggcctcccaaagtgctgggattacaggtgtgagccactgcacccagcctacccgtttcttaaaaatattaaattgacgttacaggttttcattaacccttatatgaatattttggttactgccattattttctactcttaagtgactgaaatgtttaactttggtttttgtctttttttcagagttccggtaatttcagaaatgaaatgatttgactagttttatcctttgaatttttctgtcattctttcctttttttgagacagggtctcaccctgtcacccaaactggagtaaagtggcataatcatggctcactgctgcctcaacctcttgggttcaagcagtcctctgcctcagcttcctgagtagctggggctacaggcatgtgccgtcatgcccagctaattaaaaaaatttgtttttttgtagaggtggaatcttgctgtattgctcaggctgatcttgaactactgggctcaagctgtcctccttccttggcctcccagtgttgggagtacaggcatgagcctgtactgtgcctaagtcctcccatcctttctgtagtaggtattgccctaagttaggattgatcatattccctatgatcatcattattatttttttttttgaggcagagtctcactctgtctcccaggctggagtgcagtggcgcgatctcggctcactacaacctccgcctccctggttcaagtgattctcctgcctcagcctcaggctctccccaccatgccctgctaatttttttgtatttttagtagagatagggtttcactatgttggccaggctggccttgaactcctcaccttaggtgatccacctgcttcggcctcccaaagtgctgggattacaggcgtgagccactgcgcccggctcctctcattatttttaaccatcagaaattatcttgttctcttgtttctaatagtctgtcccttttcacagagccaagactttatcatattttacaatgctgtaccccattgctaagaacagtccctgccacatgacaagctctttaaatactgaatgaatgaatgaatgaataataacagcaaagtatacctactccatgcatgtttaaactaggtgcaaggcattgtgatagataacttataaatgtaccagacaaggtcatttatggtcgggtatgtgccatgtataggagaggaatattaagtgccttaagatacaaaatgctattggaattctcccctgacccaccccattaagacattggaggagttttatttagtaaggctgtttgctgagttttggttggacagtggcaggaatggcttttgagctgggttataagagtagaggaatttcatttattcaacaaatatgtcaagcagtgttttgggcagcataaatataatggggagcaaagcagacaatgttcttgcccttgtggaactgccgatatcatgtggggaaaaaagatattcaagcaggaacagtgggaaaagcaaaggcacagctgagggaaagaaatttttttgttggtttaggcataaccttagtgaaggaaaaagaaacaaaggctggaaaagtagatcagtcagctcccacagggccttgactgagtgtgacattaggcatggagggccactgaaggttttaattcagaggaataagataagacctgtgtttccgaaggattaatttagcagcaatatagagaccatccgcaaggaaattggttacaaggttattacagaggtctggttgagagacattgagggagacagttggggaggaggggaaaggtacgcattattatggaaataggatgagtacaatttagcaattaagtcagaggtacaggacaaaggggaatttgcaaagacccttttaaagatttgattgaatggtggggaatatggttgtaccatcagcaaacagcagttacagggtggggaagaaagaatgggtttagaagaaaaagggatgatttgagtataaattgtattacaggctggggcgtggtggctcatgccagtaaccccagcactttgggaggctgagaagggtgtggatcctttgagctcaggagttcaaggccagcttaggcaacatagtgaaactctggtctctacaaaaaataaaaaaataaaaaaaattagctggatgtgctgctgcgtgtctgtggtcctagctgccggggaggcataggtggtaaggggatggcttgagtccaggaggctgcagtgagccatgatggtgccactgcattccagcctgggcgacagagtgagaccaggtctcccctgcactgcacagcacaccccacacccctggaaaaaaaagtgttacataattaatgatataaagggatggctggttggaaatgacaggctatgaatgctatatttaagttcagtggcacaaaaactgagaattaacatttcatccaattcctaattttgtcttcaggagtataagagatacaggaagtagttgagatccattcctagtttctcttcaaaagagtgggttgtaggatcttttatttctactgattgctgtcacttaccgtaccctgctgatgactcgttttgccaatgtttcggacacaaggactaggcagaatgttctccactcctcaggattgctgttgggctatcttgatttatttgtgtatttatgtacatgaatctgtggccagaatgcagtctgcccagaagaggtctttaatagctgggatgaaggctgtatattcagagtgggtcagattcgtttgcaggctgggaagcctttgctgtcgaattcgaagagtaatttttctgtttctggaaagtgcctggcttaggtttgtatagtgactttctactgaagagaaaattttctaggtgtgatttgtgtgctttaaatctaaaggatatttgatttcttgacatttaagttgggatttttctttggtgccaggtaaacacgtagatagtgttagagtatcatttttcttctactcagattacattactgatcattttactgtgtggttgaaaagacaaagtgtgatccttggtcctcatagcccagttaggttctttgatatctgcttagagactcatttagagcagtctaataatggatttatagtgctcacagatagcagttcattttggaacatgcggacattaccataaaacaagttaggaaatggctgttccaccttcactatgtcattctttttgttgagatggagtctcgctctgtctcccaggctggagtacagtggcatgatctcagctcactgcaacctccgcctcccaggttcatgcgattcttgtgccttcacctcccagagtagctgggactgccggcacacaccaccacgcttggctaatctttgtgtttttggtagacacagggtttcgccatgttggccaggctggtttcaaactcttgacctcagctgatctgcccacctcagcctcccaaagtgttgggattacagccatgagccactgcgcctggcctactatgttattctttaggctagttaacatatagttcctagacatcctattttatgtaatcatcctttcctcccatttccaatacaaagaacgttcagtaaaaattatttcatttaattaatgaaacacatctgatctttttatttatttatttttttttgagacagtctcattctgttgcccagactggagtgcagtcttggctcactgcaacctctgccttctgggttcaaataattctctgcctcagcctccctaagtgctgagattgcaggtgtgagccattgttcctggctcacttaattattactattattattatttttttgagatggattctcgctctgtcgcccaggctggagtgcagtggtgccatctcggcttactgcaacctccacctcccaggttcaaacgattctcctgcctcagcctcccaagtagctgagattacaggtgcacgccaccatgctcagctactttttgtatttttggtagagacggagtttcaccatattgtccaggctggtctcaaactcctgacgttgtgatctgcctgcctcggcctcctaaagtgctaggattacaggcgtgagccaccgcacctggcctattattattattattattattattattattattattattattattttgagacagggtctcactctgtcgcccaggctggagtgcagtggcgcgatgttggctcactgcaacctccacctcccaggttcacgcgattctcctgtctcagcctctcgagtagctgggattacaggcacatgctgccccgcgtggctaatttttttgtattttagtagagacggggtttcaccatgttgcccaggctgatgtcgaactcctgagctcaggcagtccacccgcctcggcctcccaaagtgctgggattataggcgtgagccatcacgcctggcctattattattattatttttattattatgtatatttttgagatggggtcttgttctgttgcaggctggagtgtagtggcgtgatcttggctcaccgcagcctctgcctcctgggttcaagtgaacttgattattttataaaatgttttcacgtaaggcattatattattcttttggccctcttgctttaagtagacatttactgatttatgtaagataaacaaagattaagtgacacagttaattgtcatttgggtctgaaattcaattccaattcagtctgaagtgtactgttccataaaatagatgagttatgaggaatctgggttccatttttacacatcctttagggtcttgctttgactcctgataaatctaattcttccgcctcctgtcactgaaattagtttggaagctgggcatgactttatagtgttccatgtgcattttttgctttctttggctctttgtgccaagtgttttaagtctactctactagctgttagtactaccctatgttatctttcctaggaacacttacaaattttagtatttattctggcaggatttggaaaggggatttaaattagctagtgaaattacagcagaatggctgtgggcagaaggatagaggaagtaggcctttgaagtaaatgttagattgtggtaatgatggagagactgagacgcccaagataccaattgattttctttgcctgtgatgcttgtttttgtccgctggtactcctttccccctagatggcactgtcttactcatcgttcaggtcccaggtctgtaaaactttgccctaactcgtctcctcacagcacttgatcaaaattatatttatctgtgcaaattatctgttcattggtctctaccttcagacaacaacctttcaatatttatggcctttaaatgaagcagtgtgcctactgctctgtaattgttgacttaaatagagtaaaacagtatagggtaatgtttaagtatgtgggatcaggcaggcctaaatttaaattctggatatgccagaattctgtgacctcctcaaagcttcagtttcctcattggggatttgggcatgagaatacttgccccatgagctcatggtgaggtaagacagttggcacagtgactggcatagaatgagtactccttaggtggtaggttgatgtgatattcgggggttagggcaggatcatgtgctctactagatgctagatgaagtggaaccccctcacctttcacgtgagcactgagtgggaattcaatttcagaaggtaatgaaagttcctgagtttcagagtagaagtgtactgggcacaagggaccagtttttaattttctcttttttttttttttttttgagatggagtctcactctatcacccaggctggagttcagtagtttgatcttggctcactgcaaacctctgcttcctgggttcaagcaattctcctgcctcagcctcccaagtagctgggactacaggcatgcaccaccatgcctgggtaatttttgtatttttagtagagacagggtttcaccatgttgatcaggctggtctcaactcctgatctcaaatgatccacccgccttggcctcccaaagtgttgggattacaggcgtgagccaccatgcccagccctttttttaatttttaaaaactttttattttttgtggcgacaggatctcactgtgttgcccaggctggttcaaactcccggcctcaagtaatctcccacctcagcctcccaaagtgctaggattacaggcacgagccactgtgcctagcctggtttctgattctgattcttctttttaaatcttctttctttgctcactattattatattttaatggtttctgattcttgaaggttttctgtcattttgagagagaaactaaaatgagaggtttttgttgttgttgttggggatttttttttttttcggtgccataacccatcctagatgtgctaggatgttaggggcaacttggtgaaaaatttactggtttatttgggtttttcttctgctgataaatttggttgtagttaatagttttggcttggtggaagagatggtgattgctctaagtttttttttttttttcaccagagtagaagactagcagagcatctatttacaacctctcaatttatcatggagtttgtattttgttgttcagcagtctaacattgacttcaagcttttgtacaaataatgactctcgttcatttgccaacaaataactgccaaatgcctgaggcattacactaaagtggaaaatcacttttagggcttttaagtttaaacttaggttcaaattccagttttgccactatttagctgtgtgtatgtgaccttgtgaccttgacctcaagttttcttttctgtaatacgaggccagagtaaaatgagtaatgctgagctattatcattattatttttaaatagtataagccaattacatatggcttagctaataaggatgtgttgttgatgcagtcatcacatgtgattgaaaagcattcctgtcactccaacttcttactgcgcttactgcacctgccacactccccaccctgatgatagtaagtggaattttaggcagctactgaataaataatgattttactatctagaaggcactgcagtttggaacctgagaaatgtacagtgacttagtattttatgactgtccatcattttaagagttgagtttcactgtgaaacaatgtcgaaagcactgactggactaatggagtggctttacagtgcttactgtttcttcagtaatacccagagagagctgcagtgtggaggagccggtgaaagaatgtattcagcccatggcattctctgcagccacaccactgtactgccaggatcacttgagaaacagatgtctctactgatatataagcagacagctaaaagattccatacactgtagtttaaaatgattttagggaattattaataatattttaaaaaattgttactgaatttttttacagtagaagggaacatgagacaatccatatgatactattagtttgggagatgaagttgcaaaattgtgaggcagaaaaatgttaaaagtaggcactaaaggactaagaagttacaatcttggctttaatgtatccaatgacaggtgccatggtttgcttcctccagagtctaacaggcaaaatagtatttgtaaacattttcttgcctctactatgcctaggctagcagtctttaaagatagtctttaatgggaggattgcctatttatcttatgatgtacctgtggaacagaattttaggggcttcatttatcttccaggtagaaaagagctgataaggggttatggagatgttgtcacctggcattatatgctataatccttggtcacatttataagtttttttattctaatacaatggatctgagtgtcattaggagccttgcagacaagtgtttctgggtaacttctcagtaacatctttgacatttgtttagttgcagacctaaatggccactgatggatactgcagtttcagtaagcagtggagtttatttccctggaagtagaatgaggcagacccagaatattgtagagtgcttgtcatcagctgtatttcttcatggcccagaaaaactcctatgtaacttcccttagagaaatgaaactgaacgggaagcagaagtagttactggatgatgttggacctgggaattctgaatgagtcagttcaattcctgcagggtatcctgtctgaaagaaattagggcagtatgcagtgcaaggcttgcagggctcataggtctttctgttatgttctttcaggggtagcaatggtcaggatagcttctcactacacaagatgtgattagttttgtttttttttttttttttgagacggagtcttgctgtgtcgcccaggctggagtgcagtggcaccatctctgctcactgtaagctctgcctccaagatgtgattagtttttgttcctcactttggggagcgtgtgtggcagtgtttaaaaataatgctctcctgttggttcttagggaacaaagtcttctggtatggttttgctgggtcctcacccaaatctcatcttgaattgtagctcccataattcccacatgttgtgggagggacccggtgggagataactgaatcatggggacgattttccccatactgttttttgaggtagtgaataagtctcacaagatctgttggttttgtggtaaggggaaaccccttttgcatggctctcacttctctctagcccaccaccatgtaagaagcccctttactctttcttcatcttgtgccgtgattgtgaggcctccccagccatgtggaactgtgagtcaattaaacctctttcctttgtaaattaccagtcttgggtatgtctttattagcagcatgagaacagactcatacaccttcttggttttttttttttggcaaaatttcaacacgttagtctttaactctctagtgaatgttggagcagtctccagattgcttaaaactgaactaggggtacagtccataaggaaaatatgccctgaggggctgtatgtgtgcagccgtatgtatggagctgtgatttgttgtcatctgaaattctaggctataataattgttcctggggctcaaagaaaccatgacgggttactaccaataacattctggtgggatgttggttcacgcctgtgagaaacactcatttactcatccaaacccaaagaatggacttggagacatgaagaacagcggaagcaagacttttattggcggtcttgcaagatctggtgtctggtaggcagtcacaccggggacagttacaacaggtaatttatctcctagcacgcaagtccctcccccagctcctcattggttgagtactatggggttacaatcttcctggacattgcctaagttttattatcccccttataaggttataccgtggtccctttccccacttcagtttcgatttcccaataatgaaactttctccccttttaggggctgacccctcctctacattctgttcacttatcatgaccttctgggtgcatgagctgtgtggtttattacatccacaggctggcttccagtacttagatttattatgcctcgaaaatggaccacttaaaatgttttctcacaaatttccttccttttctatttacttcctttggtctcattttcatctaaacccttttggtcctcaaattgctttagaagtcatttactttcttccttataggagagtgagtttattttggtttctaatagtagcaggttattttgctggtaacttattggcattgtttattaatagctgttttaattaatctctgtgctagtcccctcacacacaagtaatactacatcccactgctaagactcctgctacaattatgagagatgtaaggattgaagccaccatgcctttccattttccaaaccaaccatttagccaacccgtaaatgggttgttaattccagcattttctgcctgttcgttggctagagttgtcagtccttgtaaagcttttgtgatggtcccatctggggcagtattgttgggaatgaaagtataacgtttcccacccagcataacacttacaccccctttttctggtattacgtctagtgcaagcctgtttttccaggccattgggctggtggcatctaactggctagccatccctttgagggtgtcctgagtataattgatgaatctttgttgattataatagatgtagttaatctagttcacattcttattaatagttgaccacagaagagtgctgactcaaacccagcagctatttggttttgggccttaaatttattcggcactcccctagggactcctattgagtcaacatatatattgacattaaaagagtttgtcaaatctctctgctttcagtggccgtgtgtgttttcaggtatcttatggaatgccagggtgaagggaatggccaattagactaaagcacaagtcccggtccagttggatggtaacaagttggggaggttccttttcccatagtaccaccagacgttagcctggggtatatggagagccgagtgattgccatcgcctgacttaccagtgatgtttaggatgtgcgtacaagttgagagttttcccacgggcttattgaactctgccccctatctagagaggcaagaggagtggttcatattccctagagagaatgaggggattgctttgggatctgacctctgcaatgtgggaaagagcagtgacagactctttacaagtcttgtttccccatgcgtccttgtcctggtatagagccaacatgcaatccatttcttcaggatcagtatcccatcctaggggaaatggaaccacctgtgcctgaggtcctcccgtagcacacgcatagcagtcactcttgttgaaggcttgtaccgaaaatttgatccatttgacccaggcgtttacatccctgcaccctgtctcaatttctaaggtttgccttaaatcctttacctcaattatttttaccttttagggttattatttggcagactaaagtgtttattagggtctggagttggagtagttccaggcaaatgagaggttgagttttttattagtttgagaacaaatcaccctatggggtctttccctgtgatgtctgcccctcacgtatatacctgagacactacttttggttcttggcctagagtggctggattgctaatggcaatgagtatagggttgcgttctaaattttggcagttatttggcaaggagcccttggacagatgtagtttattctttaagtgtcttcagctcggagttacccaccccgtgtttactgtccaaccctgaattgggtggttcaccatacatcatcccagctggggcatggtaatgccatactgtaatctgtatctggttcagggcaaagatgtttattcacttgtgagaactatctctgagtttcaaaattcccacaaggtgagacctggcaggcatcgaatcttatagtctggggtgctaccatcttggttacatagattacaaacctgattgggtagggaggagttgcctgcaagtttccattttgaccttctgctctttgcgtagtaggccatctcagccatattaacttccagaaatggggccagcccatgttttctttttagatttttctcagagttaactttaagggttacttaaagttaacctctgcaatgtgggaaagagcagtgacagactcttataagtcttgtttccccatgcatccttgtcctggtatagagccaacgtgcaatccacttcttcaggatcagtatcccatcctaggggaaatggaaccacctgtgcctgaggtcctcccgtagcacaggtgatccatgcactttccactggtcttgttccttcccttccgaggtctcttttaccagtcccttgacttgagtacagtgagtccacccctgttcagccgtttgcacggccatcttagtggtcaggagcacttcatagggaccttctcaggttgggtggagcttgtcttcttaacaagtcttaatcagcaccaagtcaccagggtggaaatggtgaactgtgaactcaagaggaagagtttgagtcagaagtccttttaacctaagggatgacagggtagaggatatggccagtatataatttcttaagaattgatccttggtttccaaagtaggaagatctgtagctctgcccaaatatgggagcccatataataactcgtagggggacaatcccaagtcttttcttggggctgtcctaattctgaggagtgctattgggagacatttcattcaaggcattttagtttctaagattagtttggtgatatgctttttgagagtttgattcattctttctacttttctagaggaagggggataccaaggagtgtgataatcccatctaatttgtaaaccttccataattccccttaatacccttgaggtaaagtggctcccattgtctgaattaatattttccaccaggccaaatctaggtacattctgttctaattttattttgaccacattcccagcagtggctgttgggagtggaaagacttccacctagccagaaaggtgatctctgatcaccagtaaatactttagttttcctactttgggcatttctgtgaaatttatttgaatgctttgaaatggtcttagtctgggaggtcttcctcctgtggcctgttttctaatcacctttttgtttatcctttgacaagttacacagcttccacgtacttgtttagcaaaagtgtaactccctatacactcatcattcctatgtattgtattacacagagcctggggtccccattgactccctttgtgtaatacagacgttagttctctcatcaggggtttacttatttctctcccatcaggaagtacccacttcccgttttcagtttgtgtgacccctatcctaattcttccttctcctttctggtaaactggggccttaatactaccttagggatgtctgggatcaggctaaatagtctaatttcttcctccagggaggcttgcatagcagctttatctgcaagcttgtttcctacagcttctatagtgttacctttctgatgaccatttatgcgaactatggcaacctctgctggaagctggaggctttctaaaacctgtttgaccagttccccatgtaccaattcttttcccctgctatttattaggccctgcactgtccagatttttccaaaagtgtgtaccaccccataggcatatttagaattagtgaatatagtgccttcttggccttcaaggagctttagcgcctggttaaaagcatataattcacaggtttgggccaaccaaccattaggtaatctacctttctcacataaggagtgtttatttccatcagtgatagcataaccattatctctctttgccatctatccacttgggacaacccatccacaaacagccttatcccatcatgttgtggagcttccctaaggtcaggtttagctttgattttgtattcagtgatatctaagcagttatggtctgatggctctttgttctctcctttgtataggaaactggctggattcaggcaagtatttgttgttacgaccaaatcttttttttctagtaatatggcttcatattttagaatctgagaatccagtaaccatctcccggctttttgatttaatatattcctgacctggtgtggggtgcttactattagggccccaccaaaggatagctttcgactctcctctaccagcagggctgtggcagctactgcttgtacacattcgggccacccgagagagacaggatcaagaagcttggagacaaaagcaatatgttgcctcttccctccccaggtttgagtgagcaccgcaaggggcatgccctggtctactgttacaaacagatggaatggtttctctaaagatgggaggactagggccggggctgtaatgagggcctgttttagttctttcactgcctgaatttcttctggggaccattgcaaggaatcaggttcctcctctagtagtttcagatacacaatctttgtcttttgagcatatgacttaatctataacctacaacagccagttaaacctaaaaattttcagagttctctcttggtcttaggaaaaggtagacccctctattcctgatattctctctgggtttattctctttccttcactaatcaggtgtcctaaatatttaacttctttttctacagactgcagtttgtttttagagacttgcaatcccctctctcctaggaaattattatagtggtttctgataccttggctctcctctccccagaaattaaaagatcatttacatattgtaacaactgggtttccctggaaggttggaattcctccaggactttttctaagacttgaccaaataagtttggggcttccgtgaagccttcttgcagcacagtacagtggtattgttgttttctcccagttgtaggattttcccattcaaaggcaaagaggtccctgctcctaaggtctaggggacatgcccagaatgcatcttttagatctaccacactgaaccacttatgttcatagggtatcttactaaggagggtgtaggggttgggcaccacagggtggcaggtctggacaatttgatttatagtccttagattttgcaccaatctatacgacccatcaggctttttgactgggagaattggagtattgtatggtgacatgcagggttctaatagtccatctttaattaattcctctattactggttggagcctttttctcccttcagtagaaatgggatattgttttctgcaaactagttctcctggttgttttagttcagtctgtaagggtgtgatttttaaccctctgctgttgcctttttctaatcgacacatagggattattttgtctttcttcctcctttattaggaggcccattatgacttttaattgttctgcctgtattcctaattctaaacccaatctcacaatcaggtctccacccaggaggttagtttctgctttgggaacatataagagtgacctctcagttcgttctggtcccaatctaattaacattttcttgaatattggaacctgaaatctctcccttttaatccctgatactgtcaatttttccttggttcagtaccccttggtgaattagggaggagcaagccgccccagtatcaaccaaaaatgtcccttctttttcctcaggtcccaccttcaaatttatcaagggttcctagtgggacctactcagaaggaacctctgaccccaatagtcttcattaatggtcatgagggggattaccttttcttcctctttttttttttgatttatactttaagttctagggtacatgtgcacaacatgcaggtttgttacatatgtatacatgtgccatgttggtgtgctgcacccactaaccggtcatttacattaggatatctcctaatgctatcccccgcctcctcctaccccacgacaggccctggtatgtgatgttccccaccctgtgtccaggtgttctcattgttcagttcccacctatgagtgagaacatgcagtgtttagttttctgtccttggcgatagtttgctcagaatgatggtttccagcttcatccatgtccctgcaaaggacatgaactcatccttttttatggctgcatagtattccatggtgttcttaatccattctatcattgttggacatttgggttggttccaagtctttgctattggggtcttcttttttctattcaggacattctcttaaaatgccctggctttccacactcgtaacatccactcttaggagctttttcctgcgtttcccttctttctctatgtcagaatctatcattcccttctctcctttgagggggattttgatttaacgtttttctgactacctcttccacagtggaaaccatgatttttgctttttgtttttgcttctcttcctctgtccttacaaagaccttctgagcttccctgaataattccttaatcagttttttattctatccatcaatcttgtctaatttttttgtaatgtcaggccagctctatgttacaaagttagccttcaaaaggccttgccctactgggtcctccggatctaattttctcatgtgatttttgagcctctacaggaatgcggagggaattttctctttttcttgttgaatctcgaatgcctttaagacattttgtgtcctaggagtggactctttgatccctttaattattctctgaggtcctgcatttgggcttggtccctgggattattattatcccatttggggtcaacgtttggagatttttgttcagctggcaagacttcttgcccaggagggtgttgcctctcccagatggtcatggctgctctcttaatcattcccctttcttctcctgtgaataggctattcatgatagatatcatttcagcccaggtgtaaaagctgggtcctacgaattggtccagctggactgctaaactgagggcatcctctaggagtgatttcatttccttcttgaaattcttaacttcagtacttgtaagaggagcatttacaaagccaatatctctgtgtcccatgggagcttccctaagagggaacattgctagatgcctgctgtgtggaagggatagggaagttctcagtatccctcttacactgttctaattcttttcttaaatttggataaggatttaaaggagcagttggtttggctctcctgtggtctccaggtctatcttcctctaaccctcctgctgccccttgattttcctgtccactattttgtgagatgtatggagggggcatgcgtgataggtggttccagggcctttcactgggtgagggctttttattaggttctttttcttcttctttgagggggaacatgggagctaattttttgatccagcagagtgtaacctacctcttcttgtgaggatggagttttatcatttacatagagaattaaagcttggcacacccaatcctcatctgagccaaacttaggccaaaaaagatcgaaggcttatgaatagggtctttgggccagataaaacagcgatgccttatcttttgcttttccttttgcctggttcaagggttgtcccttcaaaccttcagcattctccccaaaggactatctgggggaatgtcagagggagtctctttggctccctctttgctttgtaccctaggtttaggatttctgtttcccatttttgatcagcctctatgtctgagctttcttccctgtgtactcgacccgcgctactagaggtttcttgcacaccctgagcatcggtttgtccgtctctggctgtttgcgtcgcaggagaacggaaccgtggattgggactccgcacttgcttcatatctaagatacatctcagttgcacacacttgacctctgaaaatgcccaaccactaaggcagtacttacagtctaattttcctacctgggctcctgcacaaggttgcctggttgctgcagtgtgtgcttttctccctgtgttgtctctgctgcctctggaataacagtcttgggtttgtctatggcctctgccgggtgctggaatacccagacagagcaggccacctaaattgatgggatgtgtctcccccttgaccggagttccactccatgcaggcacagagatcctggttgggcccccaggtttgtgagaaacacacattcacccatgcaaacccaaaaaatggacttggagacaccatcccgtgtgtggtaggcaggcacacctggggcagttacgacaggcaatttatctcctagcacacaagtccctcccccagttcttcattggttgagtactgtggagttacaatcttcccagatgtgtaagttttattatcacccttagaaggttatatcctcgtccccttccccacttaagtttcgatttcccaataacgaaactttctttccttttatgggctgacccctcttctacagtctgttcacttatcatgaccttctaggtgcatgagctgtgcagtttgttacatccgcaggctggctgccagtccttaggtttattatgacttgaaaatggaccatttaaaatgttttctcacacccctaatccctaccacatttggttggacaaacttgacaatttagaccattcagcacatgatagatgttttagtcaaggtcttgaccccaattgcacaaatcctttagtttgtagaactttgctgtggattggcatgaatattctagctgcagtgatatatccctcttgcttgctgttaagtatcttatatcattgtacttgttttaggacagtgtgtcagtccttttgaatattgtgagctactttttgttatgagggtaatgcagggctcataaaatgagtttggaagtgttcgtgcctcttctgtttttggagattatgtagaattcgtgttattctttaatgtttggtagaattagggctgggcacggtggcttacgcttgtaatcccagcacttcgggaggctgaggcagggggatcacctgaggttgagagttcaagaccagcctgactaacatggtgaaaccccatctctactaaaaatacaaaaattagccaggcgtggtggcacacgcctgtaatcccagctactcaggaggctgaggtaggagaattgcttgaacccaggaggcagaggttgcagtgagccgagatcttgccactgcactccagccttggtgacagagcgagaatccatgtcaaaataaataaataaataaataaataaataaagtttggagccaggcatggtggctcacatctgtaatcccagcactttggtaggccaaggtgggcagatcacttgaggtcaggagttcaagaccagcctggccaacatggtgaaaccctgtctctactaaaaatacaaaacttagctgggcgtggtggcacatgcctgtaatcccagctactcaggaggctgaggcaggagaatcacttgaacccgggaggggaagcttgcagtgagccaggattgctccactgcactccaccatgggtgatagagtgagactctgtctcaaaataaaataaaataaaataaaatagttggtagaattcagcaggaaaataattctagtcccgggatttctttttaagaagctttgaagttagtgattcaatttcttcagtagagagagggccgttttttcttccagtgtgtttggtagtttgtgattttcaagaaataggttcatttcatcaaagttgttgaatttatgagcatagcgtgtttatagtattctcttatttatcttttttaatgtcggtggagtctgtagtgatgtccttactgatattggtgatttttatttattttcctttgtttatcaattttaattatctttttagagaatcaggatcttttggtttcattgatttgcttcaaagtttttctgtgttcagtattatttactgctcttaccattgccctctgcttgttttggatttattttgctctttttctaatttcttaaatggggggcttagattgttaatttgagacatttcttcttttctaatataagcatttgaagctgggcatagtgaagtgtgcctgtagtcccagctacttgggaggatgaggtagaagaattgcttgaactcaggagtctgaggctgcagtgagctatgattatgtcactgccctccagcctgggcgacagagcaagaccctgtctctaaaatatataagcatttgagtctataaattttcttctgagcactgattagctgcattatacaaattctgacatgtttctcatttagttcaacatgtttttattttcccttgaggcttccttctgtgaccaatagattatatagccaagtatttggttgtttccagatagctttatattaattatttctagtttaattccattatggtgaaagaacatactttgtatgatttttgtatgacttgaatccttttacatttgtgaagcttttctccccccacccccccccttggagataggatcttgctgtcttcctccaggctgggctgcagtggtgtgtgatcacggctggctgcaccctcaacctcccaggctcaagcagtccacccacgtcagcctcagcctcttgagtacctgggaccacaggctcacacgaccacgtctggctaatttttataatttttttgtagagaccgagtcttgccatgtaacttaggccagtcttgaatcctcccaccttggcctcccaaagtatcgagactgtaggcatgagccattgtgcccaggcaaagctttgatttgtggctcagaatatggttgagtgaatgttcccatgtgcatttgaaaagaatgtgtattcttttttaatgaaatgttctgtaactgtgaggtagatccagttggttgttgtggtaagttctacatccttgctggttttctccctatcaattaacatgagaggaatgttgaaatctctaattataattgtgggtttatttcaattctatcaatttttgctttatgtgttttgaagttttgttaggtgcatactcatttaggatgttataccttcttcttggtgaattcatccttttattatgtaatgtccctctttatccttggtatattttcttgctttgaagtcggctttttcttctgatattaaaataattatttcagctttctgtgataagtggttgcatggtgtttgtctttctatctttttacttctaacttacctctccctaaattatattaaagtgggtttctcttctttcctcttttctttcttcttgctctgttgccaggctggaattcagtgatgtgatcaaggctcactgccacctccaactcctggacttaaacaatcctcccacctcagccatttgagtagcttgggactaagggcgcgtgccgccacacctagctaatttttaaattttttgtagagatagagtcttgctaggttgctcaggctggtctcgaactgctagcctcaagtgatcctccttcctaggcctctgaaagtgctggaattacaggcatgagccactgtgcctagacaaaatctgggtttattgaagacaacatatggttgggtctttttaaaaaaatacattttgacagtttctgtcttttcattgatgtgtttagaccattgccttttaatgtaattattgatatttaagacttagtttaaacatagtatttagttcaaataatcatttaattatttgttttctgttcagtgcctttggttttgttcttattttacctttgctgatttcagcggagtgtttttatattaattttaatttctctattggggttttgactgttccttgcagtggttcttctagagtttacaagtatgcatttcccagtccacttagaattaatgtatatcacttaatgtagaatgtagaaaccttagcaacgtagaggcccctttaccttcccccctttatattgtagtcattatcggtaatatactgataggacttggcagtgtccccacccaaatctcctctttgaagtcccacaattcccatgtgtcatgggaggaacctggtgggaggtgattaaattatggggcagatctttcccacgctgttttcctgatagtgaattaatcttatgagatctgatggttttaaacaagggagtttctctacacaagctctctctttgcctgctgccatccatgtaagagtgacttgctcctgcttgccttccaccgtgattgtgaggcttccccagccacatggaactgttaaatccattaaacctctttcttttgtaaattgcccactcttggatatgtgtttatcagtagcgtgaaaatggactaatacgtacacctacctaaatggaaaacgacaccaatgtcgaattttacctattctttgaaaaaaaaattttttcctttcagccatcaaacattttaaagtatttaaggggagaagagtttattatatttacccaggtatttatcatttcttttgatttctcttcatttttgaagtcccacctttccctctggtagtttctcttatgcctggagaacttcctttaacatttcttttagagcacgtctgctggctacagattttagtttagtttagttttcctgcatctgagaatgtctttatgaccttaattcctaaaagatatttttgctgaatatagaatttcagactgatagtctttttttttttccccctccagcacttcggaagatgctttgattgtttctgatgggaaatttgtagtaatttcaattgttattctctaatgtcatgcatcatttctctttggctgcttttaagatattttcttgtctttggttatagcagtttaattgtgatatatctggatgtggatttctttctgcttaccctgcttagtgtttgttgtacttcttgactgtaattttgtctttggaaattttggaaattttcagtcatttttttcaagtattttttcctgaattactctctctcttattccaggactttgacatgactgttagtcctttttatattgtcccacagatcctgttcatttcacagttttgttcattttttaaaaaaaaattttattgtggtaaaataacttttttttttttttgagacagggtctcgctgtgttgcccgagggtggagtgcactggtacgatcttggctcagtgcaacctctgccttccaggttcaagtgattctcatgcctcagcctcccgagtagctgggactataggcatccactaccatgcccagctaatttttgtttttttgtagagatggggcttcactatgttggccaggttgtgtcttcaagatttttaagtgttcagtgatgttaagtaccttcatattgaatgcaaccattactgctatccatctccaggaactctttttatcttgtagaactgaaactctgtacccattaaacagtaactcctcattcaccccagcaccaccctagcaaccactattctacattctgtctatgattagtcttgctctgttgcccgggctggagtgcagtggcacgatcttggctcactgcaacctctgcctccggggttcatgtgattctcctgtctcagccttctgagtagctgggattacaggggcatgccaccatgcccggtggatttttgtggttgtttttgtttgtttgtttgtttttaaagtagacttgtgttttcactatgttggccaggctggtctcgaactcctgacctcaagtgatcctcccacttcagcctcccaaagtgctgggattacaggcctgagctcctgggcttggcccaagttactatcctttcatttcaacctgcagaattccctttattttatcttacaggtcaggtctagtagtaatttcctcagcttttgtttatctgggaatgttttaatttttctccaacttctgaaggacgttttagctgaaaataggattctcggttaacagtttttgttttttcatttagcactttgaatatattagcccattgccttctgaattctgaagtttctgataaatctgctgctactattgattatttatatttgatgagttgcctcttgctgctttcaagattatatctgtctttgtcttttaatagcatgtttataatttgtcttggtatagatctctttaagttcatcctacttggagtttgatgagcttcttggatgtttatgttcatgtctttcaccaaatttggggagttttgggtcattatttcttcaaattatgtctctgcctcctattatctgtcttcttttaggacttccacagtgtgcatgttggctttcttgatggtgtcccataggtcccctgggctctgttcacttttcttcattttttttttctttctctgactcagactgaataattaattccatttgtcctatcctcaggtttgttgattccccgtgcccccccacccccgcctggtcaaatcagccttcgtgttcctctagtaaattttgcatttgctttattgtacttttcaactctgaacactttctttttggcatctttttcggttttctacctctttattggtatttctattttgttcgtacatagttttcttgcatttttctcagtgttttttttttgttgttgttgttctttgagtacctttaagataatttttgtgtgtgtgtgtgtgttgtttttgtttttgagacagggtcttgctctgtcacctaggctggagtgcagtggcgcgatctcagctcacggcaacctccgcctcctaggttcaagtgattcttgagcctcagcacccctagtagccaagactacaggtgcgcaccaccatgcccatctaatttttgtatttttgttagagatggcgttacactatgttagccaggctggtctcaaactgctgacctcaagtgatctgcctgcctcagcctcccaaagtgctgggattataggcgtcagcccccgcacttggcctaagataattgtttactggtcttcctcagggtcagtttctgttggttaattttttttcctttgaatggaccatacttccctgtctcttttatgctttgtgatttttttttgttgaaaactggaaatttgaatctaataatgttgtaaccctggaaatcagactctcccccttccccagagtttactgcctttttttttttttcagttgttcgtttgtttggttttgttttttgagacggagtctcacattgtcacccaggttggagtgcagtggcacgatcctgtctcactgcaacctctgcctcccaagttcaagcgatactcttgcctcagcctccaagtagctgggattacaggcacacaccaccatgcccagtgaatttttgtattttcagtagagatggggttttgccatgttggccatgctggtctccaactcctgacctcaagtgatccacccgccttggcctcccaaagtgctggtattataggcctgagccaccatgcccggcctcaaatgggatttcaggcatgcgccaccacacccagctaatttttgtgtttttagtagagatgggatttcaccatgttggccaggctggtcttgaaatcctgacctcaagtgatccctgtccctgcctccccgcccccagcctcccaaaatgctaggattacggacatgagccagtcactgtgcccagccatgattcttcatatgttcagttattttggatacttttggattcttcttttattcttcttcatttttcagttgttttggatacttcgagtactgcgacattctaggttttgtttaaatcctgtggagaatattgatttgttattttgttttgttatagcagacagttaactcagtttaggccacaagatccaacccaccttctatgggctttggttctaatatgatgttagttttcaaagccttgctggtgctatttgggtcatttctggctatgtgccacacaggggtcaaccaggcacttgggtggtggtctaccttatagtttagttctcaaagcctttgtgctgttgggatcagatccatatgtcacagcttgggggtgagcccaggagttcatacacaactttatcagatgtattactccagttcgttcccttctgagtttccttgatactgtcttagtctcccatctcccacttcctggtcctgagcctggaaagcttgaggctcctgcctttccctcagttgaatctgtctcaggggccacaaggtaggagaaggaatcgcaaaaaaacaaacaaaacaaaaaaacccccaaagcaacacaggttctttctccataccactctactccctcccctccccaaagcacttaagttagaccacagttttctggtcagagaggattttcttctccgtaagtacagctggtccatagctgccttaagtgtgcacagcttccaggcttggttttgtctggttgcaatggcaagagagagggtggaaataatggatttctcccactctgtattcctcacactcccaaccttatcgccccccatatacacacacataccttataccagaaagagaaatctcctcttggagctttatctcttcatggctggtatacatttctagaaattgggctgcctttgtatccagactggaagattgggagaaaacaagcaaaagtaagaaagagcaccagatagattgtgcttcaagttctagttcccttctcaaatctatctgctaccatttacttttcagagtcctcagataggtttttttttttaatgtattttgagatggaatcttgctctgttgcccaggctggagtgcaatggagcgatctcagctcactgcagcctccgcctcctgggttcaaatgattgtcctgcctcagcctccaaagtagctaggatcacaggtgctcaccactttgccaccactcccggctcatttctgtatttttagtagaggtagggtttcactatgttggccaggctggtcttgaaattatgacctcaagtaatcttcccaccttggcctcccaaagtactgggattacacgtgtgagccacgcgcccagcctggggcatgcattctgtccagggttttagttgtattcagtggaaggaacaggtaatggtattcagtggaaggaacaggtaatgtcacgtttcatggaccgtgggtgatggtagcaaacattgaatgctttccctgtaccaagcactgttcaaaatgctgtatgtgttttaattcattttacttttaaacagctctgtgaggtagagactgtggttatctccattttatatttgggcaaagtaaggcattacaaagttaaggaatgtgtaagaagggcacactgataggcaagaggtaacgtcagagttgttacctagtgtgactgtctccagggtccgttataaccaccagaataacactgcctgtatatcattgttttaacatttattacctgaaaaaatgaacagggtctcttagagtaattcgagagccactgaaactctttatgttataccgaaatggttgtttatcagttatgtgactactgttttagtaggctttataaatgacatttaaaatttcattttattagtcccttgattctgtcttactttaataggtcttgataaagattaggctttttaaattttaatgaatatgaaattcattctgttgtttatggcttacaaatttgtagtatatgctgaagtcttcctccgtaagggatttatttgtttttctaaaactgaaggacagcaatgcatggtggctcatgcctgtaaccccagcactttgggaggccaaggttggaggatcacttgagcgcaggagttcgagaccagcctgggcaacatggcaaaaccctacatgcgggcatgcaccaccacgcctggctcaaattttgtatttttggtacaaaatacaaaagtgagccagacgtggtagtgtgtgcctgtagtcccagttacttgggaggctgaggagggaggatcccccgagcccgggaggttgaggctgcggtgagccacgatcgcatcagtgtactccagcttgggtgacagagtgactctgtctcaaaaaaaaaaaaaaaaaaaaaaatgccaggtgcggtggctcatgcctgtaatcccagcactttgggaggccgaggtgggtggatcacctgaggttgggagttcaagaccagcctgaccaatatggagaaaccctgtctctactgaaaatacaaaattagctgggtgtggtggtgcatgcctgtaattccagctacttgggaggctgaggcaggagaatcccttgaacctgggaggtggagtttggggtgagctgagatcgcgccattgcactctagcctgggcaacaagaatgaaactccgtctcaaaaaaaaaaaaaaaaaaaaaaagagaaaaagaaaaaagactgaaggatttttgttacatacatatcttactaagatcatttgggtagctctagaaatccccctttttaagttcagtaatagaaacctagaaatagatttagaaagaaacttttttacagtttttttttatgaacaagcagcatttgtactcatagaagggcacacaatgacaagtctttttctcattttagttcccaaaatacccagttttcccaagaaagaagaaaataaacttctaaataaagttattttcttaattttaaaaagtttttatgttagaaacgcaaacattcaaaaagtagtacagatgtttagagaccaaccaggacaatagtatcaaggcctgaaaatgtgactggtatactaataacctcaacactcatgctccctacttaagaaccccacacagcctgcatgtgaacggtaatcatctttttatataaaaatgcaggtgtttattaaggattatggccgacctttgattttcatgggaaatatatccagataactttagtgacttcacaagttgacaaaaagtgttatttgcttgagctctctagcactaagatttcttttagtgtccctttttatgttgctgttggctcatcaatgtttctgaatatttgagtgaaactgctggttggttgacaagggatactcactagcaaactaatcacagacaagcaagttgaatttttattcagcagttttttggatatggatttagtagcaccgttattagaatgctgttaatgaaaggtagagtgatcatatgaaataatctttagagaccttttaaaatgactatttttcaggagtagaggtaagcaagaatgagttttcaggctcctaattgaaattgtggtttggagaacattttaatcctctagggttgtctttgtaaaggaagttgctgcagagtagctccctttgtattaacaggcagtagagttagttgtttcaagtgagttagaattttagaattggaacgacagcatgtaattagttggagagttcctatgccattacgctttataaaaagttatctagatgtgatatgaccagttgatcccctgtaataaaaacaattaattttctagagaatttttatctgctgtattcaattttcatagcataatgctgaagaaaatgtaatgagtttttcactgagtttcgttgttcccattcaaaaagaactatttaaaaatccatgttgctactatttgggatgttatagatcctgacaggataaataaaacttgccactagtgtttttttgagacagagtctggctttgtcccccaggtgtctgtcctccagggtagagtgcagtggcaccatctcagctcactctaacctctgccttccaggctcaagccatcttcccacctcagccttccaagtagcttgggaccgcaggcatgccccatcacacctggcaaatgtttgtattttttgtagagatggggtcttgctttgttatccaggctggtttcaagcaatccacccactttggcctcccacggccggggattacaggggtgaggcactgtaccagcctttaccactagttatcttgaaaaaataaatgattcagcccctgtcccataaggcaaatctgattgtttgccagattaccataaactcagcaacatcaaaaaaagacaaaacaaaaacccagcaatattaacactgaaacttgcagtcttgccttaaggtgtggtcctcagtctgaagtgtatcaagagccccactgacatcagagaggcaatgtttgagtggtttgcaaaaaacagcacagcagttaagagttaaatatttcatcttaagggtttgagtgggtctgtttgtttgcctcatctaaaggctagctgttcgggagcaggaaagaagaaaagaagcaaagccagcagtaaacacttgaggtttgagctagtataggcacttaggagaagtggcagtaaggagaaaggagacaacacctctgcattctgattgagtaagagggtttagagttctctgtatctaatataatcaaaagtgacatagctaggactgaaatttagatttcttgactcattttcaagtagcacagtgggtaggcactctgcagaaacattcctattgttatgtgttgatttaagttagtccttaggggcttaaatgtcactacttcaagaaaggccttcttggatactcaatcacctcatacagtctcctctgttttgcatagcatatatttattgggtgatatttgtatgtttgtttcctagtttctcttctttttattgttgaattactgactgatggctaagtgagtacatagaggcagagacaagtagctttaagggtttataagaccgcaggaaaaagtgaacagcaataggtgtttgtaaatcagtttgctatagattcgttatctgtgtatgctgtcaaggcacacaaaatgcatctgtgtaaatcagctgctcatcactggactggatcatttgtgtagcagtcttttacaattggcctgtctgccttagaataactagagccagagttcataaatgcatagtatgagagctatagccacttcttcatctatgcagatgccacagatgaaagagaatgtcactcattgacctcaggttggagccacagtcagtccatttggattagtaagctagatgaaatgttggcatgcaggccacagtctacgcagggtgcctgttcttagaagaatctagggttgcctttatctttctggctagtgtttttggaagagttagatttgtttgagtctgtattgttgtacattgtgtcagttttgaaatgataatcttggaatgttatgactttgtagaaggttttatttgatttgcttcagaaaaataatttctgagttttttgtttatctgggatgttggcccatggggagaatttgggccatcaggtaaaagaagccttaattaattatatcactaaggaattttgaagtattagtttaaaatttttgcacgctacttaattcactgtgataattacagaagagcactttctttagaaacaaaaataaatccattgaagttttgagaaactttattctttagtaataagacttaactgcccaaatgaatcttttatttttactatggattcagtggaacatgggcgggtctgttccatgggtatattttgtgatgctgaggtttgggcttctactgatcttgtcacccaaatagtgagcacagtacccaatagatagtttttcagtccttactctctccccactttttggagtctcccatgtttgttgggcctatctttatgtctgtgtgtactcagtgtttagctcccacttttttttttttttttttgagacggagtcttgctgtgtcacccaggctggagtgcagtggcgtgatttcagctcactgcaacctccgcttccctggttgaagtgattctcctacctccacctctgaagtagctgtgactacaggtgtgtgccaccacacccagctaattttttatttttagtaaagacaaggtttcgctatgttggccaggctggtctcgaactcttgacctcaggtgatccgcccgcctcagcctcgaaaagtgctgtgattacaggtgtgagccaccacgcctgaccagctcccacttataagtaagaatatgcagtttttggttttctgcttctgtattaatatcgctgaatcttttaacatgtactttttaactaaaatcctttgggaaggaattatgtctgtggttggaagtaaatccaaatttgcatataaaacagatcaaattattgatctttgcaaaattatttaaggattgtccatagtgttctgaaattgggagaaaatgaacattgtatatatgattcttgaaatgttactgtagtgaatgattatgaacatattttctagcactttaaaaagactgctgctgggtgccatggctcatgcctgtaaccccagcactttggggaggccgaggtgggtggatcacctgaggtcaggagttcaagaccagcctggccaacatggcgaaaccccgtctctactaaaaatacaaaaattagctctgcatggtggcacgcgcgtgtaatcccagctactcgggaggctgaggcaggagaattgcttgaacccgggaggcagaggttgcagtgagccgagatcgtgccattgcacttcatcctgggcgacaggagcaaaactccgtcttgggagaaaaaaagagagagtgctgtaaagggaatatcatatttgaatatcatgtatgtgtttgcaataaatattgtaaagaagaggaagataaagaatagaatattattatactttgtccctcggtagatgcgggggattggttccaggaccccctctgtatatcaaaatctgtacgtattcaagtcccgcagtcggccctgcacatatgaaaagttgttccccaccccctatatattaggtgtttgaattccatgaatactgtatttttgatctgcatttgtttggaaaaaatccatgtgtaagtggacccatatgcacttcaaacctgtgtagttcaagggttaactttagttataactcttctactttttcctgaactaattgtcagaattctttatgattgattctgttcatgaattttactattattattactgtagtaggtaataggtggtagtggcatgactgatttgtcttctgttttgagatgcacttgatataataaagaatgaggtagtatttgattatttctatttaaaatttgttttatttggaaattatttaaaatttatagaaaagttgcagaaataaatgcattgcaaacagcactcatacccctttctaggatcaaactgtggttaacattttacctcatttgctttctgatgtgtatttgtatcaccttacagcattcaattttctgaaacatcggagggtgaggcccttgttttctaagtatgtagtttctaagattagggatgttcttttacatgagtatagttaagttaccaactttagtacatttaaaagttgatacatcatagattttacctattccatttttgtcagttgacccaataatatcatttgttgccatttttgtccttcagtactggatccaactaggatcaggtaccttttggatgcagtctaggatcatgtactgcttttaattgtcatgtctctttagcctctgttagtctgaaacatttctacagcttttctttttctggcattgacatttttgaaaaattcacacataacccttcttttaaatagagtgttcctcgttttgggtttgtctgatgattagattctgttatatattctcagctggaatactacataggggatattgtgtccttctaatggtatggtgtctgtaggcacatgatgttaatctgagcatcattgagatactaattttaatcacacaaagtgttgcctgatttctccattgtataatactagttttccccatcttgcagctaatgatcagtttgtggggatacactttcagactgtgaaacttcttgctcttcatcaaaatttccccctagacgagtatcttattaccttccttttaagtactttgctagcaaaaaaaaaattgtttgtaattctttttcttactaatgtaaattgaaataaaaaattctacttactacagaaatacagaaagcataatactaatttgaaaaatgagtattggtaattatagtgacttcatataggaattaaaagttcttagaaggaaaaatgactaatttgggtatttagttggtcatatcctctcgtttgcccagtgtgtgaattttggaattaaacaattgagtcctagtgtgttttgttttaaaaagaaagaaaagaccactctgtttagcatgtgaaaagtagcttcttctgtactgtaccaaaggaaaaaatctagtatgaggctttgtcatgctccatatttcattctgtcttcacaaagtggcttgataactacacccttaaaaaatgattcttagaggaaaaaaaccatgagacatttgttaaagtaggtatttttctatttgtcttttcaagtttattgtattgtattggaccgctgctatagatggacaggtcaagcaaagagaaacttcatttcccatgctgttgttaatagcttgctttctgcatgtcttcatttaaaagaacaattgtgaaatctaacctaatccatttagtactactctactttgaaagcactagaacatatgaagaggatttcactgtgttctttccagtgtcagatatcactgtttacaagtagtcagtgcacagtacatctctggtatattaacctgtttacaaagaatagttgcacccgccccctcacccgtttctattgtcttaagatatcttttttttttttttttgagacggagtcttgctttatcaccagactggagtgcagtggcgtgatcttggctcgctgcaacctccgcttcccgggttcaagcaattctcctgcctcagcctcccaagtagttgggattacaggcacgcgccaccacccccagctaatttttgtatttttagtacagacggggtttcactatgttggcccaggtggtcttgatttcttgacctcgtgatccacccacctcggcctcccaaagtgctgggagtacaggtgtgagctgctgcgcctggctggtatctttcgtttttttttttttttttttggtaatgctctgtggcccaggctggagtgcagtggtgccatctcagctcactgcaacctccgcctcctgggttcaagcgattgcatcagcttccggagtagctgggactacaggcaagccccaccatgcctggctaattttttatattttagtagaggcagggtttcaccatgttgcccagactggtcttgaactcctgagctcaggcaatccacctgccttggcctcccaaagtgctgggattacaggtgtgagccaccgcgcccagctgtcttaagatatctttagtaaagtgtcctttcattactggaggttcaccgcctcatgtcttcagtcttcctgctgttaactttggttgctgtctgtacgttcttcaccattttccatttgtctcatttctgagatctctagtagaaaatgtaggtaagtgctgcaaagtggagtgttggcactgatagaactttctaggacaaggtctgctttagcctttggtatgctaatgaatttgggaaaagccacatttttctgctgttgtagcattcatctccttgcttacctgtattttaaatgaacggcctatgaatagaacataaaaccataaacgttagggctggaagtgactggagatactcttccaatttcctttttctagataaggaagctgaatcccaaggtcacatgacttgcatctagttagtaagtagcataattgttaataagattccctgactttgagaataatcttcttttcaccatcttattttgcttcagatttattttgttcaaccaagttccaggtacactgccttgcaactttggcttataggagggtaagcattatgacagtgacagctccatctgccatcacagaatcacagcgagtgccacgtgtgatcatggcatttaagaaggcaggcatgaaagcatacagtagtccctcttatccatggttttgctttccagtttcagttacctatgatcaacctctgaaataataatgactctaaagcagaagagtactgtgcctaatttataaattaagctttatcataggtatgtatgtattgggaaaaacatagtgtacatagggttaggttctatctgtgatgtcaggcatccactggggttcttggaacgtatcccccaaggataaggagggactacttacttttatttttctactctttcccccccaagtcagattaactcataattatccagatcttaagaacaatgtgactttaggcaagtgacttaagctgactttgccttgtttttctcatctgagaaatgaagataatgctactcatttcattgggttgttataaggattaaactatgctgatgaatgttaagtgcttagtattacgtgtttgttaaatttgttaaaataagtagaatgatatactactaagtagtattttctaaacatctgtttcccaaacctgtagtcttaattaagcagcttcttgacagctcagacataaattctcaggtatctagtgcccagttgccaactgagtggttatagttgttcaacacaagctttgaaaagtgatgattaagattggacactaggaaagaagtagaaaatacttccaggtccataaagtaattattgcacaaaattcatgcatcaaagttaagcactttattggcagaagagttccagcattttcctccttcatggcctatgttttttttgagacatgctctcactctattgtctaggctggagtacagtggcacaatcttgtcttaaagtcatatcgttcttaagatctcaacctccacctcccaggctcaagcaatcctcccacctcagcctccctagtagctgggactacaggtgcatataaccatgcctggctaatttttgtatttgtagagagaaggttttgccgtgtcacccaggctagtcttgaactcctgggccgcagcaacctgcctgtctcagcctcccaaagtgctggaattacaagcttgagccactatgcctggccctaataactcttagtttgttcaacaaatatttattgaatatcttgctctactcaagaattttggagtaaaaactcaaggacttgattagctaattttcggtttttgcatgttagcagtagcagctgagttacaggaaagttgttagggttggccaaggtaaagaaaagagataaatgaacccctgagaaagctcgggggtaccccagtatactgcagccccctacattattttattatgaagtgctgtagttgatgttcataatcataaaactttacctccaatagggagggcccttgagtgttatctaatttagttttcttgttttgcaatagataaactgacccagaaacattgagaacacattaaatcatgttctataggttgtttgtgggaagttagccaagtgtatattgccttttagaaagctttccatgcaagctagttgtaaagtttggtacctaaaaattttagctactatttttcctgcctcttcattatgtaaaacacttaatgatatgaaataaatgagcattatctcacgtagatctctcctcagagattaaagcctatcacaataaatataattacaatgaaaatatttaagaaaaatataatcacgatttagccatgtgaccttgggactctactacctgttctatgaaatgataatgataattgtccctccctgtatgatgactagttttttaaaaattttggtaaaatacataaaacacaaagtatcatcttagtcatttttaagtgtgcaattcagtagtgttaagtacattcacattgtgtaaccatcaccactgtccacttctagaaatttgttatcttttcaaactgaaactccatacccattaagcaaattaatatcttctgtctttatgaatttgactattttaggtacctcataaagtgaaatacagtgtttgtgtgtgtgtgtgtgtgtgtgtgtgtgtgtgtgtgtgagtgtgtgagacttctggctcatttcatttagcaaaatgtcttcatttcttttgagtgtatattcagaagttgaattgctggatcatatgataattctatttttaggtttttcaggaactgctataccatttttcatagcagctataccattttgccttcctgccagcagtatacaagagttcctatttctctgcattctttccagtgctttctgttttttttcttttcctcttaatagtagccatcctactggatgttaggtggtatctctttgtgggtttgatttgcatttccctaatgattagtgagtcgaacgtcttttcatgagttcattggccatttatcttttatcatggcttacttttgatataactagtttagatagaatgactagattttcacatataatcacatatgtgaaagtcctgagaattataatgtcttatataagtgaaagtagtgactatggctgtgttaacattttttctgaagttaataaaactccactgaacagttaaaagaggcacaattcgagttctgtataggaagttatttgtacagttggaattcgttgtgctcaagatttaagacaattttggaatacatgtgtatgtggctagcataaggccatagcagacaatactcatgacattgagataagtaaccaaaaagagaacaaaattgattacataaaaggaaaaacttctgtatgacaaaatattttataagccttattaaaagacagacttggaaatgctgtttagcagtgaattttaatagttactgtcagaataatttaaatgctgaaagttttatttctgatctcatctactttgtggaaatgtacatctaggtgaacacatttaaaaattttcgtatgtatttgtcatataaaattcttttagcataaggaaatatgtaaaaaattacattagtttcaaaaatatcttttttagatggaagaatatatctttgttgggacaaaataatgcatctcttcaagaattatggccataaggaacatgttcttaaagtagattgttaccaatggtaaaaaaatatttactaaaatggttacaaatgcaatgttgatattagaagtttatgcagtgtcattataagtgagtagcctaacttcaaatgttttattttgttcagtcaggtcaattcagtgaagatatgatacccacagtgggcttcaacatgaggaaggtaactaaaggtaacgtcacaataaaggtaagttatttcttgccgtacgcaatttaaattgttagcacagacccctagaaatttttctgttaaatttctgtgtttttactgaaaatttgcagtttttcagtaatgaatgtgcatgtttcaaaagaataggtttttttgttgttgtttttttgttttttttttggaaacagagttttgctctttcacccaggctggagtgcagtgtcgcgatctccactcactgcaacctctacctcccggttcaagtgattctcctgcctcagcctccaaaatagctaagatgacaggcttgtgccaccacacccagctaattttttgtacttttagtagagacagggtttcaccatgttggttaggctcgtctcaactcctaacctcaaatgatctgcctgctacggcctccccaaagtgctgggattccaggcgtgagccaccacgcctggccaagaatagatttttaatctattttgtttttcaaaaatcaaatctatggcctgagccttaatgtccattttgcccaattattgtggtttacagaagctgttcactttctctgtggctcatctaatgaagttccagatttagtcaagtgcaggtttctttatgcttgttaccagtgctttagttaaaccggaagcctcttgaagattaatactgtgacttgagactttaatgtagcccagtgtctagtgtgatgccctacggagtagacacaataataaaatgattatggatgtggctttcatgtgcataaaataattttattttattttatttttttgagatggagtttcactcttgttgcccaggcttggagtgcaatggtgtgatctcggctcactgcaacctccgactcccaggttcaagtggttctcctgcctcagcctcccgagtatattacaggcacctgccaccacacctggctaattttttgtatttttagtagagatgaggtttcactgtgttggccaggctggtctcgaactcctgaccccaagtgatccacccgcctcggcctcccaaagtgctgggattataggtgtgagccaccatgcctgaccaaaataattttatacaagaaaaacacctatgtggaaatgttggctacttatttacaggataatttcaaaaggttaggcattaatgtagaacaaatcagacgattaagacttaatagattctgaattgttgttttctgtcttggcattcaaatctggatggtgcatggtcctgtagcttttaaattgttatcataaagacatatgttttcaataatagaagtatattagttaacaggcaaactattgcacataaaccaaatctttgcttaagcaaaattttagatgtattgtaaatgtattaaatacggacttcaagtttagaagtggccccaagaattcccatattaagagcttgtttgaggtcaagtctttcaggagcactttgcctctaacattgtagaaataaatatatcttcccgatctttctttttttctgttacttcctcttgcaatcatttaattaaaatatctttattaagaattgccttgttttgatttaaagatctgggacataggaggacaaccccgatttcgaagcatgtgggagcggtattgcagaggagtcaatgctattgtgtaagtggtttttttttgtttgtttgcttttaaatcaatgtaggcatcaaagaagaaagtttattttagtatttccagaggctcaatttttatctcaggcagtgaaaatctttcttagctaatatcctagtgtaattcccaacatgggatttaaaaaaaattaatcatagaataagatctttatgttttttgtttatggagctaagagctaaggggtgtacatgttttactatcatgtattagtctctaaaaacagtctagttaaaaagtattaaagggtgctgagccttttcttatgacatagtttattttggttaataatttcaataatgtaaatcttacaaaaattaaaaatcaataatactagttgtcatcatcaaggcatacagagaaggtatgttgagatcacttcatttttttaagttacatgatagatgctgcagatcgtgaaaagatagaagcttcccgaaatgagctacataatcttctagataaaccacagttacaaggaattccagtaagtatggaatacttgttattttacattgtaattatataatgatattaattatggtaattatgcagtgatattaattatgtttgaaatcagtaacatgtcttcatttttaaaatctggaaaacttgcttaccatgtatctgccatatactgggcattgtgctaaatatgaatctcataaccacgtatctactaaactactatgcagcaggagcagtgcgtaggcccagggatatagtgatgaatggaaatcagtagaaacatactccttgccatcatggaccttatggtttagtgggaaaggtagatactctgaaaacacttgaataatgcagctttaagtgctaggaagaaaggtgcaaggggatatgagagttgtaatttagaggggagatgtgatctagtttgagggaagaaggagggattcacgaggaagtaatggttgagctgagatccaagggatacatacaaatgtgaggtatatgacagttggaggggaagagagttccaggcaaaggcctttgggtgggaggaagtgggaaactgagaagaggccagtctctagaatacatttaggaatttgcatttggattaggaatgctcaaccagtaagtatataatgcaaatccaaaaaatttccaaaattcgaaacacttctggtcccaggtattttggataagggatagtaaacctgtactaagaatagcagaatgccgccgggcgcggtggctcatgcctgtaatcccagcactttgggaggccgagatgggcggatcaccaggtcaggagatcgagaccatcctggctaacgcggtgaaaccccgtctctactacaaaaaatcagctgggcgtggtggtgggcgcctgtagtcccagctacggcaggagaatggcgtgaacccgggaggcagagcttgcagtgagcccagtggctgctgcactccagcctgggtgacagagcgagactctgtctcaaacaaacaaacaaacaaacaaacaaacaaaaagaatagcagaatgtgtatcatagactcagactattttacatagcagttggcagccacatactgaattaagagcacctgcatggtgggagttgagtgaatacaagtgtgagcaatgaaatgaatgagacaagccaccagttacacaaataggccttaacattgtggaatgtgttaacatcttaactttgtgtcttcacatatcaagatgataaacttctgtgactttttcttgcataaacgtgtgctcttaatatcttttctttttaaaggtgctagtgcttggaaacaagagagatcttcctaatgccttggatgagaaacagctaattgaaaaaatgtatgtcttgaatatgctattttaataatttgcttctaaattaccatattttgcccacttgttatgttattcctaatgatcatagccattttttttaggtagataaaagttggcctatcagagaagtgaatcctaacattttaggattgctacgatgatttcttcagtatagtaataaaactaatgagtaaaattgaacaaagtgataagtatgacagctgttctaagcacagacttatccttttaattcttctcataggaatctgtctgctattcaggatagagaaatttgctgctattcaatttcttgcaaagaaaaggataatataggtaagaaatgactggtaattttggaagaaatgggtatcattggaaggaatgtctatgcttcttacagcttattgtctcgatttctcattaagtgacttccttttcagaatactgttgcttttgcctgagaaaaaagaatagacataccttttgacaacaaatatagtgaaccttcacttaacatcattgatggcttctttgaaattgcaatgttatctctctctctctcatacaaatatatatataatataatatatgtaatatgtattatatattatatgtaatatatatgtaatatgtattatatattatatgtaatatatatgtaatatataatatatataaatatatattatatataacataaatatatatatataaataatattatatgtatatgtattttttgagacagtgtcactccttcacccaggcttgagtgcagtggcgtgatctcgacttactgcaacctctgcctcctgggttaaagcgattcttgtgcctcagcctcctgagtagctgggactacagacgtgcaccaccacgcccggctaatttttgtattttcagtagcgacagggtttccatgttgcccaagctggtcttgaactcctgacctcaaatgatccaactgcctcggccccccaaagtgttgggattacaggtgtgagcccggcctatatgttatcaaactcttgaacagcaaaaaattttttaaaaagaggaaattgcacttttaagcgaaatgacatacagtaggccctcatttcgttcagcgttacaatgttaatgagaaaaaaatagttttgttatacaccatttcacttaaagtggcagtttccaagaacctatcagtgatgttaagtgaggactgaatgtataacatcctgaatcttctttgtgctatttaaagaagaaaatgcaataaagtcgtgaggttaagattatgtgataccaatttattgtgttaatttttgcagagctagtatcccgctgtgctttataacaaaatggcatttttgaaataagactttacaaaaattagtctacaggcactacaacaatttttcagttattgaaccagtatattactgcaatatgttagcactctattggaattatatgcccaaaatacccttcatttactcaatgcccatattaacttcttagaactgccataacaaagtaccacaaacaaggtggcttagaacagcagaaacttaagtcattcaaaattctagaggctggaagtccaaaatcaagttgtcagcagggtcgtgttctctctgaaggctgtagaagatccctccttgcctctctctagcttgtggtggttgccagcaatccttggcattccttcacttgtagatataccactccagtctctgcctcacattcatgcttctcccctgtagttgtctctgtgtcagtgtattatgttttcctaaggacgcaagtcactggattaggtagggcccacctaatccagtatgaccttatcttaactaataacttgcagagaccctatttccagtaaaagtcacattctgaggttctggatggacatgactttttagggggacattaaacattctagcatagtatggttacagaataagtatgtatggctcaactttagtttcttaactaatttggtttgagatgatttgataaatgaatgtattggaacaaaatgtaataaatagtaccagaatagtatatctataaagtttatgctgatattttttctttagcttttgtattccagtctatccttccctaactcaccttccaccccgcctgcaaacatggctttatttatttttatttttttaagatggagtctcactctgtcgccgtggctggagtgcagtggcaagatcttagctcacagcaacctccacttcccgggttcaagtgattcttgtgcctcagcctcctgagtagctgggattacagttgcccactaccacgcctggctaatttttgtatttttagtagagacagggtttcatcatgttggccatgctggtcttgaactcctgacctcaggtgatgcacctgcctcagcctcccaaagtgcttagattgacaggcatgagccaccacgcccagccacaaatatgctttattcagtttaaagtgtggatagtcgttctggctaattttgggcttcctttaaagaccatccagggcagtctcagccttagtaacagcggatagacacaaattttcctttataaatggatagaataattcacttgttacattgggagcatttatttgagaacagactcctcaagcacttgtggttacttagactttatttaaaagttttttctctatgtggcggggaaaactctttttaaaatttaagatatgccccatgagagcatttatttctacatcagtggttctcaatggggagcttttcccccaggagacttgacaatgtctggagacatttttggttgtcataactaggagggtgatgctggcatttagtgggtagataccagaaatgtagctaaacatactataacctccacagcaaagaattatccagcataaaatgtcagttgtggcaaggttgagaaatcctgttctacactaaccgtaatttttagtccattgtgctattttgtaaatccattactccctacatgttttctgtttttccattgttacaaactagttggatacttcctgaaaaaaaaacaaaatctcttgggctcatatatggaagtgcagtagagctgtgaggacttctttcgctatttgaggctgatctttatagttggctaaatagctcagtagtaattttagaactcctggctcacttaaaaggttgtcaagcccaaggaatctgatccagtctaataagatccactctaataaaattcgaaataagtattttgtagatcagttcatctgagtatcttatttctgttgtctttttgcctattcataaagatccatttgtctttaggatatgaacttctatcagtatccacagaggctttgtgtaattttttagtgaatttctttttttttttttttgagatggagtttcactcttgtggcccagctggagtgcagtggcgcaattttggctcactgcaacctccgcctcctgggttcaagtgatctcctgcctcagcctcccgagtagctgggattacaggcgcccgctgccgtgctcggctaatttttgtatttttagtagagatggggtttcaccatgttggccaggctggtctcaaactgctgacctcaggtgatcacctgcctcggcctcccaaagtgtgggattacaggtgtgagccaccgtgcccggccatgaatttcttaaatatttaaatttggttatttcacttcagatttacctttctcccattcagttccaatgagtgtggctttgctcgtattgtgcactgttgtccccattttaaggtgcagaggtgcttcttcagtagttgggttaaatcattgcttccacaatggtgaacagttcatgtttgttatagctcagccctgtggtgtttcgttaatgcatgttagctgggaaactggtagtgaatttaccctcatctttcaggcttggagaatagagtggtgcttctgatagactctcatgtacccttctgaagaagtgaggacaagaattacccagccccagatgtcaaaagggcatggtgtgaaccctgcaccagccttggcagtgacagcctcctctcccatccctgtgctttagtcacattgtatcactcacaatccatccagagctccacaatgtttcatgccttttaacattcttttgctgttttttttttttaacctggagttctgtggggtggcccccaagccccgggaattactgcatcttttctgtgtattatacttaaaagcgccttgagggcaaacaggggttattcctttttttttttttttttttttgccttcctggcaatttgcatgcaacacctgattgattgtgtgggcaacacataaaaggtggcaccagccgtcctatacacaacttaatttttaaatcagaaaacgcttcagtctctgataattcctcatattctcttgaagttcgggtaatggagtatggtaatgcagatgcagaaaagcagcagaggtcaggcatagtgtgtgccttgaattagctgccttttaaatattgtctctgtttgatgtttagttttttaactttaatgtcttcacttttcccctctatctttagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatcca

SEQ ID NO: 552 - DNA, 17932 bp, Homo sapiens
cagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagtgagcatcctgagggcagcgggaaaaaggctgggatggaggccggacagggaccccaccaggagagttaagtgtcaggacgggacaacgtcgctgtctcagactgaaggggagggtgccgctaacggtctatgccgggagaccttgggaggcagtcggatgctttccctttcctggtcctgtacctctggaatgagcatggcaggcgctcaccccctgccatggtcagagcatggagtcagttatttccaaccttattttggccccatgtggggacgatcattcctgggccctggggacaggtggacccttattagtctcttgttggattcttttatatctcatctggtttccctagaacctagtcgttttttgcattcacttcagtcttttggtagcttgttattatgtagaaagatgcgacacaagtgggaattctcaaaacccaaagggcttctagtgacgacatagactgggaggctaatgttactgcttctaaaattaataggctctgaaatccctaatcaaagcactttttttttctttttttttttgcttgggggtgggatcgttgttcttttttacagttgaattcatcgagagatttgctatatcacacttgtcatttatgtgagactagggttcctctacattgctttcttgcttctgtcctttcatgctattagtggaagtgggttttctgtctatattaaaagacaggatgaatttgttagcactagttttgcagcagcctgcttttgaaatgtctaggcacgcgtatgttgttttaaatctttccacccttacttggaggtgaaactgtaaactgaaagcaaataattaggaagtatttcctttggtgggttcgtacaccagcaaatggtatctgaaaatcagacaacttaaatgtagacatttaaatccaaatctgatttacatatttgttcagatcatctaagtgcccttgagtggttattcaacctcagattaataaatagtgacaaatttacaaccagtattttactgctgtctgtcattaagaatctggcattagggcattcgttagagtttaccctaattaatgatgttttaatgataaagttctcattaagctttaggaataagccttaattgaccatttggccactcttctgtatacagttcttttaaaaagcatttaatttctgtttaaaaatagtatattagaaacaaagtaggaaaacaacccttaatgtttcattgtatctttctttttatttttttgagacaaggtctttttctgttactcagcctggagtgcagtggcgagatcatagttcatggcagcttcgaacttctgtactcaagtgatcctcctgtctcagcctcctcagtagataggactacaggcggacaccatcatgtccagctaattttttaattttttgtagagacagggtcttgctatgttgcccagtgtggtctcaaactcctggcctcaagtgatatttctgcctcagcctgtcacatttttgggattataggcgtgagccacggtgcctaccatttttccagcttcttttggaatcatatgacttaggtttttactagtaaaatacaacatgtagtagtttgtatcctgcctttttcacttaatatttttgaacagcttttgataccatttcatgttctttatttgtatgtagaaaggttgatggagaatttccaggcgcggtggctcatacctgtaatcttactttgggaggctgaggtggaaggatcgcttgagcccaggagtttcagaccagctggggcaacatagtgggaccccatttctacaaaaaataaataattagccaggagtggtggtgtgcacctgtagtccaagctactcaggaggctgaggtgggaggatcacttgagccgaggcggttgaggctgtagtgagctgtgatcatgccattgcgttccagcctgggctacagagcaaaaccccgtctctcaggaaaaaaagaaacattgatggagaattaatatgaggagtttatggtgataatcttattggaaaaggggtaggtaatttgtattgtagctgttttgcataactagcacacagttttgacttacatttgtgcttattggaggtggcttaggacttagttaatggagataaagggaattgggcctgaagactcctcatgccatttcttgctatcatcacaatgtatataagccataatttatttaaccagtcctctgtttttggacaggtggttttcatgtgtttttgtttgtttgtttgtttacatagtaatattatattctatacttttttgcactttttattatagaaattttcaaacatttatagaatggcattctactgttttgtttcatgtcttttgtgtacctcattaatttttttctgaaatatttttaaatggttctaagcataataggattttacttgtaaaagcattattatgtatctccaaaaaataaggacttaaacaaaaaccacattaccattattgattcaacaaaataatcatgccttaatatcatctaacagtcccatttttatgtttcctcagttttctcaaaaatattttttatataattgttctttcaaatcaggatccaataaggcctacattttgtagagtacatttttaaggatgaattttaaattttgtattgcaaactttatgttatttttctcaagtaaaatatttaccttaggatgataaatatatttgctttttctttaattatttctgatattatttgtgttccactgtcatcagtttgtttttttctggatctgaaaaaatgttttgaaattggttgagtcagggctgggtacggtggctcatacctgtaatcctagcactttgggaggccgaggcaggcggatcaccagaggtcaggagttcgagaccagcctggccaacatggaaaaaccccatctctactaaaaatacaaaaaaaaaaaaaaaaaatcagccaggcatactggcggtagtctgtaatcccagctactagggaggctgaggcgggagaatcacttaaacccaggaggcggaggttgcagtgagcagagatcacctcactgcactccatcctgggtgacagagtgagactctgtctcaaaaaaaaaaaaaaaagaaagaaagaaattggttcagtcagggtcccattaagaagtagaagatgcactcaaattagagtaattcaaggataatttaatgaaggcatcaaacagtgtagtcatggtgttgggaaacagccagattgtgcagtaccctggagcttacatcctcaaggttattatcaccacctctaatcctgaaggaagaggagagtagaggttactggaaccttgaagggaagaaaggcctgcattgaaagacacaaaccagtcccttaacacagccagtcagaggtggcctgtcagtgagaggtctggggggaaaatagactaagctcattttctttccttcctccagtctgcaaagaggagaaaggtagagagtggatctagagggcaaatggaacatgtccaggccaggcataagttaacttttttacatttcaattctggcttagtgtgctctggagtgacactttttcatcttacttttttttttttttttgagacggagtctcgatctgtcacccaggctggagtgcaatggcacaatctcggctcattgcaacttccgcctcccaggttcaagtgattctcctgccccagcctcctgagtagctgggactacacgcgcatgccaccacacccagctaatttttgtatttttagtagagacagggtttcaccgtattagtcaggatggtctcgtcatcttgctttttagtaactgttgtggatatcatcagtatcagttattcctttaactatgaaagagcctatgaggatttaagaagcattattttaatatattattatgatatcgggaattctctgatacagttggtcattttagaaccatttgttttcctgaaacataaactttttttcccccctcagaatagtagtttctcatttttcaaacaaattaattttgatctgtgaaatgaaattatcagctcttgataggatggttttctaagtctaggaagtttagaagaaatcagtaaggaaaagatggatgtttttaactacataaacattttaagcttctagtaaccaaagtaaatgggaattatttatagcaaatagaacaaatggtacttaaataccttttattatttgttaaaaagaacagaaaaccggccaggcgcagtggctcacgcctgtaatcccagcactttgggaggccgaggcgggcggatcacgaggtcaggagattgagaccattctggctaacacggtgaaaccccgtctctactaaaaatacaaaaaattaaccgggcgtgatggagggcgcctgtagtcccagctactcgggagactgaggaaggagaatggcgtgaacgcaggaggcggagcttgcagtgagccgagatagggccactgcactccagcctgggcaacagagtgagactccgtctcaaaaaaaaaaaagaagaagaacagaaaaccaaaaattgcaagttaaaactagaacaaaatgcctttttttttttttgttggagatggagtttttgctctggttgcccaggctggacagctcactgcaacctctgcctcccgggttaaagcaattctcctatctcagtctcccgagtagctgggattacaggcatgcgccaccacgcctggctaattttgtatttttagtagagatggggtttctccatgttggtcaggctggtctctaactcccaacctcaggtgatctgtctgcctcggcctcccaaagtgctgggattacaggcggcagccaccacgcctggcctgccatttttaacagtaagaagttgttgggggtgactggcaaaattggaaccctaatattttaataataatgtatattcaatgaagacatggctttagaatgggaattgtgtttctgtcacctgtcatctctacccatagaaggaaaataattactttctatgtcaggcttctctgctaccctggagtggtcttgggtattttcagaacctattcagtgtaattatagacactgaaggccggcacagtggctcatgcctgtaatcccagcactttgggaggctgagacgggtggattacccgaggtcaggagttcgagaccagcctggccaacatggtgaaaccccgtctctactaaaaatacaaaaattagctgggcatgatggggcacgcctgtaatcccagctactcgggaggctgaggcaggagaatcgctcgaacccaggaggcggaagttgcagcgagctgagatcgtgccattgcactccaccctgagcgtcgcagcgagactccgtctcaaaagaaaaaagaaaagaaactgaagcataggacaactttcgccaaggttttgtttgtttgtttgcccgttgcttttaatgtcatttttcgggagagttgatttgggaattagcaagtaagaaaagactaagctgttgatcagtagtagctaaacatgattttcatttttccaggacagatgggagttttgtggttcatgatataccttctggatcttatgtagtggaagttgtatctccagcttacagatttgatcccgttcgagtggatatcacttcgaaaggaaaaatgaggtgagggcacctgatttaatttttgccaaaagctaggctactgaataccttagtatatattccttttagaattaatagtttagatggaaaattctttttatttaaactacagctattccttaaaacacttaaaatatcctcgtttatttaatctgaacattgaaaaaattgtaaagttgagcttcttgctctggcttaaaatttattttaaagctcctaatatgattacataaagaaaaggtaagattacttactataggagctaaagtgctatgaaagttataattgaaatatgattattaagttggaaataatttaacttttctaaattagaaatactattcatcacctgtttttcactgggatattttgataatacctcttattacctatttgatacttcattgatctggaaatttctgtggtcctttctttatggaatcttttatgttcaatggaaatatagtatttctagggaaaacaattgaggtgaaaagaactatagtctaatttagactgtgagtgtggaatagcaaaacctatttgaagttgaaacatttgtatagtatctatagtcttcagagtcagcttcccattataatagaacacatttatttatttattttgttgtctcatggcaatagcatcctctttggtcaaatctgaccaggaaatatatgaagcaactcctaagtggtaatgtctcttctttaagctatcaaatatgactatgttgcagtaataaagcacaggtcatgcaaaggcaaaaacaatttctggaggtggaggactaataaataattttactactgatctttttggtgtctgcgcagcatatttagactgacttgtagagactcaaaattgagctgacacatgttcagttagtaccatactatttacatttgagttagtgtttactcctaaaatttgtaatttgtttcttctttctttgctttctttgacattgaaagttttaaaaatgtaatatgtaaatatgccataattcaaatagaatgagtcacacatggagttgtcccatcctttatcttagctgcgtgttagtccattggtggatttgacatcatttatataaccggctcctattgatagacaagcagtgatttctttctcttcttttagcatgtatactaaacagagacagttatcaagagaatattctttttttttttgagacaaagtcttgctctgttgcccaagctagagtgcagtggcgcaatcttggctcattgcatcctctgcctcccaggttcaagggattctcgtacctcagcctcccaagtagttgggattacagctgcacgccaccatgcctgtctgattttttgtttgtttgtttgagatggagtctcgctctgtcacccaggctagaatgcagtggtgtgatttcggctcactgcaacctctgcctcctgggttcaagcaattcttctgcctcagcctcctaagtagctgggactacaggcacctaccaccaacgcccggctaatttttgtatttttagtagagacgggatttcaccatattggccaggctggtctcgaactcctgaccttgtgatctgcccgcctcccaaagtcctgggattacaggtgtgagccacggcacctggcttgatttttttatttttttgtagagatggggtttcgccatgttggccaggctggtctcaaactcctgacctcaagtgatctgcccactttggcctcccaaagtgctgggattacagatgtgagccactgcacctgtccaagagaatattcttgatattatcaggaaagtaatactctaatgccactaatatattcttaaaaacaaattacttttcccccctactttgtagagagacaaaatcttgctatgttgcctaggctggagtgtagtggtttttctcaggtgcaatcatagcccgctacagcctcaaattgacctttagtgatcttcccacctcagcctcctaagtagctgggattataggcatgactgtaccactgcactccagcctgggcaacaaagcaagatcctgtctcaaaaaaaaaaaaaaaaaaaatatatatatatatatatgtgtgtgtgtgtgtgtgtgtgtgtatacatatatgtgtatatgtaaagttcttttatattaaatctgtgccttaaaggacttattcatgactttttgtatattttagaattgtaagcttggaaatggaggggtacgtggatcacagtatatgttatatatactgctttaaacattttttttatattgaaaacacaatattggacggaatgagagctgctacacaaaagggaatacttgtatttttttttaatcctttttactctggttaaattttgaataaaatagtcttagcaaataggaatattgttttaaatatagacggtccccagcttacaatggttcaacttataattttttttttttttttaatttgagacagtctcgctctgtcaccaggctggagtgcagtggcgtgatctcggctcactgcaacctccgcctcccgggttcaagcgattcccctgcctcagcctcctgagtagctgggactacaggcatgcgccaccactcccaactaattttgcatttttaatagaggcagggtctcaccatgttggccaggatggtttcgatctcttgacatcatgatcctcctgcctcggcctcccaaagtactgggattacaggtgtgagccactgtgcccagccctcaacttagaattttttgactttaccatggtgcgaaagcgatacacagtagaaaccatactttaagtacccataacaaccattcttttttttatgcttagtacagaatttagtaagttacatgaattaaataagtttcttattataaagtgggctttgtattaggtgattttgccactgttggctaatgtaagtattctgagcacttttaaggtaggctaagctaggctatgttgttctgtgagttagctgtattaaatgcatttttgacttacagtatttttcaatctataatgggcttattggaatgtaaattgaggagcaactgtataaagttttcattgcctttttaccttgagtaaagagtacttcctgctttagcacttatgaactggttgcagcagtgggattcatgttctcagatacattcctgatgattggatgtctgaagcataggttaaattaaaaaaaagaaaaaattatttaaaaattattttaataattagggatggggctgggcacggtggctcacacctgtaatcccagcactttgggaggccgaggcaggtgaatcacgaggtcaggagttcaagaccagcctgaccaacatgatgaaccccatctctactaaaaatacaaaaattagctggacatggtggcgtgcgcctgtaattccagctactcaggaggctgaggcaggagaatcacttgaacccgggaggcaaaggttgcagtgagccgagattgcgccactacacttcagcctgggcttcagagcaatatttcgtctcaaaaaaataaaaaataattgggggtgtgacagagtagagaacaaagtgggattcatataagatcctaattctttgtgtgtgtgtgtgtgtgtgtgtgtgtgtgtgacggagtctcactctgtcacccaggctggattgcagtggtgcaccctcagctcactacaatctccacttcctgggttcgagtgattctcctgcctcagcctcccaagtagctgggattacaggcatgtgccaccatgcctggctaatttttgtatttttagtggagacaggttttaccatgttggccaggctggtctcaaactcctgacctcaaatgatccacccaccttggcctcccaaagtgctgagattacaggcattagccactgtgcccagccttgaccaatattttataagcatgcagcatgcatgataaattagttttgaatatatgtgggattttcagttctgacattttggcagagaaatgctggataaaaatatgacgaacattttcttttattaataaatgcatagctccccccacaacaaaggaaatccctaggggataaactataaagcacttccccacctggagattttgatattctctaacccagaaggcttagatttaattagcaatgtgcagggaggaggcaagccatgggcttgcttggagtcagaattagatctaaaatttggtcctccctttgacctttggtactaaaatgcagaaggccctggattttcggagggaaaagtctgatgctggcctttgggggaaaaagtctcccctgaaaactgatagttacgctcctacactcattacaagttggggtatgaatttattactttctgcataatccaggaacttccaagctaagcaatgaacaaaatagtttctgtttataattcccaaattcctggcagtaacaaatgcataatctctctggaaggagataccctttgtatctctttacttaaataaaggtaaataaagtctactaaacttacaaagaacccaagaaaacagtctacattgagtcagcaaataaatcagacctctaagaactttaaatagtagaattattagatatagactgtaaaataatttaatgtatatttaaagtacttaaggaaataaaagactgccatagaaatgatataccaaaataggctatagatatttgaaaaaagaatagaatagaatctctacaatgaatataggcattgaaatgtacaactaaatggatgcattaagaaactgagcagaagtctgatgaagtgggagacagatcagaaaaaaaatttcccaacacagcaatgacagtgaaataggagaggcagttttcaaaaagtaaaatggatcctatgtaaacatggatgagaattttgattaaaattagtgcgtctttggtgaaaaatgtagcgttacctatagcactgctgcagtgctttcttgcattataacattttctggcaatatagccttaaaaattggttacatccaataatgcatttcttagaccatcaaaaaaataaaatccagtatttttgtatggtataatgaagtaaattcattactaaatataatcaaataactttagcaccagaaggattctaaaagaacttttgacataaatagaagttagggaactgatttaatcccacaggtctaggtaatgacagagctgcagctagaagattccaagtctagcgtttttttctctgtgttttgctgcatattttagacatgtagataaagctattttggtcagattttcaagatcaaaagtttaggttttaaagcattttggaaaaagctgaaagtgtgtataaggcattgctaatataatataagcagttcttttaaccagtaatgtttttaatggaattactgttgctttccccatgttgctttatcagagcaagatatgtgaattacatcaaaacatcagaggttgtcagactgccctatcctctccaaatgaaatcttcaggtccaccttcttactttattaaaagggaatcgtggggctggacagactttctaatgaacccaatggtatgtatcaggctaaaataaagcactttactaatacctaatttgcttctaggcagtggaaacttcaaacctctgtgagatagaaagctgaggtcagattggtggatgaaaggataattgtgaataatttgcagatttcagaagaatagtggctttgggaatacataatgaagagaatataatgagaattgcactgtagatttgattattgaaatgtgtaatagaaattggataaatatttatagcatgttttacatttcaaatagaataagaatactcagtaagtcagtcatacctggagctgtctcattcttcatactacctgcgtattttttgtttgtggtttgttttggctttttttagacggggtttcgctcttgttggccaggctggagtgcaatggtgcgatctcggctcaccacaacctctgcctcccaggttcaagcgattctcatgcctcagcctcccaagtagctgggattacaggcatgtgccaccacgcccggctaattttgtatttttagtagtgacagagtttctccatcttggccaggctggtcttgaactcctgacctcaggtgatctgcccgcctcggcctcctaaagtgctgggattacaggcgtgagccaccgcacccagccatactgcctgcatattattagtccattgatgaatgtgccatcatttattaaccagcccctattgatagcacaagtaaggatttcttcctctttttttaacatgtgtagtgaagagaaaagttattctatggtaatttaagtagttggcattatgaaccgatgttatgatactcactaataataaaacactaatagcatgcattctttaaaaatttgtttttatttttaattattataggtgcctaatagatgtacatttatgaagtacatatgatgttttgatataggcatacgatgtgtattaatcacatcagggtaattgggatatccctcaccttaagcatttatcatgtttttataaatgttaggaacataccaattccactctttgattgtgattttaaaatatacaataaattattgttgactatcatcaagaaaacagtttttagaaacaaatcgaccttttcttttgctgtttttaaaaattgaattgctgtcttagaatttgtctaagtaggccaggcgcggtggctcacgcctgtaatcccagcactttgggaggctgaggtgggcggatcacaaggtcaggagttcgagaccagcctggccaacatggtgaaacctcatctctatcaaaaatataaaaagttagctgggtgtggtggcggggacctgtaatcccagctacttgggaggctgaggcaggagaactgcttgaaccagagggggtggaggttgcagtgagccaagattgcaccaccacacttcagcccggggaacagagcgagaccgtgtctcaaaaaataaaaataaaaataaaagaatttatctaagttttggtcataatccttgctgatagctatttagatcacacatgatctgttttcagaggctgtatatcccctagggaggaataaattagtacctagaatctgtaatcagagataaagaggcggggggagactggatggaagaagtcagcagtgaaactccagagcttattcaccttccatgttctcatttctgaaattccgtggaagtgtatctagtgctccagtgcttgatgcttctaggtcatttttcaaaactggtctgctaaagtaggtcagttttccaagaaccacagtcacctgaaaagagcagttagcttgccatcagatcaccaatcccattgccagactatagattaaaaaaaaaaaaaaagggaatagatagttccatttgcaaactatttgtgttaaataacactgtaactctgcaaaaagataggtgggtggcacaactatgaagtgaggtgtctataaagtccaaacatacatacagaaaactttaatattctataatagtccaccatagtcagacagacagccccttgctatcatcagaactggctcagtagaattgcggtggttgctactagtgttattgtatagacaacgtttaaatctttaattttaccattggttgttaagtgcagtttttgttctattaactgtaaagtgggggaaaaacattttctggattttttttttctgcaggttatgatgatggttcttcctttattgatatttgtgcttctgcctaaagtggtcaacacaagtgatcctgacatgagacgggtaagatgatggtccagctatggatttttttttttttaagagatagagcctctgttgctcaagctggaatgcagtggcacaatcagtttgagtggcctcaaactcctgggctcaagctatccacctgcctcagcctcccaaagcactgggattataggtccgaggcaccatgcctggccccacctgtgggtttttgaaccgtattgtgatgtttgctctgtcccatcgtagctgggtagcttagtttttctcaattttattctagttcccaagccaaattaatctagaggttgtattaacatagtatcatgtttatggcttttaattagttgcttccattagactagataaattgttagttctgcctggcctggatctctttatgtagctaaaacatcttactgcatcctagcctctttgtgtgccttactttttaaatagctgaaatgtacaatacttctggtatgctgaatctaaatattttacaaagtgattgttcctgtgatctgcctttactttacaaaactctcttcagagtacatactcagtttatgtgttcagacacacagatagaccaagggggatggataagtagaagagtgacctttgaattctgttccacaaaaccatactggttctgcagagggagaggatttgctaagtaggatgcttccaatttagtgccaccacattttctctttgaatattggcttctatttgaactcttcattttttcaaaaaaccatcatgcatttttccgttcaaccatcaacaagtatcttctgagtttcaaggttccccattttatttagtatatagatgtggtgacattttattcattcctgagtaaacatttatcaatttctagggtctagatactggagatacagaaatgaattataggccatacctgtcatcagtaggctcagtcccagttaaatgtagaaaatagaatggatttatcaaatattcttcttgctatcaggggattttgtgactttttcttttcttttttcttaatagaaatttgtcttatttcttaaagaaataaggtaaataaaaatgtttgctaaggtagtaggtgattatgttctgtggaaggtaataaggggtatattcaaagcaggaatggcagaaaaagattcataggaaaagaaaggtttttgatatttcaaaatgttttattggtgaatgtttgcatttttgcttcagtgttagactgaaagtaatacatcctgtgcattccttgtatatgttaagccaattaactgtggcatcagtagaaggaaacatcagaagtcacatttgattaaaagttcattctggccgggcgcggtggcgcaggcctgtaatcccagcactttgggaggccaaggcaggtggatcacctgaggtcaggagttcacgaccagcctgactaacatggtgaaaccccgtctctactaaatacaaaaaaattagccgggcatggtggcgcatgcctgtaatctgagctacttgggaggctgagacaggagaatcgcttgaaactgggaggcagaggttgcagtgagctgagatcgtgccattgcactccagcctgggcaataagagcaaaactccgttaaaaaaaaaaaaagttcattccttgtgaagtgctttgcacatagtaagcatcttaaaaagttgattcaagagcttcagaagctctcttccttggcactgcctgcagaggtggcaccatctcctacttggcatcatggctgccctcagatcctttgtgaagcccaagatcatcaaaaagacaactaagaggtttatctggcaccagtcagaccaatatgtcaaaatttagcttaactggcagaaacctagaggtgttgacaacagtgttcgtagaagattcaagggccagatcttgatccccaacattggttatgggagcagcaaagaaacaaagtacttactacccagtggcttctggaagttcctggtctacaacatcaaggagctggaagtactgctgatctgcaacaaatgttaccgtgctgagattactcacagtgtttcctccaagaaccacaaaaccatctggaaagagcagcccagctggccatcacagtcactagtcccaatgccaggctccacagtgaggaaaaggaatcaacggctctcatgcatgttttatttgtgtttaaataaaaccacaaaaactgaaaaaaaaaaaaaaaaaaaaggggagcttcagaattgaacagattcaaaaatagagttgatatatgtttgcagggactcaagagctgttaccatatacatttatttcttaattattggggcatgttaacatacttgatttatgtttacaatatttctttcgctagccttatttgtaaaagcaacttctcctttaaaatttaggaatcaattctacctttgtgggaaaagctcaagctaatatcccaacagtgttcaatttgaaatggaagcctagtgctgtgctgtgtgcctatagtcccagctgcccaggaagctgaggcaggaagatcacctgagcactgtctcctaaaaaaaaaaagaaaagaaaaaaatgaaagaaatgatagataatatagtatttgctatctttttcatgtatgaatgaactaaagtcaattttaagttcactttgagaatgtcacttaaaatttaaatgaagcagatgttacattaatattatataactatcaaacagtactttatagatttttggctcaattaaaggggaggacaaatactcaaaagtgccaagtcctatcctgttttgccaatgacttctttgtaacagtgtgttgcttgctttagagtctaattgaagtcatgcaagccatacagcattcatagatttactactgaggcttataaatgaattcttagaaatattgcacttattttccaaactgtactgataccttgatatatagttaaaaattaatattctggttatatgcatctaaaggaagcatgaacttaaaaatgtactcattaaaacaataagaaatcactttaatcagaaaacataaaataagagaggaatatgatcaaatatattcagtatcagaaaaaagtgttctttattaagacaagcagaatcacacgaaagggaacatcacacacagggcctgttgtggggtggggggaggtgggagggatagcattagaagatatacctaatgttaaatgatgagttaatgggtgcagcacaccaacatggcacatgcgtacgtatgtaacaaacctgcacgttgtgcacatgtaccctaaaacttaaagtataataataaaaaaaaaaaaaggcaagcagaatcaaaccctaggcagtcatttattggacatttactaagagtcaaaatgtctagtggtataaaggagatatggaaaatagttactaatgatatataggtgaagtactactgagtatgatgttgcatcattgctcagaaccagtacctttcacttgttctactcctttactttttccttaataggaagtgttaggagttaaaagactcgaaggatcctacatatcattgtgccttgtcttcttgcaggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaatcaaa

SEQ ID NO: 553 - DNA, 421527 bp, Homo sapiens
agtaggagtggagagcgtgcgtgagtgagtgtgtgtgtgtgtgtgtgtgtgtgtgcatgcgtgtgtgaagaatgcacactatctcctgttggtaagtgtgtgcttactccctgaccagatgctgcggtgcacggggcagccaccatctctgcatgcatgtctgtgtaagtgtctctctctctgtgtgtatgtgcctctgtcatttcgtgtcaaaggtacattacctgattacctttctcggctgccagatttttatctagataattggaactgctatggaggctgtgccttgccagccagcttagaatctgtaaagccatagtttgtccaccttgttatctgtggctgcctgggcagaggaaattaaagagatccacagccaggggggcgcttcctactcctgacctccccagcgatcccaaacaggacagtttgttagtaccgtctttttgtttttatgttttgatttcgttttgggtttttgttcgctcgtgtatgttattttggcatgtggatacctattcccctccacatcgcacatcgtgttttatggagtttagagctgaggaaactttggtcgggttgccaggacgttcgcaccactttgcggaaagcacgagctaacagtgagaccgacagagtgagtgacaagttgtttacaggtttccttgaaggggcctctgctatatttcaatctgtcaaagttgcttttcttccctcagaacaatgcctgattgttgtgtgtgtgtgagtgtgtgtgtgtgtgtgtgcgtgtatttccgtgtgtgaacggagagagcctagaaaagggtgagaaggaataacaattctttgtgtaaaaatgctattactaacattaaattttttgcttaattagttaataaatgcagtttaatcgagcttctgttattatatagactaggtttttaatcagcagcaaatacgttttacaaaatcatactgttctgcgtgtgtatgtgtgtgtgtgagttttatgatttagaagacagagtatgggagacgtgttaaatgagttgacttctcacattcagtgatgtctagaagagagaattaaaaggaaaggacaggcaccctgaggttgtctagagccttgcagccggagcgtgtggctccgcggaggggggagcagccagactccgctgctggaagtgcactacccctttaagagactggtcaaggagtcctaggagagagaggaggggaaggagggggggagaaagagagagagagagagagagagagagacagagagagagagggagagagagagagagagagagggagggagggagggggggaagagacagagagaaaatcaattggtttagaaggtttggactcacttgacaggttcagttggagacgatcataggtggctgctgtgacaaagggaaattgtgcttttccagcatgcttactgaccctgatttacctcaggagtttgaaaggtgagtacagttttttccccctaatatattgaagtacaactctcccattttacagtagtctctgaatcattggaagatgctcccccaaaacgtgtttgttagagaagcctttagctagggcttctgcaatcttgttagctgattttttgttgtgattgcccggaccaaactgaactgatttgcaaagtctccgagatttctgctaatgtttttaggttgcgtcctataacagcaaattaaatgaaccttaagcatctctctctctctccccaactcgctgcttctgtctttctcattcactctcttactttcttccttcattgattgttttctccccaccttttaaaaacgcttttgtgcagaatgttaccattttcagcatctctgtctcatgtaatttctagggtgacagaaggttttagtggtgctttaaacggaggctataagttcctatttgatccttccgtaaaactttggaagctgctcagtaaagcacatgaccttttgttgatataagagagcgttttttccccccaaagaaaatttaacatcatcgctatattagattactccctaagtgtcaaaaataggggcgaaaaggggataaatggagctgttccctttctaagttttagtggccactttttgtgttagctgtcttgactgaattttaatttactgtattttccccttttgctatgatgggaatagtgtatttgtaattaagttgttcctatttagagaaatatctgcagcatccttttatttgatgttgttgcaagtaaagcagggctttgaaagaattttagccctcttaatgttcctataagtacacattgcaatttttaaatttgagttcttatcccagcataagttcatttttttgaactataaatagaattttgtttgccattaaaaagaattcaaactttgtattctgtatggtgaattaaaaaaaaaaaagctaaaaaaagccaggatgcatgatacccaggctttttttcattttcatgaaagctaccttctgtataaacatttgttgtatctgactatgcaatgcaagctaggtgctagaccagctggttaaaaatatgctaagtcaagctgttcatcgctcaaacgactgaatttgatatgaaaagacgaaaaaagaaaggacaaagattaaaacattctagaagtgaagcaatggaagagaaaaagagtattgaggataaagtaacgcttgaatgtggtcacatattagaaaagccagtatcaaatcagggaagaaagtaaaatagccaacacatatacttcggtgctgtcatctttctttgatttcttctgtgtttttttttttaataattaaattgcatctttactagataattccagcgaatgtttgagctttcttaacagttttgaattaaaattttcacttctatatattaactctttaattagtgagcttttatttgcaaatatagccttatatcataggtagatgttgaagttattcatagtggaacatactgtacattacctaatgtagcgatttgctaatttaacacagttaagttttctagaatgcacagagtagcacttaaatgataatattctttaattctaattatactttttgcaaatacaactctgaggctgatttgtaagcctgttaacagattgtacttataaaaaggtagttacatattaacaggctgtagcctatttctctatataggcaagcttcctgctgtgaactttatttgtatttttttttcaattatctctttttaaactaaacttttccctttcctattctgatgctcaaatctgttaacatcttttttcctcctggtgggaatttcatttttttttttcacccagaggcatgcttttctaactagctaattaaataagcaagtgataatcaatagggttgttagtatgactatcatatttagaaatattagtagctaaaataattctgaaaaatgtcacacaatataacgttccttaataatttcccctgtggttgtaattggtaatacatacaaagatctcagcaaatcattactatttgtttacattgaatttgtacgggtgagtgtctctataggcacccatgcatgatacagtgtatcatgtagacacaatattgaatatttatattcttcaaaggaggtatttatgatgtaactaaactatcacatataattagattttttgccttttcaactatttgcaactttcattgaataaataggtcatttctattgactgttaatttttattctattgggtcacttgctatagatgaatttcccacttaaacttagaaatctaaaagaagacttctaaatttctttgtgaaatagagaactttgatctagaggacataataaattgcttagggttcatgtactgtaaaagttttatgtgatcatttttactaatttcattggtagagtcttgtccatcttttattcttcccagcctgtagactatttgaactttaaggaatattcagaacttaaatatcaggatcaaaatttggatttagatttgtatatgtctatattatcatccctagaaatgaacatggtcagtactctcagactaataagcagttgttaaatagttaagaagtagtaacaatttcattgtctgttaaaaatatgcaggaggtagtgcaaatagaacagtgattctaaaaggtaaagaacttgaaatatttttattttcaagcattcttgtgataaactgattatgattactgaaaaacacaactccaaggtgggaagcaaatgggtgtatatattctaaaaaattatttgtaaggaaagtcttctacattttaccgtttaaaggaaacatagctggcaacatggtctaaatgtgagtaatagcatcattagaatgaacgcccgaagtctccccacatttttaaaagaagtcaataaatttatatatttaactgaaagtagataatgaaaaattgtgacttaaggttttcctttgagaatgtcacctactttttgatatttcaaggatgaaaagaaaatatttgccttaaatgtcaatattagtttgttcatgataagtaaaaatgtccatttttgatagtttctcaatattctatttctttccttttaattttatctgtcctctttggttgtaacataatagttttgtgtctaagcttcccgttacagtttctaattgctttatgttagaaacttaaatagcaagtgtaagacgattgcttaagaagacagttctgataatgtctagaaaggagaaaaaaagttgggattgaaagtagtgggattatgcaaattaggttgttagtatcacctatttgattgcttctcccaaattggtgcagacaacagacagcagattttctacatgttgaaaggaacactacaatagtaaaaccttctgcaataaaaattaacttatttacttcacatttccatcaaatttatttctggtcatgctgactaaataatttttttcttattaggacacttttcagtgtttttctgaagaaagaaatatatatcaggtgctgttacaaactaattcgtaaaattcccatgaaaagctactgctagacatttgcagaaaactactctctgacattagtggtattttagttacctaaagtttgaccatagtcatgaaatatttatgacacagatatattttgcttaattaaaaaccttaacaacaacaacaaaaaaatccgttgtgctcatgagtgataagtacattcaggttagcaggcacactctaggtgtgaatcacagaaaagttatctgttcacattctgtcacctaatggcaactgtaaacctgtaagtttgattttacgttttcaggatgttctcataggctttgataattttatttatattttatttactactacattgtagaggagacaatgtctacaactgaatatagattttaattaccgtgtcaataatttgcaagctaactgagctaagacattggtttggaatgcagcttgcatgaggcagttcataaaccacatttctatcactctcatgctggaatactgtcctgaagacttggcaggagacctgactgattaccaggaacaattaagggttaaatgtcaggtgacattgtgtactgctcagtttttagcaggtttgatagacacagaaatgtgcaaatattatgattacttcacatattggtgtgtccttatcttatgtttctcaaatataataagcacatgttaaagtatttacctgttcttagggagtttttgacaaaaatcttgtatacgcatcatacatgagagacatataataagacctgttctgattctttagcacattagtcctccacagagttggaaactatttcatatggattatactcctaatgcatttagaaagcaaaattacattcatgggtaaaggctgatttttattgtctgttttctctccactatcaattgttcagcaacctaatgagtatattgtgtaatgcagatgtgcattatgtaggctgaatacctccctttttatagattagttaaataagtataactgatgagttttgttttctttcataatttgttattcctttataatttcaatggggttatccaacagcctgggaaagaaactaacctaagtttttctcttgtactaactcacgtatagttccaatgtgccaggtctctgactcagatgatggcagtaagataaaaagattttcaaaggtttaacccaaccatgaaatatctccttcctaatgaaaaattttcttgaacaagaaatggacaaaaacataacaaagtcttccttccttcattcattatctccttccttctctttcattgattgatagcatcatcatttgtattaaatgtgaaatttgattgctatgtagataaacaggatcaagtgatattgctagagtgagaaaatatttaaatttgacatgctttaggagaatgccacatattccttcattatgatcaggaactgatagtggtttaggagaagacctttttattctttctgacctctgtgttttctcctgcagtttggaagctgttctttctttcttttagtgttgtctattcttttctttacttactaattgagagttcacacatcttctctggagatattgtggcgtatggttttgcttgtccaataggggggtgttgcatttctccacattcagtatccttttcccttggatcctgggagtaaaacctcagcagtactccctccctttgccagcctgaggagtcagagactcaaagttgttcccagctcttgcgccttcattgtagagctgcattctgctcagtgggctgccgagaaggaccagaccgaaacaagatttagaagaattctggtgagaactgtttatagggatatggtattttaaaagaatgtagtaaacaaacagaattgtggcataaacaaagataattagcataaacaatgtcgttttaggacaggtggtttaaaaaaacaaacaaaacaaaaaacccaaatatgaacccaatttgaatgctgccagtttggaaccactgaaccttaatctgtacttcatgagaattacccaggtttgttgataaacttgttaacatgcgttttttgtttcttttgtatcattttccggtcattatgcccttttgtcacccagcttgaaagtaattaatctattacaaggtagtttaaggagtttttgcccataaaacatgacagaaggaaaatttaaaacaaaagcttgtagatgttcatagacatttgaaatcagtgtcaaaccttaaatcaattcaaacctgaactcggctcattgtatttgaaacctctcttttatctaagtaacattttagtcacttggctctctagtgttaatacatttacttttgtcttgccttaaaattcagagatttgttttgctgtggctaaatcagcatttttgtagtatgtgtttctttctaagtgttgcttatttcttattatttttctctgtaacttagtgaaggtggtacagcagcgtataaatgtatctgatgatcatgcaatatgaggatgctggttattatgaaccacattatctaaacctactatgccgtcgtgatgaatttttatctggagacatttaggtttattactaaatgacgttttttcttaatgccttgtactgaaatgttttgacttaaatgaaatgtggagtgtggtgaacagaaagctgtttatttttcttgcattaaggatcaaagttctttattgaagttaaagagattttttttttttctcttcacttactcatggacaatggggaccaggaattcaaagtgggtatctctgatattctgtggcccttctctttgctgaaatgaaagcatttgtgaatgagttttggtttcttggagttataaaatgtgtgtaaactagtaaaccatgtctcattcatgtgctatggagatttctcgtacttcagggacaaaaataatttggctactaacgaattagggctacctgccagtgccaacacatagtgtaggtaagaggaacactataaagaaaagctgctggcagcaaatccgttgaaactttcatatgtaacagcgtttctatttctgctcttcacatctttgaaagaaagtgtgttttagaaaagaaaatgttaaaaaacagaagatatgatctttcttaaaaatgtatgtgtagctccactttaatatttctcattgtggagatgcatggggtttcattatgtcctatgcactcttggttcccctacctttcccaatcaattctgtcacattgaccaacctaaggatcagatgcattgagagtaagtgtaatagagaagaaatgaaattcactgcatagagccaaaaaaaaaaaaaaagcctcagagccttatatgattttgatattggcagtttaagggagttagatcaattgggacactgagcagcaattttataaaggatgtgtcctctcattcagggcttcaggaacattttcaagaaaagaagggaaagagttaacctgtgttgcctgttgttaatttcttagtgtaggagtaaaacaagaggtagacccaaatcatgttttcttgtcatatttttaatcaaaatttatttcagaatgttgtcagtgtttacattagtactgagtttgcctttttgtttttgtttttgtttttatattaagtacaattgaaataccagggagataggttgtttgaacactggttgtgaaacttttacataagatctttcacgtaccattttaagctattttatatttatctaataaaagatcatcctaatgaaaaagaaatacgacactgaaaatgagaaatattccttcacctaggagaacacaagataaaaaagtaatactttattatactattaatttttcagtcacagttaattaggttgcttgacaaagttctaaaacacttttattctaattgcaaagttaaagtattatttgtttgcctacaattcttcctttggttatttgccctgggccagtgtttgttgggcaatggttttcaaagtccaaagacttttttttcactgctctcctgaggtccctttgtcatttttttttttttattagctagtgagtttcataatatgtttgaaaagaggttgcagggggatgtcacatataattcaggttaatatttccttccttttttcttatctgtactctaagaggtctatgttggagattcgttaggataaggtatagtattcatattatttagtgtagaacggaatgaactggtgctcaaactattcagtttagtatgcattcactaattcaactttgatcttgagtgataactgaatataaaatatcagattcagattctttgtcatctatgatacagcattatctattattatattttatgtaatatacaaagtaccaatagtcaggcagaacacctaggaatggtaaaagaaagataactatgaatgctattcctgagagtagaacttctgttttcctccagtcctaaatataactacaatttgggaaatagaggaaaaggtattatttttaggaccctaaggattatgatatataaatatttatagtacaattatttctaaaaatgttagcattacttgaaaaataatatggatctaatttgacctataaacagtttaagaacacttagtgctttaaaagcattcttctagagaaataaaagcatatccaaaagatcctgatagcaatttaaagaatcaaagtgatggggcaacatatttggacttttataagtaaattaaaagataattggaagtcactaacaggtatgtgcaggattattttagggaatataatagttatacgtgtgtgcacatgcaaaagttagaaagccaggagaaactttttcatttatagggcagttgatctcttgaatgaatcctgccaaattctaatgaagctgcagttttttcaaaaaatcttgaaaggaagaaacatttcatagaaatacaaacaaggttcattcccgttttcttgtttgcagctcagaatcctgtggcatgtgctacaggaacatataatagtattccatcttgaaaaaattgaaggtggtattgtggtgcatatttaatggaaaatttgaaccgaagacgttgggtgaatcaaggtatgcttgagtaacatttggggatatttgaggttttaggttgagataatatgaaagttgagtgttcagggtctaaagcatacctatcaaatgaatgagtttgtgtgtgtgtgtgtgtgtgtgtgtgtgtgtgtgtgtgtaatacttatctcctctgtaaataaaataatttcctcttctaggttaagatttatatttgccagtatcttcattgattcttttggaaatgtaacatagtacaaagcgctattagctagatgttaagatctcaagttctagttcttctttaaaaactgagacctctttgactcttaagagtatgcatctgtaaaattagaagataggatggataatttctaaaatcagttaactctaaaatttcattactttgaactacatttgcagtgtccctagctcctaactctagtggtcagaattcttgcatttatgtagctatttggagattatctctatagccagcctttacatatagaagcacttcagtttacctgtcaattaggtatcattacacaggaacaagcagccatggtgtctcttaggagtttttaatctaaataccatgtataattcttatttaggattaggtgcccaactttgctctgagctatttgaagtgtttcaaaagataagattcacattctatgatcctgaaactctcaggcatcagatcactattctgaacaattataaatattgtaaaagataaattatatatggttaaatgaacaagacactatggggaaatatgaaaagcatacgagtggcactttaggtcagggatctaaaagtctgtttataaggataaaagaaaagaaaaaatatgaagaatccgcaggagagcatgagtacagcacaggggctatggacagtatatgtctttatatgaataattaaaacattgggctggaaagtagcaagatcaactaagattacaaacatgtagtccaaagaaaaattttgagtgtttctcaaaataaataactattagcattaccaggccagccaatttgatatgcattatactatagttgctagttggcaatttcaagaaaagaaatgttaaactctgcaaagcaagggagtagagcaaaaagcaatgaagtatgcatttaaaaagctgtatcgagagaacaagcttcatatattgttaatatatttggcaggtcgcatgctgtttttttaatgcagtgttggaaaaacagtgtagttataccatcaggaatatacatatctaaggtccttccgcattatctctacttagaaaatttgtctgtggtatcatgaaatctttgtacaaattagtttatatttaaaatatagattcatgtatttgagataacaggaatttgctatgttaaaattaattttttttacagaataattatgatgtagatttttttatttgattcctgccgcttttaatttaggcacaaagaatgggtattattctcttgttctccttctatagatataaatgttgaaaaaagaaagaaagaaaataacctcactgaaccagcactacatttagaactaggaccaaagagaaatgtgcaaatatcctactgttaaagcagaaagaaaatctggaaatcatccagttgggcaacttactgctaatatattttataatccagcatttagctatatacaaagttggcatatgttcctacagtttctaaatcaagaattagaactttgtgatgtataagtcacttgcatcgtttgggtttcagccatgcgtctatgaatggacttaaaaataaatataaaattatttatcccccaatgcaaatgagccagcttaagcttataaaaaatcataaaaatatttggatatgtctgaatgcaagctactgcattcagatttttaaaactaggtttaatttttggcaaatgtaaaatgatcagcactttaataaaaatgattttttgtttaataacatactagtcagatatctgcaaattatttcagcatataaaataatacatgtaagaaattggtttacttatattttagttttgtagttaatataattgttttaaatgtacttatgattattgatcccaggtaacgtgtacttaaatagcagcaatgcaactgtagtttcctctaactgcttagtgctcataattaaatattccaaaaacacatctcttgtcattttatatataggacatctgatgcactaatagttatttttgcaagtatcagtatattaagtatttgagtaatgaatttgctgatttaacatattcctatgctttaagatgcacaaattaaagttcacttatttttgcataatcacgaaaatgaatcatttcgtagaataaatgattgaacaactgaaaacagtgatttttctgttaatctaagaagtcacacacatactattgctttttaaagtattctttgtacaaacattttgaaaactagaaaacattaaataacttgacacaattatgtgtactaatctagcacattatagattttcatagtaaaagcaacataagaggttttgcattagctacatattctttggactgtaggttaagcttgaagaaatacatagatttctttttatgtggagctctataacaagcaaaccaaatcacctaagaaacagaacccttatttttgataaaaaattgttttcactgatataatctgttgaaagccagaagccatccaaagtgctgataccaatttaagaagatgatcttttgccttaattatacatctgggaaatattagctgaacattttgtggagaacagtgaataccttagttgccagttgtctaaaatgctgctaatgatcgacatagtgccagtgttttgatggctaaaacctaggctgaatatgaatacaaagaacacagttggggaaaaaaaaaagcgcacattttatacaaaacagatttcaaccatctgcttggcacttaagtttgtgactataggcattatatgaaagagaccactgtccacgttaagaatggtattacttttattggtaccttagaaaaaccatagggttttgaatgcatgtataaccaatgattttcttcagctaaataatgcaaacaagggcctcagccaaaattttgttccctccataatctcttctatgtcagtcttcttgtcctggcaaagtaggtttcactaataaagtaggtcttagtgctctgcctcaggatattaaataataccagacaacactaagcaagtggcccttaggatgagaaccccagatggttatgagataaagtactgtttgctttaggaataggttatattcctgaatctgttgcctgaatactatggtgcatgtcaaattagcatggaagttaatggtccagaagcacttctaaatttaatgctttcccatttgttctgaatttatagtattaaatcagagcagtactgtttcatcactatttcagtaaaggaaaatcatgctatggataggaaattataggcaaaatctaattgtttgacccatttcatttacctaaaggtgagggagaaatcctgaaatgctcaatagaagagtattggtaaatatcatatattagatgcttttacatttgtagaccagttggcaagagctattatagactgttccttagcattagagtaggcaaaacataaatttttgactaagtaataatttgacctattgtattatctttagctgagatatactttgtctttttaaacattaggaaaatcaagctattagaatgtgttagcttattgatttgttgaggttatatatgtaggttgtgtgaatggaaaaatacatattgagaccttcttagctcttgacaaacaggtatgtgatttaggaaagtataaagaaacgctctcagagtccctctctatttgtgctcctttctaatatggtagctactactcacatatcattattaaaagtttgaaatgtgactaatctgagccaaaatgtgctgtaaatataaaatacgcactggctttccaagacataggttcaaagaaagaatgtaaaatatcttactaagttttaaaatgttgattatatgttgaaatgacagtaggatatattggcacaaataaaatctatattaacattatttttatctctttttaaaaacttgttaaatatgactactagaaaatttaaaattacacgtgtgcctcatatttgtggctctcatatttctattggatggtgctgctttatagcttcctgtggatggagggaaatcaaaacttctatctttatctagattctagtggttcatagctcagtatggtagcaatgagttagaaagacttaggggtttattaactgtctttattcttagccttcttctaccacaaagtggaattttattacttttttaaaagctacagtagttaacactcacattcacagatgtgaatgtttacctcatgaatactgtcactttcttcaaacttccatggagttacaatggaaaggaagatgtttgcttaagaattatttaaattattttagagattatatatttgaaatgggaaattagatttacttttttgaaatgccactatatgtatctttaattttactattgagttttaaagaagtttgtggaggggtaagaataccttcagcttttgtatcccagctgatactacacacagtttcttaaattgacccacaagatgtgatccaaactttctctatacatatggagatacacttatagagatagatataaagatagagctaacattcagtatgtacttattatgtgccagactctgttataaattgctttacatgcattatttcactctagcctcacaacaatcttatttttttacctcatttcacaaatgaagaaaatgaaacagagagagttgcctaatttctaggtaataagtggaaaagctggggtacaaactcggacattcaaactctaattatccctcttaaccatcacattatagtattgatctagaaaataatgtgctaccataactttataatctgttatttattttagtggcagatatttctttatttattcaacaactacattttaaattcctactataccaggtattatattaaatgctgaataaatattgaaaatgtagatgatataaatgacataaaataattgtgatataaacttctaattttcttctgaatgaattaactcattcattgcacaaggtgatatgctggatggtggatatccaggcatatatacacttacgtaaagggtttcttggtaatggctaactggaactgtttttgagagatactgacttccagttctccttactgggagaagtgtaactatgtagtatttctcaaatatccatttctcaagtcctttgtagtaagccatctattgaaataatatctttacagacaggcagtatttttgcttaaaaagtttatctgatttgtttttgctagctcagtaggcagaaagcctctttacagtatagtaattcttaagtgtgtcagtgttcacatctcatgtggggatattgatttagaaaagttgatgatgaattggtaaataatggtataattaataggatattctttaatttgtagccatgatgaactgattttatttgggtagcaggaagagtgtggtaattttgagtagaaaactcaattagatatgataaaataatgtgactgataatatgattgcagctttatggtaacgaggcattggggaatggaaatgaacctcatgtttttcagccactgatttttcagttttactgatggatgaatatgcgttaatgtaggcttgatccatggatctctgttttaagtcttaatcttttaagtgttcctcatgcagatatgtccaaggcttctgttactttttctgatttcttgataccttagtaaggagaagccatctaactttgtagttccaagagtactttggagtcagactgcttacatttattttatagcctcattattgattagttctgtgatctttgcgatttacataaactctgcatgccttaattctttaatctgtgaattggagattataattattcccatattataggtcatcttagtgcttcaataagaaatcatttataacttagcatgtttaggaaatgtatgttatgattattctttaacagatgttaatcatgtagaaagagttctaagaatactccatataatatggtaggtaacattgaactacctatggatgtataaatatcaagtaaattatgctgaacattatgtattgtataaactggtggtttatacaggatttatcagaactatggctgcttaagaggatgaaaaaatatttaaaataaaatattcatgttgtataatcatttgtattttatatattagacatatatattataaatatataatacatatacatcatgtatgtgtataatgtgtatacatatatacacatcatatgtgatatacatatacatatgtataatatataaaattgatttttgacatgaatattttatatgtatgtatgtgtatatataaagtgaaatgggggaagagaatttctaaaactaaaaccatagctgggaataattctgagttacctgactcataatgaagtttatgtttattattttctaatggaaagaagctcactattgtatcagtaatcacaattgttttgggagccctgatatctgagggaataatttattttatgaatccttaaaatgtcttcaacagaagtattacagaaaattcagaggcattgttcacattgccatttttagtagagaccagataagaaaaagaatattgaatgataactaacttagtggaaggaggcatttctataagtagctaaactaatgtttgccaggtatgtagatttcttggtgaaaggatacaggcagagatctaagaaaaggctaacaagtcctttaaactatctcctttaaataacagttgttacatccaggctgttgctaagagatgaggaacaatcagttcttgactgagttgtattcttgccgagattgagggcactcccacctctgtccttaaatttgctccaggtttaagagtatacagagacaaagcaagaattttcctcaggaaacacttttggatctgctcaagtacctgaagagcatcctggtgagaccctagaattcgatattgtaaacatagcacaagttgtcttcatttgaagcatgaaaactttatatttactgttctgatccattgccatttctgcaaattttgagcaatactgcatctcactgggccctccaggttgacttaattttgaaagtcatcctaaaaattaaattagcagataaggtaactttacatgctttctcatgatttatttgcacatttagagtgctgtagacatagaaacatttccattttgatttattcatttagaaatatttattgagcacttacaatgtgaatatcagtaggtcccgcttatctgcaaggcaagagacatgctccacaacccccagtggatgcctgaaaccatggatagtaccagactctgtacagtatatgttatgttttttccatctgataattgaggcaggatatatagcgtgggtaaagctggacaaagagatgattcaggtccagggttagctggagcaggatggcttgagatttcaccttgcttctcagaacagcacataattaaaaacatatgaattgtgtatttctggaattttccatttaacattttcagactttggttgactgtaggtaaatgaaacttcagaaagcaaaactatgtaaaaggggatctaatacaagtcatctggcaggacaaaagtacacatcagtgtgaatgaaagcagtggagatggctactatagggaagagtagggaataagaaggacattttacaatttatcattttatcaatatgagaatattacttaaaaatactgctcttttccacttgcaaagtaacacttatcttcaaaactaatggttttgtctgtggcataattattctagaacttctgtttatgacaacatttaggtacttttagatcatgatggtaaatctaagtgatcaaccaagaagatttttgattttacatttgctgtaaccgaaaacattgtggtcacctaaaaaatgttcatttaatcagatacagaaacctttttcatttttctccttttttatttcaaaaaaaataaaaaacaaatgtactgaaaagttgaaataataacacaatgaacacctctatactttttactattaactttgcccccttcactttctatttctttcttttctgattcacttgaaagtaagttaaggctaacatacctaatataaggtcattctcttatataatcacaataatattagcagatccaagaaagttaacattaatacagtaataacatttgacatacagttcatattcacattttctaactgtcccagtaatgctttttatgtctttttcaaaaagttaaaatcaagggtccagtcaagcatcagatattgcatttagtttctagtccctttaaagtataaatagcaccctgccatctctttgccttgacattgacattgacatttttgaggagtccaggccacttgcttcatgtaatgtctcacgatctggatttgattttatcctcatggttagattcaggttagatacagggctcttaagacaggtattggaccatcattcttttttatatcacttaagattgtaattagatctgtcagaagtaagtacctaccaagttcagattttggtgtaccaggttcatggaaactttttttttttggcttagatttttaagaaatctaatctgttctcagaaagctatctgagctatggtgatttgtcttgcatagagtttaactgacccttgttgaggaaatagggcttccttagttcaagaaaccattaccacatattcataatgtctactctgaagatagccatgaataccattttttgcaggtaatctaaaaatattgattacaaagtccgtgtaataacatgacattgtataagtgtattttgttagagttcatacttagaactacaacatttgttctttatgaaaaaatgctagatgctacttacctcagtcagaacagattcaactcatttcctcatttgtcattcactgttctcacaaattgaaaatcagaaataatcttgtttaaagtttctaaaacatttaataaattttgaaaaaaattagaagcaagtacaggctattctcttttaactctactattctgctctttaagaaatatatttcaagatctatggagtgacattttcgttaccaaagtttcctacttctgtgttctaactactttataccatgcctctctattcaaacagaagagttatcaatttgaaaattgcccctctttagaggtaatgtacagcacaggctctagagtcagatccctctattcagatcttggctatacatttcactggctgtgtgatgtgaagctagttacttaacctctctgaattccatcttcctcatatgtaaaatggtttttttgttgtaagtaattgtatgtatgtaaactgtttgaaattggaccacgtatatagtaagcactaaataaatagtagctattaatattcttgatgatgaattgtcaatatttgcagtaactaatagggattcctgaatagcacttggacattagaacagatttttaaagcagtagtgaaatatttgtgcattctttcatgaaatacttattgaatattttgtgtgtgctagacactgctagtttctagagatttaaaaatgaataaaaatatatagcttttgtccctatgaagcttatggtttggtgggagagacatactaagcaagcaattgcaatgaaggaaaatatgaatggggaagtaagttcaggtgttatggtagaacacaaggagtcctaatcctgttctgtgtgttagagagggtctttctgaggagaaggtgagaaccgaaagcaaagaatgatacattttccagacctagacagtcatatgggccaggagtgtggcctgtagggtaaaatcctccatagtttatgagtctggttctaccatatgcaagacgagttcccttgggtaaattctttaacttccctgggacttcctcagtttactcatttgtgaagaggagataataatagtacctgcctcacagggttgttttgagaattaaaagagatgattaagaacaactaagaactgtccttttcaccttttgagtacctaataaatgttgactatattatcagaggattcagcatgtactaagtcctggtaacaccagtaaaccacttgaaggacccaaaacaccttaatttattccttagatatgactgtaccatgagtctatgttgcaaattccttcagctttcatcctcctccctctataaatatatacagagctttcttttgtaggtttacttgagcctgatcttcaaaacacaagtctgaatatcaaactgagcatatttatattttttcttggtgtattaataaaaatggcattttgtgagagcaaaaaataacctagccaaattgctacattcaggtaaattttaaatgggtttgaataaattaaaaatgaagcattctaccaatgttcttggaaagtttctggaacaaagtctgctttaccagtgtgaacaacttagccattttctctgcatgttgccctcctccccacatgactcagtaacgcagttacatttattggttgtttacttttaatgcccttcattccactaaggtttgtgaggggtgagaaagggagctccagaatgcgtggtttgaattggaaaaagatgttgtgtggtcagaatgaggatgagtagagaaattgtagggaagctttggttttgaacagcctgttgattgtcctcttttattaaatggagatgctaaagaatgatttaatttgattaaactgttgttattatcctcttcatggatggactctgataaacttcaatgctgttttttaactgcaaaatttctaaatataacattttctgttggttcaatataagctgtcgtgttatgtcttaaaaagtagtagttctaaaaattgttttcacaggtattaaatatcaggtggaaacacgtattttttaaaaaaattaagaattgtaaaagtatagattatattgatgtatgctatttaattatatctccttttgtgagcttaattatgactagttggattttgttagaaaggttgttgttgttttttttcctctttcacagtgggattaaataattttaatggctaaaaggttcattttctcttttctgtattggacacttattgtcaaatgctcagataaatgctagccccatgatgtgtgaactttgactcatacttaggagacccctgaatgtaattggctagctgatattcagctcacagcacagaatgtttttattcaggaaaaaaatgagggtgggagataatgaagcaacattatcctttttaacagtttcttaactgatagttttgcttttgctttaaaaactctctttcatttatatcatcgttcaatatataactttgtttccacaatgtaacatactttcagagtttatattagtttgttggttttttacagactttaatgtgagaataatccatatttggaaggaaatgcattgttgtttaaggagttgctctttgtgagataattcaaaatctcttctgattgttccacttttaatttatacatatgtttgtaatactgctatggctttcatgttaagcttttctgtgtttttgtttcgtagaaggcatttttttaaaaaaacactaccagagcagtcacttaatttattataattttctttcagatattattttagtaattatatttacttgcaataatttagcaacagctaattgataatgaattgacagtttaaacatagtagtggataataaaaattaaacacccatacaataagcaattttcttttaggttcttgatctttaagttccaaatttttactttttacctattgcctgctacttttattagccataagaccttagatgcttaaagataattgtcaaaattataactttttaaaaattaaaagtcaggaatttgaaagtggtatatttcctactctaagagcaagcaacattaatttccttgtttataaatggctggtctattttgtatatggaatgaataatgaaaaattaaggaaaagtgcttttattgtttattgttttattattttactttattgtttaaaaataaataaatttataattttctatagtttatgtatttcagcttaacaatgaataaaatgcataaaattgtttttatatgcttagaaattcatacgtctaatgatactaaaggcattaggtttcatacatcctctgaatgtcagtttcttgggctttaatattaaagagttctatttcagttaaagtgtaacttatcaattcccataaaattccttggccacacccgagtactgagcaacattaaggatagagaggaaaatctgcatttctgcttcaaaagggccctctgctaatggatgttgaatctctgagatcctggttttcgtggctgtttggatttactgtaggtcctatgtttttcctggtacctagccctactcagacttcttagcttttcaccggtattttctctgggctcatttggcttcccttcaggttttgttaccttatttctccagggagctgtgctgtactccactgtccttcctcatgtgcccagtagattttcactggggagctccatgactgttaatcgccctggttccatcctctccagttgctccttgatgctcttactactggagagtgcatttcatagccatctaatggctactaaatcttctgggttctggaaaatgtaatgcttttctggagacagataaatttcaaggtgagcttatttgtgactttgtgaggatctctatgttttgcggaacatgatattagcacactgaaaggtataaatagagtttggtcttactcgtgatcatcaaagtgtaagtcatttacagcagcataccaatggttcttgaagacaaagtgcaatcaagccgaagtactatcttacatatttgttaaagatggattttaacattgtagtttcttttttagaaaaaaaaaatgatgttatagatggtataacttgtccttaaactatgatggagagactttagactttatatagtctgtgaggtaaacaggaaaattgaaataactattggtcatgatcatcattattttaacaagatgaaggattttccactaattatggaaaatatattgtctcagatcttagatcctgtagccctgcctatatgtatgtccatatgtatgtatgtgtgtatataaagcgagaatgaaagagagggagataaaaaggagagagagaaggagaaagaggtgttaagttggagaaaaatagagatagtgatgaagaatgaggagtggctttagtaaaatggtatgaattcttcacaaaagtgatatacctccagtggaaaggatagcccttctttctcccgtaagtagaagttaccagagagccaagagcctcccccagaatggttacgtagtttattttaggtgaatttgaataactgctataatggttaaaggcagtgaagaagtttgctaatttataagaatgttttataaagttgattcataaaatccagactataatccttttggaaaaacaaagcaaggaatgtccagtttttaaaattaggttctctaatagtggttgttctaatttttaaaatttgtattagcagatcatctttttcattttttagtagtaaacatgacaaataagaattgtgaggtcctttctggcatacaacaaaaagttctttatcctattacccaatgcagatggattttaagtcctctgggataggcttcttcttggtatttcactctctcctaaagttgacgaaccttgcaatctaagtattttgagaattgtgcttctcaaaggcattttccctgtagatcatttatgacttgacaagcatatctcatggacagccttagccatatactatttgtttgacactattaaataaacactcaaatctgtcatcaaaattatgctttattttgtaggacaaaaatgtatgtgtcagttctttaaaacaaagaaatgaattgctatcaggaaaaaaagcataggattttgaatataccaaacataatccaaaagttcaggtaaagcataggattttgaatttactaaacataatccataagttcagataaagcataggattttgaatatactaaacataatccataagttcaggtgtcctcacaggaacattgattaaaaatatactaaacctatgaattagtagtattttgtatctttataatactcgctttccccatgtagatgatttcttgcctgaaaagcacagcttacctattttcttccttcctactacatatattacagactctgagacgtccagtaaagaaaaagaaagaaaacttgtttcatgtagcttacccctaatttatttggtgagagaaattttcttcttacagtgcatcttcttaggagatgtaccactgaatacaaaattgaaaatacctatttaaagagattctaaaaatgtgaggagtacatctacagattcaactaatttcagtaaaaagtattacagtaaataaatatgagccagttagcaattaaaataccaagccatcccagtgtcctggaactatcaaattgattatggataactccagcatgttacttcccttactgagtctgttctcacagcagcctgcagggctgatacttagttgctataaccagtatggttatattggttattgattgccaacatttattctaattggttggtgccacattatattttttgtgagatattttatttatcatttttaattacactaaaggtgattgtaagggttaagtgaaatattattcataacattgtcagagcaacaaataccagcataacttttgttagtttgtttctaagatcagtttatttataggaaaacttggataaacaaataagatttatatcacttccccaaaaatgttattgtatcttgaacatatttcctttgctaaaatcatttatggcctagaatattcagcctcaaacaataaaatgtgattatagacctcttcaatataattttaaaacaaccctgtaataactttcctccatacagattactagtcaccatttacatttactgttcatcttcatatttaacttgaccttgtgatggagttttcaaaggaaaatactttttctggcacctatcactaaattaccaattatattctgaaattgcctgtgaagtttttcttgttgtataagacaggagtattacagaagttgatgtcacggaccagctatgaaccactctcctataaattggatattagtgacatattaaaaaatcacactgatgtactacttgccctctactaaaaattaacattaactctattcagtaaattattcaaatgtaacacacacagaattatcaagacatactatgcatttttgatttgtgagagaaattccattgaattctacctaaaatagagagccaaagcattgtactgatttatgaggtcataattgtgatctgtagctacattatgaaaatattattttgctaggatagttataaaatctcatacctatggtaatatatttgtgataatttgttggcatgatacatgaacaatacaccatggcttgggttttcttttttttttattgatcattcttgggtgtttctcgtagagggggatttggcagggtcacaggacaatagtggagggaaggtcagcagataaacaagtgaacaaagttgggttttctattaacttattttatgagcaagactgaaagaagtttaaaattaaaatgatagggatttaatcatatgagcttaaccaaactttttttttcagttaaaaatactgaccttgttgaagtgtcaagtatttgatgacctgaagtcaatagtaataatttaaatacctaagaaaaaccaacgcgaagcaacttcctgctatatcaattctgtgaattcctgtgatcttttttcaaaattcctttcctttaaatttcacattttagtaagtatcctctaggaatgataacaaaaatggaaggctgagatactggtagcctgcaagttatagactttacaaatgtaatattcctccgttgcacctgatttaaacctgcatcaccttcacttacaactaaggacattctgatagaaagggaagaaaacattatattagcatttttggtgctttcaccaaaatttcactgtaatttgtcaaattatataaggcctttgtaaatctggcttcccataattttaatctaccatgtcaccttgtgtaatttcttgatgataaagtctggtcctaggtctgtaaaaaaaaatgcaggaagaattgctacaacagtagctacaggctgaggaagtagtgacaacgtagcctatcaagtgtgaaagaagcaataatatgatacgtttctcgcagcttaatctctgatgttaaattcatgtgagatttttgatatttccataacattcataaatttttaagatcacttagctagtctaacatactaaatattttatcttggtacaattctgtaaatatttgttgaatgtatactaaatgcaaagccttttttaggcaacatttgtggaaaaggtatgacaaaaattctccctcaatgtttttcatttgagtggtagaaaggtttatataagcatcacaagaccactttatagaacaactgcagtagatatccataaaatgtcattgaagtcctaagaagtgaaagataaattcaaactctgaagattaaagaaggttatataatggtggtggctttcaagctagaggttgtataggcttttggagcaccccagaatagggttgaaaggacatttcagatttagcaccagcataaataaaatcacgtaatcatgatcagctttgaacatggcaagaatctcgtgtgactcagatacaggatataaaacatataggctggggacaggctatggaagaccctaaaccccaaaattggctgttatttcataagcaataaaaagtattgttctttgagcttggggcggggattgcattatggagtttatgataaactatcttttggtcatggcacttcttaatttaatgacatgtgataactctaagttgcctgcagcatcctcatggctcagtgctaggtatatttttgacattcaagtgatgtttattaaataatcggaacttaatttcaccttctaactgtttatctatttatctagctgtttgtctaccgattccctaccttgcattctagtctctagctattgtatatcattctatatttcttttaattattagcttacattatgcttttacgtattcattcattcattcattcattcattcattcattcatttatttttgggtggtttaacctcatcctttaagaagcttcccttggccgggcatggaggctcacgcctgtaatctctgccatttgggaggccgaggcgggcagatcacgagattgaggtcaggagattgagaccatcctggctaacacggtgaaacctcgtctctagtaaaaatacaaaaaattagccgggcgttgtggcgggcgcctgtagtcccagctactcgggaggctgaggcaggagaatggcgggaacccaggaggcggagcttgcagtgagccgagatggcgccactgcactccagcctgggtgacacagtgagactccgtctcaaaaacaaaaaaaaaaaaaagaaggagcttcccttgactaactgagagtcgtgtactccctctgggattcgcacagaatcttctttctacccgtttcagtatgtttaccagttgtttttcctcacgagactgcaatgtcactagattgtgagtgcgtcagctaaaattcattaatctttatttcctcatgccaagcacaatatcaacactacagaagtacttattgaattggattgagttttcaaacttaatatagatttaatagcacttgaacttatttttaacataggatatatatgacacatgttacatataaatgttatggaaaccatttatctatcggatctcattttctctgtaatagcgtctaaagactggtttcaacttcacctgtgcatatgaagcaaaatatagtaaatcagagagtaatatttgtaagacacaagtgacccatgaatgcaggtggatttcctgttcttttctttgtactcaaagatatttttcttgacagaaaacccttggtttagtttgtggactgttaattgtaaatttaaaggagaaaaatataagcactgtgtaggggttgaatttcaaatatgatgttttttgaagaatcatagtgaaattcttatattctaaatgatatattgataatggacacatgacattagacattttgttctttcctattattttgtttttctttctttctttctttctttttatcaagactgaacaggaagctgtattggcaaccaccacattgggtgggattcagaaggaggtgtaccagaaaggagtgaaaacaaagattgctttggtcttttttaaaggacgaacacactagctggtttatagtattattcctccctgaaaaaagtgggagcccagggggggagttgtctggtgtttcggctagtccgtcttttagccctgcagactataatcatttttgtattctttgcccttaatgaaataattgttatatgctggaagttagtgattgccgttttgggtagaatgagggagttttactttgaaaaaaataaattagtaatggagtggcagggaagaaaagacagaacagcttttctgttttccggtttggattctgctagtggctttgctgccttgcctgcagtgatgggtattgccagaacttagggaaaaacaaagcgaaaatggcaacatctcttaggaaaatctgtaagattgtaagaaggctgggtggttgtggggagtgtgagttagagagcagatgcctttggtctgagtttcagtcctcacagtctgtttgctttcttgctttgaaatattttttgtttctacctccttggtttacagggagctggggaggctcgtttttgttgttgttttgaaatgtaagtttgccaacaagtgaaacagaaaataactgctgtgacagacatgtcccctaagacctttgcttctaagggaaacacctcagcttcatgtgtaaaaacagagaccccaacattggaataccaaattctttttgtctgctgtgcaatatgaaaatgtaaaattgtccctttggatttttgacttttttttttttttaaagatcatatcaactttgaggtcttagagcaatagtttcactgctgccatgatttgcctttcatagggcgtacattgtgctagtgctgaacagctgctttaaattctacttatgaacggaaatttgaggttttaaaaatgctcgtatttaatcatgatcagacctcttctgattgatgcactgctcctgttgattattttgtacttctttattaggcttccttggcagcacagggactattctaacttgggttcccttgagagcatattaggtggattatgtaccagtaattgttttaactatatagatggaataattattttggatatttggacagtcactcaacaaatatttcatgtatcagacactgtgttagcccaaagaatatagaaatgaagaaaatatacatgatctctgtctcataaagtttatagtgtaaatagtagctttatctagttatccattaaaaattttatatgcccttttcataatacttgttcttagccattatcactattattaatagaccttgtaaacaggatacttttgttttgaatcatgctattttgcatacatatattatacaaactgcttattttggaggacctcaaattaagtaactatggaaaattcaggactaggtaagatttttcagattttctccactaacatacttcttttctcccacttatagacagttttggcaagcatattgcataaggagtaggtccatggataaaagcaatggtattcttgttttcttttagctcttcatgagaagattcatggaaacaatgtcaagaagcttctacttccaattcatatgtcatctgcccaaaagttgtgattcctatactcaacttggacctaaatcaaaatgggaaataagataaaagaagcagaagtgccagtagtccatgctgggaattttgtcttagagctagtctattactaatctagagagtcatctatctaggctaccacattttcataaagattgtaataggcagtcttaaagtttgtctcttacttgaaatacaccaagggccatcgctaagtgaaatacaaacaatatcttagaattagaaaatgacttcaggtaaattaaaagtaaacaaaaggcaactattattaaaaacattcttttctatcgctttttgtagaaaacatttagttgtattgggaaatttctatttcgaagtttattaaaactaacttttgtggggttttttttagcagagattagaaaaggttttcagagaagggaaaatgccataagtgagtagacttttaggcaatagcgctgattaaataaatgccgatgtttggcaataggactgtggaagatagatgagatatataacagagtctactaatcctgtttacaggattttctgggacagtttcagtgtcaaatataataaaaaaccatccaaattatccaaaagtctctccattttggactctgtatttttcaaactgtctcactcattcataactggtacaaatatatttgccagaagatatgccatttttagggttatttttgtaaaagatagtttctgtctgtaatgcacttcagagaaaatctccagtagaaaccatgtagtggctaaaagcatagactgtgaggtgaaaggctcagggtcgaatcctgccctgctactgaagttgtgggacttcaggcaaatcacttcacttctgatccttggcatctcctgacctccattccttggcttccttggccgtaaagtagagataggaatagtactcactggcatggtggttgtaaagatttgataggtaggcaggtaaataagtagatagccagatatggacatatagctcagtgtgatatcttagttgctatataagtattagctgcattttattaccacatttagatgaaagaactatggctgaagtgacaacaaataccaagatattttgagatagttctaatattgaatgtattgttactgtttaattcacattaaaccaaaggtcacaaacttatgtactggctatgggtgtttcttgtttttcttttgattatactaacattaaaaacctggacattcctcataaaaatccagatttttggtttttcatgattgtatgagttagctacatgaaactaccaatttcacctgcaaactgtgaacctcagtgaggtcacaggagccattctagttggggcacatgctcaggtttcttcagcttacctgtcacttaaacctccccaccaccccaaacacacacatgcacaatgcaggcatttgctcagtcatcttcattactcattgatattacctattaattacctttcagtctctggatttttgtgattttctgcaatgtgacctgatttttagtgtgattttttaaatacaattttggctgtttggggtaaaatggaagaattgggggccatttttctttctttctttttttttcttttttttgaaatggagtcttgctatgttttccaggctggagtgcagtggcacgatcttggctcactgcaacctccacctcccgggttccagtgattctcctgcctcagccgcctgagtagctgggattacaggcatgtgccaccacgcctggctaatttttgtattttcagtagagacggggtttcaccacgttggccacaatctcctgacctcaagtgatccctccacctgggcctcccaaagtgctgggattacaggcatgagccaccacgcccggcccatttttcttatatatatcagtccctgaaatataggcaggtaaaatatttgaaaggcatggttaagtatagcagaactctagtatatgccaaatccttacaactagaaaaataatcaacaaataaagaaccatattcattacctgagatgagttattgggcaaaattttcgatctcatttttagttaatcctaaaatattgattattgctagcttcaggtattttaactagtaatttaagacttagtcccttcttagtaatagaaggatatgtgacatttggagaaaagagaagatgctaaaattgtatgccgttgttaccccgaattagaactctctaggaaccatgtcctttaaaatactttgactaaacgaaaaaatgccagatgaaagacagtaaaaattacttatgaaatggaaaaacagagttaaggaaaatattacagttgtattgttagtaggcataaaacatgcatataatattctcatgtatctgtctacatacataatatataaatacatgctgtcttagaggaagaatgaagaaagagtaaacatttcaaatctcccatcagtcttagaatataactcatataacctactaccagtttttgtagtctttattttatgaaatgaaggaacgtatactgtataatttataacatatcacattcgttaccatatcatgaagaattactcataattagtagatacccaattgatggactgtcttgaaacttcttattcataccattataatttccatttcccaacatgttgtacttttaaatgagacccattacattctgttgctaatcacaatatataatataataaaaatattagccaatcatacccacttttcaaaaataagagtaaaatatcagcagtaagaggaaccagaaaggtcgactagtccaaccttttggaggtatccatgaatcctctatctagcatttctgataaatgatctgttttgtgtttggatacttaaagtgttgtggagcacactacctgttgaagcaagcaaaatgccatcattttgactgctaaagggttctttttatttttatttattttcttttattttttgaggcagcgtctcattctttcacccaggctggagtgcagtggtgcaatcttagcttgctgcaacctctgcctccccggctcaagcgattctcttgcctcagccaccagagtagctggaattaaaggcatgagccaccaggcctatccattttttgtttttgtttttgtatttttagtagagacagggtttcaccatattggtcaggctggtctcgaactcttggcatcatgtgatttgcccgcctcagcctcccaaagtgctaggattacagacatgagccactgcgcccggccagaagtttctttttaatactgagcctaaatgtaccttctctcaataatgcttttaattattttaaaaaatcttgtatctctatatgtaaatctattgtatattatatagcattgtgattatctgtttatatgctagcctttacaagatagggcacctggtacatagtagaccttcaataaatattaaatgaattaaggaatagttcaggttctgtcctctaaaaccacataatataaatacagaaattcctatgccatgccatggttacctttcaacaattttcttagatgtgtgtagtgagctgtgtgttctgtatgtaacacaaaatatccatgtataaaattttaacggttagtttttttttagatattaaaaagccctgatagaaattccataggcagtaatcaccagatgagttggtaaaaatatttaaaacctagactttactggtagcttctggattgatgcccatgttgatactgaattgggaattctaatattacattccttgataattccctgtgggtttctaagaaccggaaaggctacattgattatttattataaaatacattttacccaatgtttgcaattaaaacaatattggtaacattgaagtataaatttcccttagattatagttctttattgtttcttatatttatccacattatctccaaaatatgaatgagggtttacatttcttgacagtacacccacagcagtgcttattaagtctgaatagtttctatatactccatgagctgaggggagacagtccatatggcaagtaattggtggtgtttaaactatctcgacatcactccattttgaagtagctattatttcatcctgctttttgctgatagcctgcagaaatctacctggaactgcacattttctattgattttcttttgccaaatgattgatggagcattctagttcaattgttttctcttggattgtgtgcggttacactcctttgttttcaaacattttattagaagtataaaatatttctagatgaacaacatggtcattttgggaatgctgatggccaaaattattgatgatagtgtgtaagaaagagggtgaatcaactatttcagtagctaaatagctacatagattgaaaaggaaattcttactagtttttcttttttcattcttatttcttgtgttagcttgatttttctggtcaaaaatcatcctttttgggtttaacctcatggtcctcagatggctcttcaaaatgcactgtatcaatctaagccaaacttaagagtttgtgattttttcttgcaatgctagtgcagcaagttcagtgatacaatgcacctgtgtcccacatttattctttacaatagacacccatttctttgtctggaagtcttaagtcctgcacatagaatgagggaaccactgtttatgtgaatagcagtttcgaatgaaactttcacaatgactgaatcttacaataacatgtcctactgtccttgattttaaggagattcagcatctcctaaagaagcacatggtgggaatttcttttatctatgttatttggaaataaatgtcgtgtagcaaaaaaccatattctgaattcctagtaatgggatggggttttggtatgttggtagtaggaagactattagtatagttctcggtgtcattcaagtgatttgttttaaacttaattgaaactaacgttatttgaaggcccaggatgcttcagagccagttgtaagaacgtgattactcacttttctagcaagattcagaaatcttagcttcacaccacgaattctaagtcttattttttaaattcagaagtaaaatttttggctgtataaaaatattaaaataactcttgactccttttcaaaggtccaagtatattaaacacagatggcttctcatagctaattagattgtgtcgtatcctaaccttaactatggtttagagctaagtggtttaaatgatattcaattcaatttcaaagaacaacagcaataataatagatagcatttattcagtatgtatactgtttgatttggtgctacatgtttctatatgtactcatttacttccctaaaaatccataaataatgtactacttatgtttcctgtaatgggaaaagggactcagagaggttaagtaacatgatcaaggtcacagaggtaggaaagaacatagctaagactcagtctaggtctgtctaatcaaagcttatgctcttagacattgccctcatgcctctactttgatttattatgctttatgttaggtccttcattagattgaaaaatgagtaatattggttttggctcagagtttacaatccaatagtaaactcactttaattttggttaaagagtttcttctggattaaacgtctattagatgggtttcagtaatggaaagaaagaccagaaatgtgaggttttgtattttcatctagaattttcaagtacattacttattataataaaaaagttaagctaaatttggaagaagataaaaatgaataaatgtgaactactagtacagaatttaaaaacaattactttaattaataatgagactagtaattgattttttaaatatccaggtccttgggaatcagtaagctcttttgctttactgcttacatttacatattttgttgttattattggtatcactcaaatgtctgtgcctcttccctctaattcacttctttctcctctgccgtgatagagatgaaattatttttaaggaaataaaattgaaacacttgcttctagatatacctcaaggaaatcctgatttctaaattggtttgaagttacttgccctggtaaatcaatgtctatttaattaagcctatgttgcatggccataaattaattccaactactattataactggaaagcatcatggaatatatcatggtatattaattgagtataatgttctacttttataacagtggaaatgtatttgtaaaacaactactatgaaaaaaatttagaaaaccatcagcttatccattttacttaccctctgtaatgttttaaaaaaaaattagacttcattatacagtgagcaccaacaatagttgattttgtaggaaatgaattaatttagggctctggagatagaggaaacagatattaacagctaataattattattttggagattattccagaagttgtttgcaaaggttttaattccttcagaagtttcctgtgacaaactgaaggttgagttacctttccaaagctttacctgggttaacaaggatgaaatgctggatcagaccactatagactaagctattggataataaaataacccatattatcttttctaagcatataaatgaagaaattagtaacaattatataaaaatttataatctttcattggagttctatgggggaacaagatattgtctgttctacgtaaatattagtaatgaattgtcaatctattcagtgcttgctttctttttttttttttttttcttctgagacagagttttgctcttgttgcccaggctggggtgcagtggtgcaatctcggctcactgcaacctccaccttctggtttcaagagattctcctgccttagcctcttgagtagctggaattataggtggatgccaccacacctggctaatttttgtatttttagtagagacggggtttcaccatgttggccaggctggtctcgaactcccgacctcgtgatcctcctgcctcggcctcccaaagtactgggattacaggcatgagccactgtgcctggcctattcagtgctttgttttagaacagtcgtcaaatatttgcctatgaggagtgtaaaaagttgatgtggcaaagagaaaaggagctaaaaaaaaaagaacttaaaaaaagaaaagaaaaaacatgtacctaatgtagatctaacaacaatgttcaataaaagcttgtattcaaataaaagcaatagaaatgagaaatacatttttgattctttggggaaaaatccaatttaaagcatatatttaagttctttcataaaaaaattttatatttgacttttaattaacaatgaaaatatgataatatttggagcaagtctagcgccaaattctagttcagccactttctaactgtgaggctttatcatcttaggtaatatctctgagctagtttctatcagtagaatggacgtgataatgtgtgctttgtagttttaaaacatattgctttattgaaatataattcagtactataaaatttacccacttaatgtataattcagtagattttagtattttcagaattgtgcagtcatcaccacaatctaattttagaatattttcattactctaaaagacatcttgtgactattagcagtcgttccccatttcccctccccacccccataccctaccctagacaaccaccaatctactttctatacaattttttctattctggacattgcatataaatggaattgtagaatatgtagacctttgtgaatggcttctttcacttggcgtaatgttttcaaggttcatcagttttgtagcatgtatcagtacttcattcctttttattattgaatcatgttccattgtatggatatgccacgtattgttttttcattcatcatttaacagattcttggcctgtttccactttttcgctattatgaataatgctgttatgtacctttgggtacaagcttttgcatggacatatgttttcaattgtcttgggtatttaccaaggaggggaattgctaggtcatatggtaactctttagaaactgcaaactgtttttgaaagtggctgcgctattttacattcctaacagcaatctttgatggttccaatttatccacatcttctccaacatttgttattgtctgtcctttttattttagccattctagcagatgtgcagtgacatcttattgtgattttggtttgcatttccttgataactaatgctgttgagcatcttcttatgtgcttactgatcatttgtatatcttctggggagaaatgtatattcagatccttttctcattttaaaaatggattatctttctattgtaagtgttgtacaataattccatgtatataagtatatgcatatatatttatatataaattatcaggattctttataaattctgggtgcagttctcttaccagatatatatttgcaagtattttctcccattctttggattgccttttcacttcattgttagcatcatattcagtgcaaaagtttttaattttaatgaagtccaatgtatctgttttgttcttttgtcacttgtgtgtttggtgtcgaatgtagcaaaccattgcctaacccaaggccacgaagatgttcttctgtgtttccttctaagtggtttatggttttagctcttacatatatgtctacggtccaatagtgtgttgttttggtgaccagaaataatacatggaaagcacctagaacagtcactgttacatatcaatgcataattagtgggagtcattcaaaccactttgaaaccaaagttcatgaatatgtactagaacctatctttaggtctctctcacatgttgttcttactgctctgcaaggaactgtaaggaataaaaggtatacatcatttaaaaaaacatttccagagaggttttaatcattatatgttattaataagtcatttacagtaacaaaaatgcaaagacatggaagaaaaaccgaacaacaagtttgagcagatttaaggctctgctgttcatttttgtaagtttgttaacatgaagacatgctgtagtataaacaaaattgactctctgggaaatatattgaaattgaaaaaatttggcttatatttcatgatcattttaattaatatctaacatctcttgagatgtcacagaatggtgtcttccttagtggtttagttttatttttcaaaataacatttttttggggttttgtaagtattggatagattatccacatgtatttctggaaagttaagtaagtattttaaggaaaggcaaggtgagatgtttatgatggtaaggaggtgagtttaaatattgttcccttttgcaatggaatttttttttgtttttcttctgtatttcacttctgtactatgatttgaatatgacattagcaggtattatttattatatgctttgatataaaatatctgtttcataagaaaaaataataggaagtaactactcaattacttctgaaagtgggctactacatgaagcaagttagaataagagtagctgttgctattgtagctaaaccagctgcgaatgttgtgaagaggtggatctgaaagcaactatagataatagtttactctgaggagactatgttttctgttataaatatacattttatgttgaatagaaaaatacacaggttggggaagaaatcacattttaccccatctaaaaaaggataatccctttagatcactgacaggacagtacgaagaagacttacactgcagctgcagaagtctttggataaatagaggatttaataatgttcaaatatttgtcccaacctcaaaaggcaccctgaaatagaactaacttaacagatgatacagctctctccatataggtctggtggctcttgccctgggatttccttgggcatttattgtgttttgcttactaactaatacagttatggtagctatctttgggggattaggcttcagtcctctataaataatgtcagcatagaatgtaagagtgacaaacttgaaaataggaaatgcgtatttaaacctgcgggaaatcttccacatggtttgatgttcttggacacatgagagctaggattttgaaaggattaattagcttagcctaactttccttcaaatttcagaatcatatcttacagttgctacacactttgagtatgcatttagccaactccctttgaaatacatattctacaagaaacatattctttaaaatgtaatttatatatcctagatttcagcactcattctacctctattatatgtgctttaatatctttttaaggcatgtatcattttctagagtccttagcataaataactatcttgaaatcaaaagttgttgataatattttagtaaaaaaggaatccaaagcaagtaagtttatgtagcctttaaaaatgttttcagggaactgtgtgtggatggtgtgatggagaggaaaccagtattttgagaggtctttaaatgatcatgcctccataaacttgccagcagcaaaaaacaaaaaacaaaaaaaaagaggatggaagtagaggttggggtggatttggtcccctttggaacacaaaggtctttcagttgtcggggattggaatgggggtgtttgggtagtggaaaaaaaatgttctagcatgtggtaatgaggttaaaaaaaaaagaaaacagcaatggatgattacttttctccatcaaggcttctttatcctcataagctcagacagtggtcagcatgttagacacccctccctgttttatccatcccttaactatgttctttgacaggactggtttatacagctgggcctttgttaagctaagggggaaactgtagagaacagcagaaaagatggcagactgagtacctataaatggtaaatggtaaatactgtattgaagtgcaagattccaacttgaaggttttgcttttatttgattaagtttttcttttccagatttgtaaggtgaacacttttacaatttttgtttcaatttttgtactgacagattttgtggtgatatgggtaaattgattgtgctaatcagtaaaatttcttatggctatattctaacaaatgatgagaatgaactcagttatattaccatctaaaactagatattcatattatagttacagtgtttcagaaaacacctccattgtatgtgccaaggcatagaactgattgaaaagagaaagcatacaggaaaagctatttacttcaaaaggcttatctctatgacgtacttttaaagtatgaacaaatgggaacttaatagtaatattactgttagccctgtttgaaatataatgcaaatcttgtgctggggtcttattgtgtgtttatacttgtcataccattgctggagtttgatgattttcttctctgcagtatatgccacaacctttgaatttttattttgggggttagcattcctaacttgcccacagtggcagtatgaaccatgcttttaaactttttttttttctaaaaacaacagggcatgtgctaaaactagaaagattaatggggaaagaagataaacagttaagacataaaatgagtttagaggtcaagctagaaaaataggaaagcttatggatttaattcatattcatccaagcaaaggagctttggcatgaaaggagccaatgaagaggctcagcattcttgtaacatcaaccatagctgcatcccgctgttttggagtttgggttgatagatgctcatcgtctttggcactgcacccttacttttggacttttcctaattaggatggcatattctttatttttgctgagaagttcggaaaatttatctctgtctagtatgcctgtctctcacatcagaagctgttgtttgagaaaagatttgtgcactgtatatacgttccttgctgtctattttgaatataacataaatattttctactttgtacattttcaacagctgctgtagaaacaggctgtaaccaagtctgtatggggcatggaaagaaagagtgagccccctaaattggccagaatttagcaatatataaacgattccttgtcagggttatttggattccaaagagggtagggggtcataatatttctcttcattggactacttagacagtcagttttcaacaaatctgatgctgatgttcagtactcattttagctgtgggcctcctttctcatttctgctggggggaagcattctctggaggttttctttagacggcttaacttgcttgatttcacaatgacctttgaaaacaaaagaaattaaaactagactggttacttaattatttttgtcatcattattagatcctaaataaattaaacatgccacagattttatttcaagacgtagaccatgctaagaataagtcacttttgattatggaacaattcgctatttatttagacttagccagtaatgtgagatgggagggagagagcaagagtggggatgggcactttaacaggaagaatcccagataagaagtcagggaagatgctcaaaatatgtacctaaggatattattttggaatctaaaattttattccctatttgcagttctgcgattgcagtactgtaaagtcccaaaggggtcaaaatgaccaagtcattaaaacaagtaaaatgatttttttatagaggatgcagtattataaagcctgaatagatattctttcctactcgaaacatttttttttttttgcttatgcacctcacctgaccagtgttatccatgaatgaacatccatcttctcccatgatgaatatggtgaatatggcgagctgtttttacagattattacaaacattcccatatatacgcatttgtgatctatgtagacattaaaacactctcataaggataacatgaaaaaattggaattactaagaaattagtaatactaattgtagtagtaatatttaggaattacataacatttgagtttccttttcatgggttaaaaattggaaggagttttctacttctattttcctttaaaatacacaaaactttcaaatagttttgaattatatattattgaaagttgttagcatcagatcatgattaaattaaggtggtgtggtccaacccttaatagacgggttccataaaaaaaagaaagaatattgatgttcattaacatatcattagatagtaaagtttctcttccttctgcttctcctcctcttcgtcctcttcctcctcttcctctaattcctctttttgtctctctctctctgcacgcacgtgtgcacacatacacacatgcacacacatggttgcatatataaacaagacacagacacctcccaaacttaggcctgacaggtttattcaacgatagaacaatagaaatggaattaattcctttttcactaccaattgttctgatagaaagcagaaaagattgtccctgtagcagggattctgcagataatttttaaagataccttattagagatattgagaatgggtaagcatttcacacagtatttttttttttttggctgtctattcggctgtctataacctaaaatttatacatatggcaaccatatgtctcagaaaaatccaaaaggcttctgatttttaatactgtctttatttccttaacccggaagcacactattcctcgttaatcaatttgttaatcaatcctctgaacttttgggtcagaaaaattgtacttatattaaatatggggctttgctttttagtacttcatattattaataaaagatttttacagcctatatcggaagagatagtttttactaatctctagattcttccccacaatcctgtgtctgtcccaggaatggggtatgtggctactctgcttagctttcagacacacaaggagccgagcatctggggaaactcaggaggtgagcactttcacgctgactcagagaccagccgtatgactccagtctggcgctgtcacgcctggttatggaaaggcaagaacaatgcctcccttgagaagggggaaaaaagtctagtgcagtcacaattttgatgtaaaatttaaatcatccctccacatcctgtggacttagagctgtcagaaaggcaaaacccatgctcaaatggaaaaagctttttatttccttaaaaagtatacattctctaactataaataaaaagttctagaatcacagatcttaatgctagattattctaagtaatttatagataaatggaacaaaaggactttgacatttttaacctgtagatggctgaaggttaaacatatttttcagtttgcgattaatgacaaatgtataacaatacatgaattaaataatttacaacaaaatgctcctattggacttgtgttgttttctcccaagcttaggcatttggtcattttatctataacttaaaagaaatttctcttcgatacttaaaagtcttaatcatttctattatttttcttcaagtgacttgattgaaatgtagaatctttgatgattagagagactctgtgaccaaatgttttatctcagataaaggtgtttctgtttttgagataaggaaataaaattattacaatttttaatgatcgaaggtaaagttaggcagaatttttagtagaacgtgcttattaccatactctttcttgtaaatcatgagaaaagtattgataatttttttcaaaacaatatagaattatgttaaaacatttactacctctttttaatgaaagcacatttgtacataggagtcacaaatgttcctgtaaactagttttccttcagttttgctgtatttatcacaattaactctaattaatctttttcaagtattaaacattataaaatgatttcagtggagtttaattaagtattttttcttctgttttatttatcaggactactgttgctttaggcacatagtaagtatggattaatatcaaaataatgtaatgaaacagaaagacattttaactggcagatatacttgtttagataaattttaaccctccagcccagctattatgttactcataataaaacagtcttcttactagaacattttctgggtgtctccagccaataagacaaagcctaattttggagtaaaattttagtgatttacagttattagtgaagcactaagaaaacaaggtagcaaaggaagacctgaattgtgatttctgaatcattgtaggatggaatttggctgccataaactgtttttaaatgtttgtctccctgtttagaaaaggatagaacagtggaagtggaattaacaaaacaaaaatggacattttctagttagttttcctgctcactttaggtacattatttcaaaaacttttaaaatattctgtgtccaactagtagtaaagaagcatttatttctttcagataatgacaagaatcagattctatttctgagcctttccttatttatcttcaacttgcttttgtttttcttttttcattttataccatttcctgggagaaccttgtacctttacattgttttgcgcatctaatcctcccctccatctctgactttggtggcacggaagaggctgggaaaagctatttggtaaaagtagtgatgctagcaaagagaagagcaaaaaggtggtgaagaagtgaaaagtgctgctcttcttatcagaaagaaggaaaggtgtaacgaagtacttgatctcaatgcagagaacatctcagaaactaaacatgtggcaaggtaaacatagggggcaaccttgatgaagatcacttcaaaagttgttggtgaccacatttttgatgaacatgtttttaaatacagtttgaacttttgtaatgtataataaaatattttgtataaactcagattatatttaaatacagaatattaatttattcataagtaaatatagctcaaaagtagttttgattttagatttacatgttatggtaaattttgttgatctctactctggtgaaatacatagtgaagattacaaggaagtttatcttttttattattctatgttgtctttttctatatttctttgaaatctgtgtttctacttcaatttatattttatgccaggacctgatgaacttgttcatgccgctaaataacggtataatgaaccaggtttttgtatgtgggaagaaatgggtagagaagtatggagattggcatgttctatatcagaaactgatggcaaggaggatttagagaaaagagaagaaaaatggtataaaagtttgaaagactgcatgtttaccataaataaatcttctatttaaaggcttctgaatattatatatgacagacttggttataaaaatttacatggaatgctcacagagtaaactctcaacttagaaaaataaagatgttcaaaacatgtaagagagaaaaggaaagcatgaactataagatataataataattgaaattcatagataagagtaatgaaattgatattttttattaaagtgatatgctaagtttgtgtaattctgtttatgcatcaaataaaagtgtttgttgtttcattcatttgaattagaaacctttctattcaagctcaatgtatgttttgaattgccatattggataagtaacattctattgtgaaacaatctttaatacacagtaaagtttaattcctaatattgattagccttttcacaacaaccttaattacaacaggaaccagacaagtaaatgtaaatgtcctgaacaaatagtcttgctactcgaaaaacttaaggcacataacttccaggaaagtattattctctttgaattgccaatttttattttgctttgcatattcatattcagtgttcccttcagaagatgcaatctattaaatatttttaattaaaagagttttttttgagacagggtctcactttgttgcccaggctgttgtgcagaagcactatcatagctcactgcagccttgctctcctgggctcaagcaatcctccacctcagcctcctgagttgctcgcactacaggcggaggccatcatacccggctaattttgaaatttttttatagaaatggagtctcccagttttgcaggctggtgtcgaattccagggctcaaggaatcttcctgccttggtctcctaaagtgctagaataaaggggtgagcaaccacaccaagccctctgtgtctgacccattcttcattaccctgttgaattattgtattttctgggaagcattttctgattagtgagatatcatctattatctatctatctcctgtagcactcatatttttaaaaaggcatgcaccttacaatattctttcttgatttattaattatgttgctgtctaacgggcacatagtatctttcactaaatgtttttccactaatgaatgaataggtggataaatggatgagtaggtatatatttcctgtttccatcagaactctaacttccttaaaggtaaagcagaagggtcgtcatatcttagttgccgtgttttatttatgacacaaaggtaacttgcttggcataaaatagggactcattcaattcgttaatttatttataaaagaaatacattgccaactatgtgctaggaattatactgccctattattaattgtgtctcatttggtgtagaggattagaatatttgggaaaacaaatgcagagcaatttgcaaaggactttatcatacacataaagtcacatcctttgcattaattttggtgacataaagtgaaatggtcaaaaacagaactgtacttgaaaaaaatttacatgaaagacacgctacatgatacaggaactgaagaaattaaaaatgacattcttgttttccagatgcttctattgtagtttcagatactgtatatactaataaaaaatgtttaatttttttatgcatgcaactgaaaaagttgatgatatagtttgagattggacaatgttgcttctgccatggtggtaggaagggatggctttgtagaagaactggaatttgagtttcctctttctagatatttatttttgcaattttttatatataactgcaaactttaagataaataatattatcatgccgaaagaacaaccagtagaaggcactgcatcctaggattttaatttgtgtattatctagtcaaaggttaaaatatttaaagaaagaaacttaaaaaagaatgtactatataaggaaagcaatccctattctgagtctttcattttataatgttccaaatgcagaatatctttaactctgtacatgtcattttccagaataattgtaccaaagaacatttcctaaaagttttttttaaagtttttagcagtaagtaggtgatagctcagtaataagtctattagtagttgactatgtagtgcttattggtaaacttacttaactcttataatcttttacttacacatgttaaataaagataacatttttaactagagctataatatttttctcaagttttttgaaaacattattagagcttaccaattcctttatgctgaaattatttaaaaaaggatactgttattgaactctattttcttatttctgacaatactgagacatattcgaagcatacttgtcctataagatttaatcttaaagctatacctaggtagggcataatcagagggttgctggttttagtagctattcatgtaacatgtacactggaagactattattttcagaaagggtctaagtactgggcaagtagctgtgaacaaaaatatagtctgcctatgtggatctcatagtgggagagattgaccataaacaaataagtgtaaaatatatcaagtgattataaaggctgcgaacaaaatggcgtaaggactaagaatggaatggagtgcaggtttaggacaaatgaccaaggaaagccttactgaggaaataacgtttgagcagaaaactaaatgaagagaggaagaaggcaagcgttatgtctagggtaggaggattccagactgactaaaatatcaactatgaaaacaaagtgcttaaatcaatgatatattattaccttttttattgctgctgtaacaaatcatcacaaatatagtggcttaaaaaatacaaatgtattcttttacagttttggaggtcagaagtcctaaaatcaaggtgttgtcaggtccacatttcttctagaggctctaggagaggatctgttccattgcattttctagcttgtagaggctgcctacattccttggttcacggcctcatcttccatcttcaaagccagtagcatagtatcatccagtctcttcctctgactctgacttttcttctccctcttataagggtgtttatgatttctttggacccaccaacaatattcagaataatctccccatttcaaatttcaaaatacttaatttaattacacatgcaaaaagtcccttttgacatgtaaggtattaagacctggacatcttggtttggggagcattattctctttcttctgttgttttttgtttgtttgttttgagacagagtcttgctctgtcaccaggctggagagcagtggcgcgatctcagctcactgcaacctccgcttcccaggttcaagtgattcccctgcctcagcctcccaagtagctggaactacaggtgtgcaccaccacacccggctaattttttgtatttcagtagagatggggtttcaccatgttggctgggctgacctcgtgatccacccatctcagcctcccagagtgctgggattacaggcatgagtcactgcacttggcctgggggtgggcattattcttactactacaaattatttgcaacattgactgtgtattaaaatcatggggagctttaaaaatttctgatacccggtcaccctccagaaccaataacatcagaatttctaagggtaaaacccagggatcagtattttttaaacctctccaggtaattccaatgtgcaggcaaaggtttagaaccactgctttatctttctgttgcagtcttacaccttctaccctaccactaagtttgccatccatgtctgaacacattggagacagcctacttgcagagtgattataaggcatatggacagccttcagccaatagcaaaagaccccagtagttttctatttactgtcacatttatcaagagtagcttaattatgcaggatgctacaaggggaagtaaagggaaggagactcctgtaaaagcaagttgctttttacaagtgagcatgtttcttattttgttcatgtaactcagcaattccaggagtgttacaggctacatttgggatttgatccatattcctcaatctcttctttttttcaagtaagcttgaaccctaaatttatataatactttctaaaagtatctctgcatctttgcttttattattacttcctatatgaaattccctgtctatttatcctcaggcttttgtttatcctttttccttgaaagtcaactggttcaacaattctgtgaggcatttaaggatactctggtcctcaagaagctctcagatacttagctataatgtcatttgatctacggactgaactgtctttcattagtatttattcttttatttaaaatattctcaaccagctcataagcttctttaaccagaggccgagaaataggttttttattcccattaaataagtgtcttgcacatggtagctgatcatcaaatagttgttgatgatttggaagattttgcttgtgccttaaaattagatgtcatttctttcaagaaagttttttgaccacaaagtgagctaagaccagtgttacgtcatcatactccccaaggcagtttcacattagattatatttgtctgtcttatgtcagtttctttgaagtctgagttttgttcattggtaagcctagcaccacagaagtgataaaaatcatctctaaaggataagagcatacgccagcctagatgctcacattgttacaaattgcaacacagatatgtagttagtgtaagtcatataatgtaagctatataaatatatgcacacttgtggtgcctttttttttttttcttttttttcagacggagttttgcttttgttgcccaggctggatgcaatggtgtgatctcggctcactacaacctctgcctcccaggttcaagtgattctcctgtctcagcctcctaaatagctgagattacaggcatgcaccaccatgcccagctaattttgtatttttagtagagatggggtttctccatgttggtcaggctgatctggaactcatgtgatctgcccgcctcagcctcccaaagtgctgagattataggcgtgagccactgcaaccggcctgtggtgccttcttaatgagacttttttctgcccaagtgtttcaacactttgatagatggacaaaaatttaagaatctaatgttattggtgattttgttgtcaatatttttgagaagtactatgggtcatagtaaacatgaataatacaaccaacagattgatatatctatatgtaatttgttatatagtttacttttctgacttagtagcctattattgaagtataaccgtggttgcttttattataacgatttaacaaatctttaagcaatcttttacctgaattataaatactttcaaggccaatgcattgagaacattctataacactctgaaaatggaattgaaataagtatgaaatatgtgacattctaggatcagttgccttccggcatcatgacgctttcacgttcagtgttataaaccttaaccttttttgctctctagaatgctatatatagagaatacacactcagttaaatagaaagttaatttaggttttgaaataaccagaagttttgataaaactatcaatgtcttgtcagtctaccttaacaacctgtgtctacttttggactttcagttttcataattgatgttaataatgatattaataaagtagaaatcaacagaaaggtcatggttctgaaggtcatagaattgtattaacttaggaaaggctagctgatcttgctttctgctttcatgactcagaaactggctcttgtcaatagactagagtttttagacattgagagactatacatgagtctgaggcagacaccagaataccagtgtattaattccagtaagaatgataatgcccactcagaccacaaatgctaacgtttgtataacaaagggataatctccttatagtcaagctacatgcaaaactaagaaataattaaaagtttccttattagtttaataaatcacttcacaaagaccttaaacatttaaagcctgttctgtccacaaactctttacatgagaatcagaagtttgcctgtagaacatcgaatcagaacagtgggaattaaatatctctagtgtcatgggttattatgttattatgtaatatatcaatttagtgtgtgatatggtattgccaatgaaactagaactattctggctttgttaactccagctcctcacatgcttctccatacttagagtatacttggaataggccttgttcatgggattggaaatagttaaaattacttgaaatgtggtatccaaatctacttctcctttagacaatgctgacatggtagctgcccctatttcctcctctttgtctgtttctttggctgatcaacacctgtactattaagattttgttttgaacacttgctattacatctgatcggtttactgttaagtattgctggccagggagcatttatctaatgggaaacttagtattttatgttgattgtatagtgaaaccctttactaggcaatctgttttcctcatgtttgagtgtttttgttttttgagggtgggtgggttgcactgtagttttagtctgttaaataaacacgggctattatatattgactgtgtattctgtgttaaataatacactaattatttgtcacatgatacatagtccattttcaaaaagccttatgaggtagatatttttcaccttaaagatgagtaagttgagatagagaaattaagtctcagctagtaagtgacagaatcagtattttcattccgacttgtctgattctaaagcccttatttttttctactgtcctaatatttttaatagaatatctcctgtacttgaatgcatgttttcttttgaaacttataacactaaaaataacattattcatcaatgattagaggcatttgggggaacacactttaaatttaaaaatcagtgatctatatgaaggaagtgttgtggtagttagtaaatacttccctgcctcccatctcactggtctagaataagaatgaatgattttgtaaacactctttgtttgttgaacaaaaaataacagctttttcaaggtcagattaagttgtaaatactacaagaaagttttttaaattaaatattttaacttgtcattatttctatgggaataatttaatgaaaggaaaaggaattttctatttaaaatatttgccacatatttttaacctctgataatattctgaatcagactcacgtacaaagaaaatgtttaattcttgttcaattatctaagctcattttcatgtagactttagctcatcaaaacaaaatatccttctttgggtttttttcttttatttaagtatcctaaggataaataagtcagaattattcacatctaaatcattcatagagttgtgaaaatagaattgaaatattttaatattctcacctttttttttttttttttactaccttgcaactttgttattataactaaatgcccaaattgggtaatttggggagatgagggaaagaaaattctcaaatgttttaagattaacagtgattgtaaaatttattcaatccttaataagctttaaacaaatattaaactttctgtcagttgctgtgaggtttgcttataaccaatatttctacattttacaataatcttactttcaataaaatgtaaatttgttttaatggcaatcatttatatattgagtctattttttgatgaaagaaattttagttatttctcttcttttaaactgccaacagtatttgctattcacagatgttctgtcttcaataaggtctatcagagtgtaaaactagatgggtatttttcttccctctaaaatggaatggtctttcattatgcagtgttcttaggtgaattctcttgtttaagaagccagaatacaagagagtgctatattagtgtattattctcacaacaaacaagcactgttctgttgctacctgcttggccattgtttctgattgtgtgtgctttgcagtggtatttggatggtttcctgctctctgctagcacaaaaaggcatttctgttacaatggcccctaaccacacaatgacggcattaaggatttatgtggaggtttcattattttctcctcttttgttccttccaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggtaggtttctcatggtttattgtgcctacactcactttttgaccagtctactcctctaatagtttggcctcagtcctttgctttataattaacatctacttaagaacccatgcacaagattcacccctggcgtcttagaattctttaaatttgttccaataagcagcataagatacgctgttttcgtttcttttgtatttttcaagacttcttgcatttgagacacttacaatttaattagaggggaaaaaatatacaaaatataaaaataatgttaaagtaagatatttaaaattattcagcatgaaaatttggtgtcatactttttctaataaaagtttttttttctggtagagttacaatgaacatagtttgaacatttccaacatgataaatcagtgttattctattttttgctttgccaagattggactctataatattccctaacagtacttagaatttcatagaggaatatatttcatagagactatagttttctaatatgaatacaccaatttctaactcaggcctattcacactgttgtttcgttaattcggtaattttttttttttttttttttgcatcctattctggaatatgcaactctggataaatcctctgaccccttatcctagggtctggatcactgtagaagattaggaaaccaggactttgtggatgagaggaaagaagccagcataacatctctggctgcagcttaaacagcacacataaacacaaataagtcattgtggtccttcttagcaacttaaatacatagaatcataatgttaagaaggtagtggggcacttaccaccattaaaggcatcctcaccttttcagtgtggctgcttgggtggatcacatttttgtgactgctccaccttttctactttaaggatgttagtgttgttaatttgaacctgaattacaccaacaaaaatatattttatcttacattctactgcctttaaaggcagctctaattctgctaaatctttttttttcctccaggaaattattgcctgtcataaatatacttagagctgaaatatgtccacttgttcatgtttttgaattattgcatgtggaattaaatcaagaagaagaatcagttatcttctgatagctgtgtaatagatcaatactttgattttcatattagatttaaatattcccattcaacatttcagcctcataggtcaagatttctttgggcatttgacaattccaagatttttccaccaagaataatgttttaggtcgggcgtggtggctcacacctgtaatcccagcactttgggaggccaaggtgagtagatcacttgaggtcaggagttcaagactagctggccaacatagtgaaaccccatctctactgaaaatacaaagattagctgggcatggtgacatatgcctgtaatcccagctacgtgggaagttgatgcaggagaatcgcttgaacccaggaggcagaggttgcagtgagccgagatcgcaccactacactcgagcctggtgatagagtgagactccatctcaaaaataataataataataatagtaatgttttagctaactcatatgtcagacatatagaagtggtgttgatagcacttcttgatggtataataactcatttaaccttcacagtaattcagtgaggtattattattaattctgttttacagatgagaaaactgacgcaaagagaggttaaataacttgttcggatcagctaattcatggaaggaccaggatttaaccaagcattctgtctttggagtccatgcttacaaacattattcatgctgctgcttcacaagagcacaggcatatttcatattctgattatctatttctttgcaagttaaatcttactgcacatcattcctccctctcctttttactgtgagcttacgtaagttatgtacaatgatgaaactttttatcttcctcttacaaaggttaaactaggaaaaggagacaatgggtagtacacaggtcagtagtgtaagaaagtcagacattccatttggcattacatcactccttatgccttttccacttttaatactttcatcactgtcctctttcagaaagtatctaattaggaatgttgtgatagtaccataaatacaaacatatacatttgcagagatgaatgtagataattatgactagaagaataccagaaagataaatggaagatgattttaagtatactgaaggatgggtatgagagaagtatattaaactgatacatacataatgtagtttcatgaggggatgctgtaatgtaggtagttaatacaaatgaaaccattcctattttttttttttgagatggagtcccgccctgtcaccaggctggagagcagtggcgcgatctcagctcactgcaacctccacctactaggtttaagcagttctcctgcctcagcctcccaagtagctgggattacaggcccccgccaccaagcccagctaatttttatatttttaatagagacagggtttcaccatgttggccaggatggtctcgatcccctgaccttgtgatccgcccacatcggcctcccaaagtgctgggattacaggcgtgagccaccacacctggccaaaaccattccatttttaatggtgaattcagtctaactaaaaaacgatgaactgcctacactgtaccatgttttgtgctagacactacggaaatagatttgagtaagacacaaacttctttcctcagtgaacttcatctaaagcagaagttctctttaatttttttagagacaggtttacgcaggctgtaatgcagtggcacaatcatagctcaccgtagccttgaactcctgggctctaaagcaagagtttcttaactggggtctatagttctcctaaaaacgaattgagaatttttctatatgtcagcatatcagagtagcactatggtttccattggattcttaagtagatctgtaacccaaaaaggttaagatccgttattctagaagttagtacagtttggatacaaatgattgttttagtgacatcagcacttatacttttctcttatatttttaattagtttctaaatttgtttctgctgcatatgtttcttgattccagctgtttttttctgtcttgagtaaatagttggaagagttacctatatgatctcaaacattcaacctctttccaaacttactttcaacttccacaagacttgtttcctgataaatgacttggattgtttatgtcacttttgaagctaatgtgggctctgttgcacataggatttagtccaaaacaccttttcttagcaaaagaaaaatctctatagactagcatcaaaccatggctttagtgtcttctattaacacatcctactgtggacacaatgccctggtaatgccaagcttttcacacatgttcatgagcataccagatggcctttgaatggcacagttttattctttctacttggaaaactctctattttcacatgttaccttcctggtgaattatatttctcccataagactcagttcaaaaattgcttttggttagatgctttcactgacctcccaaggcaaaatggttactgcattattatttcatccatgagaattatttatatattttctcatgatctacattataatttatttatttacatgtctgcctttttatatactgtattcctttttgaaggcatagtcatatatatgtatatttatgtttctgggatctaacatatactagatattcaacttacgattattgactaagtttacatggatgagtaaatatgttttaggcagagtagtgaaggacagtaattaatagtgatttcattttctagcaattttagaactaaagtagaatctactaatgtataatatatccagaaagcagaaagtcatgatatattcaaattattaaactgattaagatacattttactcatgtatcaaaattattgaatatatttgtagtattcttcaatataaataatttctctttttattctggctaccaggccattgtcatattcacaaaataggttcttttatttctgtaaggaaatacattctctctttttttctattccatatctttgaaaacagagaatgcttcatagtctttatatcatagagttcaatttaagaaaaaaaaagaaggcagcttttcattgtgtatttgtgtgtgacattcatactccattcttaaataaagaagagagatgctgggaggtatatattttgtattgcctgaataggttagagacaagatacaactgttgagtgatccctgtaatgctggcttgaagttatggagaaatgctttcagtataaaacttaagttggaaagagttcttgagatagaagttctgtacacttaattactattcccatataaagactttgaggaagtaggatgctttgttcggtttcaggttatgcaaatgttacggtttgaaactgagtcagataaagatgtaattcttcctttctgaaattgtgtttattgcctcactattttggagaaacaaatgcctaagagcgacttacaaacagctgtaagtggtataaatacttaaagttcatttattcctggaatatttcactcagtgttcagagtgcactacagatgagctttcttaagcacactatatacatatacatatattcacaaaatattgtcagatttctaatcaatgtaagactgagacacagattgttataagtctatgaaaaagactgattctgttggttccttctctgaagctttcataatcttgccaagcaattaagagcaacatttgattctcatataatcttcgcacagttgaaagcaatgtgaaagtatgattctgacattagtgaaaaggcagtcctgagctttattcttattggtagttaaatctccaattgtctcctttattgttttccttcttttcttttttttttttcaacttgactttggaggctgttgcttcaaaatttcagagacaagcaagaatcactgtaattttggggtcactgttaataatagtttggatacagatggatttatttgatgatggaaaggactctccagaatgcgtcctcatgtcaatcaatatgagtatttgtgggcaccagaagggaatagagtactctgaggagaaatcaagtagcaatatcagaagcagctggggtaactctatggtgaccgttttggtgaccgttttggtgcccgttttctgtctggttgtatgctacttctttgctacttctgttggttagattgttgttccagtgtcaaatgtgatgtgaaatgaaagtcttgaccacctgtggttgttgaataatcagttgtcatttttttaaataaaaagcatattttatcttagccaaattctcttttgattccttaaaatacttgtgtgttgagtgaacagtgtaattttttttttttttttgaaatggagttccgttcttgttgcctaggctggagtgcaatgacatagtcttggctcgctgcaacttccgcctcccacattcaagtgattatctggcttaaggcttgcgaatagccaggattacaggcacccgccaccatgcgcaactaatttttgtgtttttagtagagatggggttttgccatgttggccaggctggtctcgaactcctgacctcaggtaatccgcccgccttgccctcccaatgtgctgggtttacaggcgtgagccaccatgcctagccaatatttttattttaaaaaataatttaggtttttcattctacagacagctgaattttattatgaaataaatactgtgtgtgtatattttttaacatataaagatctattggatttgaaaatatgttactagtatctaatttattgtttatactgatgacattttcttggaattgttaaagaaatctgaatatataatctcttagtttgattttgtcatatatcttaatgttaatatgcttaaacattacacatacactaatgatcataaagcaacattcaccgtgagtcagttttcttcctgaagtccatcaaaagaagaaaaaactgtcttttaaagttgatcttctgtagagtttggaaatacacctgagatcctaagtataacattatagcaagcctccaccatatgaaatccaaccttaaacactgaaagaattcattcaatgcacatgatagagaggcttttacttgctcaggctcactgtcagctcctgggatgctttatttacccaaaataattttaattgctgtattatagctatgtcttgaaataccctttatataaattttgcttacaatctaacagttagttatgtgttttcaatgtttgactaggatggtgttatgcgcgtaatactgttcagaaaatttaacaaggaaaagagaaaaatgcatgtgttacttaaaaataagtcacagaatagggccttaattatggtatggtaaagatttctatttttatatggtgctttttataagctttaaaatttctggttacctttgtacgtcaaacttagcataagttattgtgatgctataatgcatattgttgttaaaccagtgtggttattgtgccagttctaataatgagaatttcattgtttagggagagcattctcctatactctgaacaaaagtgtaattacttttgaacgatgtggaatgtgctcagtttaatagcatggagaatagattcagaaacattcagataaagtaagcttggaagccatatgtgcagtgtggcagtataaaattatgatagtaggcagtataattctacacacacatacccgatttcacacagtttatctataaactgttgtttctgtaggagataggcttgcttatctgaacaaggctaattcaattgaaacaaggtaaaaatgctgacaagcgagtatttgttttttatggtaaattgatgtttatcatacaatgaaattacattgttacaaacattattctgtaaatgttgtcacaaaataccacacgaagctgtttatctagatataatcccaggcttgtgtttaagtgtaagtggttcaatcattatacttgcattgttttgggaaattacccccagggctagcaggaatggggacgtgtgaaaaacaatcagttggggtccatcaaagccactggataagttgtgcaatcgatcattttgtcctgttgccataaaattccattcaatccagtggtgggagaaggagtcaaatgttaaactgagaaaactttgattcattcatatgatgtccacagtatttgaagtacttctgttgagagtaaagttaactggaccttgagaaattaatgagtattctctcacatgaaaaaaaaaaagtgctatgggagttgtgagatagttcaggacacttaatgaatgtctactattatccccacacagtgtaaggcagtgataggggttaggggcacaggcaagagcttccaatgccgtggtaatggggggaaatgtgttagcctgaaaagatttggtctaatggaatttaatgactttcatttaatagggagtgctgcagaaagattcaactcaaatatatacaatgaatatttatcagtggaggtatagaaatgaataagaactagtctcttccctcatgtagtttttgtgtgttatgtagtatgaaggtaagagaagcacaaaatcaccataatgtaatataaaatattagaaccctgatacaggagcctcacagttgaaaagtttctcatttgtggtgatcaaaataaattaacttgaaattgtttccactgaaaataactacttgacatctagatattaaatacacacacacacacacacacacacacacacacatatacacactggaccaattaccatcaattcaaggtctttactttgtactggaatatagttttgtttttgccataaagatttttttccaacagaaataactcaggaagaataaaaaagaaagttaaaaaaagggaaaaaaattgaccacaaaatgtactatgaagcttttaatataaaatgtagaaaagttaggaaaatatgcacctcatgttaatagggataaaaacaattactttagatattgaagtttcaaatgtttcctttccttatctgggtgaccaccttgaatgcaatggagagaatgatgaaatacttggctgggatactggaaatagccaggacactaagaagcaatgccggagacttacgtgaattcttgatttttgtggcatggataggtggtcatctttatctcacttgttattctcagacatgcattaaggaaggattacttatatttggaagttaaaaataattaaaagtttctttgcagttgcactttattatataattttgtttttaattcttcatctttcctttgattattttcatcctttgcttctctttttcctctttctttcaatttggctctatcagaaaacattcttaatggatcttcttgtggatctcaatagagccattattagaaaggaagacagggtaggagaatcagcaccattgtgctctgatatatacttccttcctcttatatgttgcctcttggggctttgccagaccttcctgcagtcagtctaggtttctcttactgcatgtgattaataaagatctgttggttttatgattaagttttaactcgtttttagtaacagaaacaatgtagtgagttattcacaaaactatatagtatatttcttcaatttattctgagattgtattattttacttttctttgatgatccagtgttgataataaatgatagttttattttcagtgcccgtacttagctaaacaacacttgaaaccctgtattgtttcccaaattatgtttcaaaatcttacctaagtaaatccaaatgtccatgagcttatgctttagcagatactggtgttctttatgtgcctattactcactttcactttaagttatttgacagcatgtgtcactatttccagtcagtttttgatttaactaaaatctttttgtcttcaaatttatttcttttttaattttgagattttatagagattggtaaaaagtttaagaaatagggaaggagatcatttataaaactagaaagtaatcttaatgttagtgtcactgtataaacttaatataagtgataataccagtgcattagtcattattttttattacactttcaaatgacagccacctgacagaatccaaaaaagaaaaaaaaaaatcttgcagtatgttggtgcctgatttctagaaactagaatgaaatctgtaagacgtggtaactcatttgtccatgggacctcaaatgtatcacataatgcttacaccatatttcttcttggccacatcagttagattcaactacctattgtactttaaaagggatctttgtataacaacctatttaaaaaatacaaccattaacacttcatttggatcttaagaaagtcaagtcttaaaaataacataagggagtctagtattggattttctttttttcacatattttgacaatcatattcatatggctttcaattaatagtatatacaaggacaaacacttgggctttgaggtgataaattagaaatattaaaacaattcaatagtaaagaaaatcttacagaatgatgagtgggagcattttcaagaaaaaatgactccttaaggaatacaatcagaactaaaaatgcttgggacactattggtggtacattaggtaaattaaaagcattcagtgtatctaaaccctttcctttctttcacaggcctgagatactaataatttgtactggcattaaagctggcattgaaactcaattcatgatagaactttagtatgctacccattttgatcttttttttttttttgccattttcttcctatttcttgttttggaaagcaattttttttcccctgtattttactagagagaatgagggaacattctttggtgtttgaaatgggaaataaatgtaaacctaacttaaggtgacaattgtaaatggcccatttggttacatatctcctttgtgtgcaaaatgctttttaaaattttcccctagaccatttttaggaatgatccatgtaagcagatgaggtgtgatataaggagagcagccttggccagctctgtgacactgacatcacgtgataaagcaaatgaacacaagtgactagattttgtgtcttatttagtcaaggctgcttctgtggcagcagggcaaacaatgttatcattatatagaggagcagtgtttacttcagtgtctcttcctagctcttaaaaatccagcctgtcttgagataaaacaattaatcttgtttgtcgatatctctaaactacaaactgatatttgaagggttaataaaaacattaaaatggagataggatatgaaaaagatgataggggtatagctccaaatgtagctttataaatttatgtaaaaaatagaaactaggtgccacgtaaaaattcaaaacctattgttagtataagaaaaataagttacattaattttagcattacacttactgtacaaagctttgaaaccacctctccagccactactagacctttccctctgcataaacacacatcctggagtaggagagattgctaggctgttatcagtattcatcttcaggccttgtgacagtggctggcatgctttgcaccgctagggacatgggagctggagaacatgcttgtgtatctgagattctgatttccccagggtcatcaatagaacataaaaagcaatgttgaaagccttgttgaatatatcttatagccgatcttcagtctgataggtgcaactcaaatatggaagatttcagtcagtgctcctcagaataagatatctaataattaatagcaatgcataatatttcaatgttttctgtgtaccagccaccctacattgattatcttagccaatcgtatattaacccagtgagttcagcaactacgtttatccccaatttacagatggaaaacattcttggatagttaaaatgacttgcctaataaataaatgatacagtttgggttcatggttttagaacccaagcacttaataattctgctcagtttctgcactcatataaatgttaaaatctttttaaaaatattttatcagaataaatagcttgaacagcctttagaaatacttgtgggggaggcaggtagaacaatctttacttgattttttattttaccctaacttcgggttaacttcattttttaaaatctttttagctggctttaaatgggccaggaattttactgtttttagaataataggctattgggcaatatatgagattctaaaaggctatttgttaaacctttcatgtaataattagtattaatatattaatttgtgttctggctataagagagttggcatagggtattagttaagcccatgaccctcagtgacaaaattactgggtaaattccaagatccgtttgatatctgtatggcatttggcaaattatggaaatggttttaccttatttttgccatctgtaaaatggcagtgataaaaatggcatctaacctagagggtgcgtacagtgtttaaagtagtcaagacacgtaaaactttctggtgctggcatatgcaggtactcagtaattgtcagttgttcaacaagtgcctaaagaaatgtttaagttctgtgatctaggagtatgttgtatgaaacgtcagctggcttcaatgcttataaatttaagtaacctataagaaaaccttaagctagagaaaaaaaaaatttgaaatgagaaatcaaacactgtagaagtctcaatctcttgtcattgaaagatcattattcaatctgagatattatctctcagtcaaatatttataacagattcagttattaaaaatattatttatttgcagacattattttgcttaatgctgttaaggctagtcagcaatagcaaccacctccactaacaccaccacaccaatatctacctcagtaaagtcaaaaaccacattttgttaagattatgagatatataatgaagcagtatagagcctaagttcacccttaaactgcttgggttccaaatcatgcaatgtgtgtgatcttgtctaagttttgcaggatccctgtgcctttgttttctcatattaaaatggtgatagtaataagaacttctccatatgtagatgtgttaagataattaaacaatagaattttcagaaatggctttgcaccatgcctggcacatagcgagcactgaatagatgatatagttcttaaatagtttgtcttctttttactaattatgattatttatcagaacaaaagactgtattttcttgtaggtttctaatattcatgttttccttttaataacctaaatgaatattactcacctgactccccattttaagtgattcagtagtcttactggtaaggtctgtcagtatcctcggatgtaattcaccttgaacatgagatgcaaactcatttaaagtagaaagctctgtggttctattgggataaaatgtttgtctgtttatcagtatctggttttttttttttgagatggagtctcgcactctcgcccaggctggagtgcagtggcgcgatctcagctcaccgcaagctccacctcccgggttcacgccattctcctgccgcagcctcctgagtagctgggactacaggcacccgccactatgcccggcttattttttgtatttttagtagagacggggtttcactgtgttagccaggatggtctcgatctcctgaccttgtgatccacctgcctcggccttccaaaatgctgggattacagacgtgagccaccacgcccgccctatcattatctttagaatctggcacagtggctgacacacagcaagtatttcaaggtagtttaatggatgaattcatgaatgtctccaaagcctgtgtgcacggaagacactttaattgtaattttccttatttaaatcttgaaatgatggtatttaattcataagcagctgatataatcattaaatgagaaaatcacctaacatagtactttttgtatagtgagtttcagttagtatgaactcccttttccatcgcgcttgtaatcctctcagcccaattgctctgcaacttactccaataaatcgaatcattcttctgtagcttcatatactatacttctccaaaccatttaccagagaaaaataacaatatcaacacaataacacaataccaaacaatattttggaatggtatatattttaaaattgcttaattttcctgcatgaacatcctaaaggctacatgatgatattcttttaggacatggttcgggggtttgtgtttattaccgtggttttttttttttagtatatccgcttactttttaaatatttcatttcacttaaaattccttttcattcagggattttagaggtactgtgaaagattcagtccttcatttattattatcgtgtttattgctttttaggcctttgatcttgcttctatgttaccagcaagaggggcttaaaatgatgttaaaaaggatatgatatgggagaaagccacaatacatgtggatttttataatataacagctcgcctgttagaaatctgacatgttgcgtctcaaactgacacacctactgaggatgtgtatatcttcaactgctaattcttgatgattaaacatatatctctgccgtttttagtggggagggtaaaaccttgacttgtcactttcctaatgtacttcatgtgatctttttatttcctatcatataaattcttccctcttcacttatgtccttttcagtgattctttaattatttttgttttacatagatagacacatgtttccccccctttttcatatggtgtttttgcttcacacagagagaactacacagatgacacttttaaaaatccaaacttcattcagttttacatttttatgcttataacactgaatatctccaaaatgtccttacctaaaatgccttattgttttattactagatttatgccggtaggaatacaccagctttcttagggataatctttaagcagaacttacttagtaagagaagctttgaaaactatctttcctaggaaagtaaatctcaaatcatgagacatcagtttaatcgctccccttgacaacttaacacgacagattgaaatataaaagccgatgcaagtgggatcaatggattatctaagtccctgaacatcttctcttaaattgggggacttgacagtgtttgtgagagggtgtgtattgtatgtcccttgtcatatgcagagcattaagttttcagagattagtgctgagtggatgtagtctacctgtgcatgatgaagcaaagagaaagaaattgcgagggaatgaaagagaaaaagagggggccaaaggaagagagggatagagagatttacatgtgagaattcagggggctttgtcatggcaattgtataaagtgatatacagtgcaaatcgacttgagcatgtccccggatagcaggcggtttacagcctccaggagctgagattacggctttatcttgtcatactaaattaacatggcagcacactgttaaacagtggtgacctcttcatctggggaaactgctgcctagaagataggtggtatttaagatgctctctccctttccccacccctctataggcttaaagcattttggggttagacagtagctgtttttaaataattatagaaaaaaattttaaatcaaggagacaatagataggtttcagttagatcaaatagccactttgggtagaaaaaacgattttattcagtgttctaaaaatgttatgtttatatatcagaattaagaatatgattgtgagcatttcattttaatcttatgttattctacagttagtctattcatttgtgtaagaattcatttctttgctttccgtaagatttgcttggtgatgatctctataggggaaagcaagatggcatacttgttccgtcccactggtcaggtagggggatagcccaagaaaactagaaagggggttgtgccttatatagaggtaaccaggttattgcttttccccaaagtttaccaggtgctacttcattccctgtattatttttacttattaaaaggggagatagagagggagaatgagagagaaaagagagagaaagttgagattaatttctcacccctcttcaggatgcagatattcccttcttgtgttttctgaaatctacatataggaaatatggtaagaattttttttctcctatgttaaaatgttcataaaacaatcaaaatccaatatgtaattttcttactcagtaagtgctattggaatttgagtcaaaggaaggggtgaattaaagcttcataataccataatatgggtgtccattcacttatgtcttcagctcaagactgaactgcttcctcactaatctctaaagttaaggtttcttaacctaggtgttaaatcactttaagggttgaaggatgagctttttgaaacctgtgaaccccctgaaactgtgtgatatatgcacttacatattgttcttgggagagtgtccacagctttgattatattctttaaggggcctgagcaattgaaatagattattgctcctctagagcttaattctttcttagggtactgctgtggtgcatcctcacactggggctatatatctggcaactgacttgcagtcacagctatgatcctggttattttgttatcatgaaatatcttcacctagcttgccttggagactttttacaaggctgccatgctggaagtagtcctacagtccacctactgctcttgaccacttaaaactcttcctatggcatccttttaacccactttttgagccatagattcactataattctagaataagagtggggttcagttctccagtgccctggattcaaggtccagactctagaaatacaaaaagactatttagcttgtgaggtatatgaaacaagtgcaatgtattttttccatttttcttgataagttgttttctcctactcactgtctccttcccaccttttccccaagtcagcatgttgtgagactgtgaaaaagaaaacatacattaatttaagattggcctcagtagttacatctgtcctatgatgccctggtaccatgctgcttaactaatacaggatttttaatgtcaaggcagtttgcttacgttcagtatttgcttatgttcatacacatggggttatttcaaagaaaagaaaattaaaaacaccttgccaagttgcctttctatgctatgtattatttgggaactaattttaaagagcgattattgaaattagtattttcctcctttttcttcctgttaatttcttttctagtttttttttcatcagattagatacattagcaactcttttaattaaaatagagagtcactaagtagccactacctcctacatttacttatttctagcactgaattaattctttcagttaagttcaggacttagaggtaagttgatatggtgttatcagaaacattaagcttttccttattcctcatttcaaattcctatttgtttaatacatatacttagtaagcattgtgaacactcatatattaaaacatgaaaggatttctttcaaataaatattgtatttgatataggaagccgtaaaggacagacacagttttatattttatgaagcagcaacatgtcaaaaaataaacaggagaagattctggcaaacttcactactaccccctaactcagagctaaaaggagtaacttcaggggcaggcagacacagacacctgaaacatggaatgatagagagtcttatcctagaactggatatctgcaataaatagaatatatgaatattacagattatttttgaggagttctttaatatttggaaagtcagtatgatgtagtattttctaccaacaaagcagaaaatttaaggaaaagagagaataaaaaatatgaacagataaaaatagcttaatataataaaaatagttgtccataatcacactaaatggataaatgtctttttaaaagattaatattttatggatttgttctagtttcatacttatttaaaaagacaagcaaaaagaaaaataacatggaaatgttaaaagtaaaagaaaggtaaaaatgtaataggcatccacagatagaaagcagaggtagcatttttattatcagaccaagttgaatgaaattcctggaacagatatttttgttgttatatagagataaaacatcataaatatttatacactaaataaactacataaagaaaaaggtacttgagtatactgaagtctagaaaggaaaaagtgttagaaatatgaggtgttgacagaaacaaaattatacagaaatatttggaactatctgtttctctttgacaaatggatgaggcggaacaccaagatgtggagattgggtaaatatagttaataaggttgatctattatatgtctatatatagatcacttgaaagcttttaagaaactatactactaattcttgtgtttaaaataagaatcaaaattaattacatgctttaaaaataacagcgtgaagagtatatgccaaaactcatgtgaaatgatcgaagttctaatagcgataactttaaatgccttcattattaaatagaataaatgggaaaaaagaattaagtatttaactttagaagcagaaaaaatataataaaacaacctcagtggagtcataaaacagaacccgaaaagcataagaaaataaattaatgaactgtgagaaaactagataaacttttttatatactaataaatgaaaacacaaatgcacaaaattagaagtgataaagggtaatgttattgtagttatggaaatatgataaattattataatatatactagcattttcaaaattttgttccaaagaatacacatttcatataatgtccaagaaaaaggttctgcagtgaaatcaatttagaaagcaattcatagtatatcccaattttttgtattcacactccatatggaatattgaaggttttgagaagtcagttctgtagttcagtttaatcttgcatgttttccacatttaattttagatctttgctttgatatatctcttattaaataaattaccaggaagtaatatcgcattgaatacacactggcaaatggggctatataaagctatttattaataaggttgagaatcttgatgaattgtatgatttcataggactacatagaaaggaggaaacataaacagactggactcatgaacaattttttttaaattcaaagaataatctccaaaaatggcaactgtaactatgcaggtattttcaacttttaaagaacagagaatatccactctgaataaggctgttttccagagcacaaaaatatatttaaacttttccacaattagcataactgcaataccaaactctcctccaaaaaaaaggaaaagaaaagaaaaaaataagtcctttaacactttgaatagagatgcaaaaatcttaaataaaattagagaaagttttattttttttattatactttaagttctgggatacatgtgcagaacgtgcaggtttgttacataggtatacaggtgccatagtggtatgctgtacccatcaaccatcacctacattacatatttctccaaatgctgtccctccccttgcccctgacccccaaaaggccccagtgtgtgatgctcacctccctgtgtccatgtgttctcattgttcaattcccacttatgagtgagaacatgaggtgtttggttttctgtttctgtgttagtttgctgagaattatggtttccagcttcatccatttccctgcaaaggacgtgaactcatccttttttatggctgcatagtattccatggtgtatatatgccacattttctttatccagtctatcactgatgggcatttgggttggttccaagtctttgttattgtgaatagtgctgcaataaacataagtgtgcatgtgtctttatagtagaatgatttataatcctttgggtatatacccagtaatgggtattgggattgctggatcaaatggatcaaatggtatttctggttctagatccttgaggaatcgccacactgtcttccacaatggttgaactaatttatactcctacgaacagtgtaaaagcattcctatttctccacatcctctgcagcatctgttgtttcctgacttttttagtgattgccattctaactggcatgaggtggtatctcattgtggttttgatttgcatttctctaataaccaataatgatgagctttttttcatatgtttattgcctgcataaatatcttcttttgagaagtgtctgttcatatccttcacccactttttgatggggttgtttgtttatttcttgtaaatttgtttaagttccttgtagattctggatattagccctttgtcaggtggatagattgcaaaaattttctcccattctgtaggttgcctgttcactgtgatgagaaagttatcagtgccttttactatacttttaatagaccatgcctaaaaagagttagtttagggaatgccaggaaagtttataccaagaaatgtatattagcatcatctatcttaggggtcaacaaactacaacttgctggaaaatctggcccactgcttgtaaatttgtgaatacagttctattgaacagagccacactaattcatttacttagtatctatagctgcttttgtgctacagtatttccaatagaggcccgatagcttgtaaagtctgaaatattttctatattacctttcacagaaagtctttgcagacttctggtttatattctcactgcctgaaggggaaatcttctatgaaaattctcaaaaaggtctttgataaaattcagcatccactgcttaaacagttcttgtaagtagttaatagagtaatagtagtgtaatctcaacctagcattgcttcaaacttaatggtaaaaatctctggttctctttaaagtcagtggtaattcagacttgctatcattactttgatgtgatactatattatcaggtttcttcctgccttctttcctctcttcctcctcctttttttccttctttccttcctttgcttcctctttcttcccctcctttcttccttcctttctatgaagaaaaaataatgaaacttttttactaaagaaaaaacagtaaggattttttgcagaattgtaacacattttaatcaggaaaaacacagtggggttatttggccagaattatggaacttaaaatgatctcctgaagtccttgggtattctaatgaaaacctttcagcagccaactttcctaatgatacaaacaaacagttttctctttaatctttgaatttttttagcaagtttaatatacaatttctcttcataatgcctctttatgtgttactgtttttgaatcaaaatattccacttcacgattattgaagaaaaacttcctgcttcgttataagattagttttacttccacagaggagtaaaactccccctcaactattagttacaggtgtgacattaggtaaaccacacagtcttaagatgcacagagaaaatccactgtcttgtggtcataaccttgggccagcactaggaaacacaatggaagttgaagacctattcttaaattcctcactgttctaaaatatccacgtaggccacattaaagcctgaggtcttttgagctataagtgagtatgcactcagcatattcctattgcctttcccccttcttctatggtactcagtggtttgaggtggaaaacagtatggatacaggatatcgaggactttgctgtaggtagcatctgtcgtggtagtttttcatgatttatgagactaatcctttctctcaggacttccccagtcccggttcaggtttaaatatccctccatgagagtatatttgtactcagtagattccatgacctcatcctgtgcctcttggaattcatcttaggatctgcatcatcttgggatcatctattcactctctctctcttcttataactctagctttgggctaaattctcttttaagttgctgcccgtactatttccgatgtctctattacatgacaagtctttactggatggaacctattatgttttcattaaattttctctcccctttcctttcattttagggaaattttaaaaagagaatactttaattgggcttccctcaaaagtcacagagatttctaagagcaccaaggttgcggtggtctgcgtatggtgcgtcgctaaacttgattgcctcaagtccacaatcagcagtaactacccaaggacaaaatatggcactgggatttatttcctctttgaatagctatagtgccaatttattaggcataaataaatgaatgttagaatttatttttaatgagaatgtttccctaagaatttagatgaggaaataccattttaaatcttactgaaaatgaattgtcttcaggtttccaggccagagataaatgattcccatctttcccttttctggtatgatttggctttatacattttctcatgcttattttttattccttgatttattacacaagagaatatacttttgtgaatcaccatctttgaagcacctaatgttcaatatctttttgattcagaaaacccactgcaaggagtctcacagttaaccgtattcttaccagaaaacctgtaactcaatagtaaagtccatctggtgagttttttataatcaaagtattggaaaaattttttatctgaaaagaaggtaaatatttatagcacaatgaccagttaaccacatgtggcttttcaaacctgctctgtgaatctcttaaacaacaatcattcacatgatctttatataccccttttcacagtggtagcaattctttacctgtagtctcctacatatcctttgcggcaaagaaaagaaaatgctctaatctaaagcaaaaataatagagactgtttgatttaaggaagcatataggatggacatttagtgtatatgaaaaagaaattacaattgagcggttggtgagaatgatatacttggcactgaaaacacagaaactggtattttataataaaagtttataaacatgtaaacaagtggtttatttttggtgtcagcaatggcactgtagttatttcttttctttttcttttgagacagggtcttaccttgtcacccagggtggagtacagtggcactatcttggctcgctgcagccttgacctcctgggatcagatgattctcacacctctgcctccccagtagctggggctgcaggtgtgtaccaccatgcctggtttattttctgcttttttttttggagagacagtttctccatgttgcccaggccggtcttcagtcttgaattcctaggctcaagcaatctgtctgcctcatgagccacggtgcccagcctacagtcatttcttggcccttaaatcgagtgatcagagataatgatttaatgaaaaactctaatgttaagcctgagttatagtgaaaaaaagtatttttgcttattggctagaaataatgtaacttttaagaatgatttcttggcgaaggctgtctcatataaggaaagtaaggtattaaagtaaacttttctgtattttgtaggtttatagagtttgagaacaatggtcattttgacgacgcaattagagaaaaacattttatttccctagtccagctttaattagtcactgaatatgaagatgatctttcaggaatgtttatcactcttttaatatccagggtgtatctggctaacctggctccctaagttgctgcctccttttcttgcgtagttctccatatgcaatctttaaaatcctttcaaagacatcgatcttcccaactatctaaaatcaaggttatattagtcactttgataaaactcacaacctatatattaaatggttaccaaatggtctggctaaatgttattatgtttgcaaaagtgtatattaagtctctgtgatattacagtccaagaaaatcatgggaaaacaaatatttaaatgtgaattaattaactagttttttatatttttactgccagtgtctacctggaacaaacatagttttctattttttgaatgctttatctcatatcaaaccataagagggactacattttcagatcttttaatgacaccataacttctgggaaatgggaagcagtctggtgacatgtgtgcttgtatttttgagtattgatggtgaaagctcgtagaattgttagtcagtaagttgaaggtatggtggtagataaatgtaacatgtacaaaagattcagtaagaataaatgggctgggtggggtggcccacgcctgtaatcccagcactttgggaggccgaggcgggcggatcacgaggtcaggagatcgagaccatcctggctaacacggtgaaaccccttctctactaaaaaaaaaaaaaaaaaaaaaaaaaaaaattagccgggcgtggtggcgggcgcctgtagtcccagctactcgggaggctgaggcaggagaatggcgtgaacccgggaggcggagcttgcagtgagctgagatggcgccactgcactccagcctgggagacagagcaagactccgtctcaaaaaaaagaaaaaaaaaaaaagaataaatgtaatataatgcttgtgttaaatggagctttgcaaagatgttgtactctcaagtattcttagaataatcacaggaaagaaaagatagttggggagaaactctattgttatagacagggccaacttatccattaagaactgtaggcacagtgccggaacccataatactttcagggtctcatgatcctgttttgatttcttttagaaacagaaaacaagtgaacattgaggttgaagaaaatgttttgattggtacataatattaatatattagtttttataccaacggagtcataaaatataattttaaaatattttgttgtatttatttatttatttttacggaaaaaagagtttacaagaacaaaaatcttagggccaaagaaagtaatgatgtaaccctggtagtaatataaaacacaaacaattttgaaaaagtgttacaaagttgtcttttatatgtagctcctaccagtttccttttttctcctctcatgtcctcttacccactattttacacttcatgtttaatcattttgggtctgaaattggcatttcattcatatttacaggtcagtttgttatcacaatcctttagtagcttgaattgatattgaacaactgatcttcatgttcatctactgcctagaccaaaacaaagataaagttatttttcattttagacctatgttaattcattttgtgtgttacataaaatgtagcaattacacatataggtaggtggtggtttcattcagacagtaagagagtcaaaagctaatatcaaaaagaaaacttgattatttgtaattgagatgcttttagtttaatatgtgagctgcacataggcatttaacttctctaaatatttttctcacagttattgctcattattttttgaggaaaaatatacaccttaaaagttttattttataatttaaaaaagatagtagtcctttcatctaattcttcatagttaagtatttctgttacattgaaatagctaccagattttcatggtggataacgggattttcatatgatccctataattataaagagatttccttagtgagtgaagtgtctcatttatgcagaactattgaagaagaagaaaaaaaactacatcatagtaaatcttacataagtagaaatagtgaaaaaaacttgaacgatcagtacaaccagaagttttagttaagaaatatgaacacctcaaaaccacttggaatggcacaaatccaatttagaatacaatttagcaccaagatttgtttttatgtgcaaatacctggtctacaaagctaaagggaaaacataggttgaatagttattatgggattgtgataagaactgtagactttgtagctcagtagactcagctgcagtgttggatcatacaagtggatctatattgcttatctggtatagcctaacattactccttacaatttgccttgttaagtgctttcttgtgtagaaaaaagaatagagttggtatttattggggaaatgtgttaagaatttgaaaggcctctaggtttataatggagagtaaaaatatttttttcctttggtttaggggaaaggtttggaaattaggtataatcttcactcttacttatgcttttgccccattcctgtatccctataatgttctagttgaatttcagatggtttctcaatactgtgttaaatcaatgagaaatagatcagtttttcctttacttatgaccctagacttctgtgtacccttttcttctttattttattttcaattaccttccctagtctttttctgatcacctatatttagctctcacttcagtactctttttctaatgctatttggaccctaggggcattctgagtaacagtatgataggaaaaaattgtgggaaagaatgaggtcgtgttttatctaaatcttaaatgttttgtcctttaatgtagtgacatgggagagaactcattttaattaagctaatatttaatatctgctatgtataaaatatattggatttcaacatgagaaaagcacatttttatctcctggaaactcagtctggtggggaaaatggatacacataaaagtcttaattgtggctgtgataatattgtggggagtattacagatgaatggatataagatatgtcatgggagtatatgggggaagaacaatactttctgacagaagaagaatagaaaatttctggcatatgattctagagcagtactactcacaaatgtggtctgagctacttctttcatcgggaagtcttagtatgaaaagaacatcagctgaactaagcagggtacttagtgatagaactgatttacattctggggctgcttcttatcttgtagactggtgctttgagaaccatccttctagaggaccatggcacacatccaatacacatgtacagattagaacaaaacagaggtgcatgagatcaatttcagaagtagggcggtaggctggtggggtttcagtgaaagggtagaaatgaagaaaggcttcctaaaaactaagatatttaagcaaagtcatgaaggatagatatgatttgaaaatgtgtgtggaggtggagagaaattgaggggaagatattccaagcaaagtgagggaaaagagcttataataaggaacagatattctaggtatgttgtgaaaattatgtagcatataacctgcactacattttgtcttttcagggaacttctgggtatgtgtgtggaacactaggcaagttaatgtatttgatgaagagtgtactttcaaggaatctagtaaaaaggaaataacatttagctaaatgtaagtgtaggctaggaattaggttaagtatttatattcatcatgtcatgtaatctttaacaaccttctgcaaagctatcattatttccattttactgatgtaaatacagaagtgcagagcataaagttacgcagcctataagaatgggcctgacctgaaagattatgttttaatgtgaaaaagttgaaaaggtagatgaagggcagattctggggggccttgaatgctatcaaaaattaggactttataatctacagttgttgaggagtcataagaggtttggagtatgcgaattgcttaataaaaatcctatctcatgaactcaatttattatttagtttatactcaaaatatgtatctttaggaaacattgaataaaaaagcctaatactggtttgtttccagaccaaatccatgggagcaaaattgaaccatggttcaggcgagggtagggtgggaatgaagggatatgggtgttctgtttaagaaaatccctccaagatgttggctggtacttggcttatttgtattttagtgaaatacataaattgtcaagtaagttctgtgaattaagaccagacaattttttggtctgctatgtgtcagaaaaatacttgtacatataacttagggttgaattatagagattaccacgagcaaaagtgaatggaaagtaagagtgggttttctgaagagtatgagaaatgacaatgagtacctatattgctacttttcttactcaggtatgaaaatgaatttgctcttgcttcaaaatgcttgatattcttttctgaaccttaaagttgtttattcttcccaggccagttagaaggtggaaaaattagataaataattaagcatgttggagtaatcagcagaaagaaatcttaacattcttatcttccctagaaatacgaagtggagccgtgaaatagaacagttcattgcatgtacaaaaaggtcaaataggaaatcttattaaaccagctaatattaaaagcaggtgatgtttttacacattttttaaccaaggaagaaaaaaaagtggaaggcagggaagaagggagggaaggaaggagggagagagggagtgagggagggagagaaggagggaaagaggaaaggaaaaaagaaaaaagggaggaaggaagaaatgaaggaaattaaaaggtagttatgatttttgtcatttcttcacatccttaaatttttttttctgattgaggttaaactgcctaggtggtatttacttaaatctatctactcatattattagcaataaaggtaataatttttatgttaatagtgttttgtatgtggaagtttttttgtttttttttttactatctttgttgtttatacacagctagagcttaatttacagatcgcttttcaaagtaagaggcatcactgttcattttggtggcatagtgtgtaggaaagacctattcttttctatggggatagatccaacccacttaattcatttcagtgtcaggcagtagtacaaattccttattcatcttattgtaaatctagatttttttaatttggggtatttaaagaaagaagttctagtaagagttttagaatgattaaagaccaatagtaacacaattaccagcttgtgtttttatatatttaccactcacagatccatagaattttaaacttggcattaggtcttagaggtctgttagtccgtatctcttactttgagataggaaaattaaagttcagacaggataagagacttgcctaagatcaaaagtgtgatttttgcttaaatcttgtgtgactgggaaaatgttggtagcactttaaggaggggaaacataagccaaaaagaacaacaggtttgtgtgacagaattctgagttaacattatcattgttgggtttgacataggagatatttaggtggaaaatggactaatggaactatgtgattaaaacctttcttccatgagatggaaatgtgagacttacctgtgtatatgagatgagatttgaaattgtaaatttcaagagtcattaattccacacatatttattgagaacatataattccccaaggaagtaaacctatgccatgttttaaagcttgaagttttttgaggagaggcgtggagttgagaaaataaggaacgcatggccaggggaaagcaaggacttatggttatattactaagtggagtggagagtgaagataaattgagtgtgcacattgttcaaagagttccaagtttttcctgaaagctaggtggaagctgaagaaacatcttcagcaacacaatgtcaagatcaaatccccaaaagggaaattagaaagaaatgaggtctttatatgctcaaatcagaacttgttatggccattaaatttattttagaggattgaagatgaaaactggcaatgcctcggagaaggatgaaaaaccagtagacggtaggccatcagaaagctaggaaaagtactgttcagtagtctcaaatgtattgaggaggttattaaaaactttggatttcactattagattataggcatatcttggagacgttgtaggctcagttccacactaccacaataaagagaatattgctttggatatgaaatggcaatggacaagaaatgaagtgttaacaggcatcattcaagagattaactagtcagaagttttaaagatgacctggatgcctctcctagtgacagaggcttactcctaaatttggattggtggcaaaacactcacagagctgttttgggcactttcgcattactaacatctacttgttcataacaaattatatgtactttaaaactctttagttacaatctagactattccatatatttaaaaatccatatattagaatcttttttcatagcccaaatcataaatatatattactgaaattaacatagttacctttcctttgtatatgcatatgtgtgtatagctattatgttatacttatgccatagtgtacatgtgtatgtaaatgtttgtatacacaggtatacctcagagatatggaatgttctaaatactttgttgttatttcaacggtgttcacaggatcttcatcaggagtagattccatctcaagaaaccactttctttgctcatctataagaagtaacttctcattcattcaagttttatcatgagattgtagcaattcagtcacatcttcaggctctgcttctgattccagttttcttgccatttttaccacatctgtaataatttcctccactgaagtcttgagccccacaaagtcatccatgaggcttgaaatcaacttctttcaaactcctcttaatgctgaaattttggcctcctcccttgcatcacgaatgttcttaattgtatctataatgatgaaacctttccagaagtttttaaatttactttgccaagatacatcagaggaatcattatatatggcagcaatagccttacaaaatgtattttttttcgttttttttgagacggagtctcactctgtcacccaggcgggaatgcagtggtgtgatctcggctcactgcaacctccgcctcccgggttcaagtgattctcctgcctcagcctcccgagtagctgggactacaggcacgtgccaccaagcccagctaatttttcgtatttttagtagagatggggtgtcaccatgttagccaaggtggtcttgatctctggacctcgtgatctgcccacctcagcctcccaaagtgctgtgattacaggcatgggccaccgtgcttggccccaaaatgtatttcttaaataataagacttgaaagtcaaaatgacttcctgatccatgggctgcagaatggatattgtgttaacaggcatgaaaacaacatttgtttccctgtacatatccagcagagcttctgggtgacttggtgcgttgtcaatgagcagtagtatttttaaatgaatctctctttttgtgaagtaggtctcaacagtgggcttaaaatagtaaaccatgttgtaaacagatatgctgtcatctaagctttattgttccatttatagacaaagacagagccgatttagcataattctttagggccctagcattttcagaatggtaaataaacattggcttcaacttaatgtcaccattaactttaagatgtactgacccctaacaggagagccaggctgttgtttgaagcgtcgaagccaagcactgactttttcattctcactatgaaagtcttagatggtgtgtctccctccaatagaagattgttttgtctacactgaagatctgtgtttttgtatagccagtttcatcaattatcttagctaggtcttctggatgacttgctgcagcttctatatatctgcacattctgcttcactttgcattattatcttatgaagattgcttctttccttaaatctcatgagccaacctctgctagctttcaacttttcttctacagcttcctcacctctctcagccttcatggaattgaagagagttagggccttgttctggattagggtttggcttaaatgaattttgtggctgctctgatcttctctccagaccaatacaactttatattaaggataaggctgttttggtttcttatcatttgtgtgttgagtggagtattacttttatttccttcgagaaccttttctttgcatccataacttggctaactatggtgcaagaggcctagcttttggcctatctctgctttccacatgcctttctcactaagtataataatttctagcttttgagttaaagtgaaagacgtgcaacccatccttttacttgaacccttagaggccattgtatggttaatatatggcctaatttcaatattgtgtctcagataatagggacgcccgagtagagggagagagatgggaaaatagcagtcaatggtgtagtcagaacacatacagcatttactaagttcaccatcttatatgggtgcggttagtggtgctccaaaacaattacaatacaaacatcaaagattactgagcacagatcaccaagtagaaataattataatgaaaaaatagggaatattgcaagaattaccaaaatgtgacacagagacatgctgtaaaaatgatcccaataaacttgcttaatgcacagttgccacaagctttcaatttgttaacaaaaaaaaaaaagctatatttgtggagcacagtaaagcagagtgccataaaacaaggtgcctgtatttttattccttctaggactcaggatagtgcttttcacaaagtagggacatgattaacatattttgtgaccatactttatttcagagtgtgtgtgtgtgtgtgtgtgtgtgtgtgtgtgtgtgtgtgtgtgtgtagtgtgtttaaaatgttatttaggagttgacaaaatagctcaattttcatttggaagtacaagttaagaaaattgaaatgtaagatgtagccaattataagtagtatagaaagttgaagatgttaagtaccttaggaaaccaaactagagtatcagaaacatcatatggtattgagagatgacatatatagggataaaacaaactttaaagagaaaattgagtaaggttagtaaaattaaaacaattaagtattttattccgatgagaagccatatgacacaatagttaaaagcacattcaaaggaatcagagatgtggattgaaattgtttgttatttaacttgaagccatggcttaaactcattttctctgtgtgtaaaagcattgatcatatttcctacctcataggtctgttagaaagaatcaaagaaatagcgttctaaaatatcatatagtgattgtcacattaataaatttagtaatttttttccagaatatattcttaggttctgaatgcaatctgaggttaatcatgataaagagcattgtaatacacatatatagatggaaagaattagctaacccatgttacagtcaaagtagtatacaatattgccatggaaaaagtaaaaagaaagacatatactgagtagaaaatgaaaaattcgcagtattcaaattgtcagggtttgggattgacccccaagtgaaagtgttgaaagcttcatcatttagatcatttcaaactctattctaccacactcaagaaaccctgtggtcaaattcttatcctgtctactagttgcatagttcttccaacagacctgctattgacatccctgtttccttgcacaaagctgttattcacttctaggaaaatcggtggctctgtggaattggataagaatttggcctacagtgagtgatttgaatgaatgaatttggaattggcaagaaaatacaaacatatgccacatttacttggtacattcacgcttcaagagaactcaggtagcacgtaaattcagtgtaaaaagccagagattttcagtaagaacctattacaaagtcagcctaaatcttcatttatttttgtcagattgaaagaataaggcaaaacgtaaattattattcgttggaatgtacaaggctagaatcccttctgataaagtcatatatggcacctactactttcaatgctgatgtcagagacagaacagtcatgttttaggcaaatttaacataagtggatttattagttgcttttaagatacactgttttttaaagccagtcttcgttggccagattgatctggactactttcagattaagtagtctttgctttccgtaggcaaaatacaaccaaggagtatggtggcccacttgtgtgctggcggtaagttggagagaatctgaacctgctcctattttcaatagtagacaaatttcttctctcaatattattgctcatgcaattttcagtaccagagacatggggcctttaaaaaggaagagatgttaaatttttgacagcttttcccttccactgactgaaacaataaaaataaacatgaagctgttggaatggcctcttcatattatgtcatttgcatgtgattccctttgcttctctagataattgaatttattcaggcaatttattttttaaatgtgtagtctctgtgaatggaaacatcttaactaaagacaaccctttcatttcctcttaatgaaatatatacatgtaagtgtatacttctgttagaaccaagggaatagaagggaaataatagaaaacccaaaaatgtataattaattaaaaagatgaagtgtgactcttgtaaccaaatattctgtctttgtgtttaccccctgtctatgttcaaggtctgtaggtgttcaataggatctttttaattatttttcccgtttgatgttgctaagtataatgaatagatagcaaaggacttttgtaaggagcttgtaaatgtgaatcacctcaaagctggtaggcatagcagtacctggttgtttcccatcttgagactcagtaagtttgagacttaaagaaaatgactctttaaattgagctccatgagtcaaacaatgtagctttataacataaatagagcttgtattctcttgaatctgggaatataaagagtaaatacttttattatcaatcggcatttttaagggttattgagcaccaagccagagcactttgggatagcagaaatatccaaagatattcagaaaacaggaattccagtagaattgtagaagtggaaacatctgtccaaaattcaaaattatttatctcctctttatactccataggatttagtataacttaaatgcaattttatttttatattcaccaatatgtaacttcatcaagtttccatgacaaagtaatttcttaatgggaatgaaaatactgtcacctgtagtcacaactcaataaagcaataaacagcagtaggattctgaaaaactttttttatattgacacatttcattttctccctttattctaacatttatgtggcagggattttagaggcaggacacacagcaccaagaactcagcgttctgagagcccattcattgtcactaagggaaagttgcttccgtttctcattttatcccttagttttacaatgatatctttttgtcacgctttagtcttcctggagtaactaaaatctttgattcttactttgttgttctagagccttctcattttcctacttctctctctgtttgacatattctataggtgctcattattatttctatgttggcagggttttttttttttttttttttttttttacaaaatatactttgtgtttcaaaatctagttataaataacgataaactttcaaaaatgtacagggcagacccaagtcagtgaaggagaaggtgttactctcttataactgccatttttaggcataggtgaagagggcttggccatttgctcttctccctgtggatactcttgaagagcttatgacctgaagtgcatttaatcattcactggaaataaatgcttcataagtcattattttacagcctttattttttcacctgccttttgtaggcacatctacctttagatgttccatatacaaatttaaagatctcaaacaattgaatttcctgagggagattgtatggcatctcttaaagtcctggggtcagaaaccaggactaatgctcaagctataaactaatttagttgggcggacttattgaaatttactagacataccaattctatttaaaacattatctctgtttgctaacaaatctgtttttgtcaataccataatcattgtttcaacttcccaagcaaaaaccatgtttatctttgactcttttttttcttattattttcaagttgcttaatcttatcattgcttctttcaaattgtctctaggattgggaacatatttttagcattctttttttttttaaatttattttaggtttgggggtacatgtgaaggtttgttacacagataaacacatgtcatggaggtttgttgtacatattattgcatcacccaggtattaagctcagttcccaatagttatcttttctgctcctctccctcctcccaccgtttccccccaagaagacctcagtgtctgttgtttctttctctgtgttcataagttcttatcatttagcttccacttataagtgagaacatgcagaatttggttttctgtttctgctttagtttgctaacagtgatagcctccagtttcattcatattccctcaaaagacatgacctcattctttgttatggctgcataatattctatggtatatttgtgccacattttctttatccagtcatttatgggcatttaggttaattccatgtcttttctattgtgaactattgggggaaccagtccccaatatttcaatgtaggttcttttctattttccctaagtgtcggccggtctgagaaataaagagaaagagtataaagagagacattttacagctcggcctccaggggtgacatcacatatcagcagattccgtgatgcccacctgagccacaaaaccagcaagtttttattagggatttcaaaaggggaggggtgtatgaatacagagtaggtcacagggatcacatgcttcagagggcaataaaagatcacaaggcagaggagcagagcaggatcacaaggcaagggtgaaattagaattactgatgagggtccatgtcccgctgggcacacgttgtcctgataaacatcttaacaggaaacagggttccagagcagataactggtctgactagaattcaccaggctggaatttcccaatcctagtaagcctgaagggcactgcaggagaccagagcgtatttcatcccttatctcaactgcataagacaaacattcccagagcggtcgtctgtaggcctacccctggaaatgcattccttccccagggttatcaattattaatattccttgctggaaaaagaattcagtgatagttctcctactcatatgtccatctataggctctctgtgagatgaaaaatatggctgtattctgcccgaccccacaggcagccagaccttatggttatctttccttgttccctgaaaatcgctgttattctgttctttttcagggtgccctgatttcatattgttcaaacacacatgttttacaatttgtacagttaacgcaatcatcacagggtcctgaagtgacatacatcctcagctaatgaagatgatgggattaagagattaaagacaggtgcaggaaattataagagtattgattagggaagtgataaatgtcaatgaaatcttcataatttatgttcagagattgcagtaaagacaggcataagaaattataaaagtattagtttggggaactaataaatgtccatgaaatcttcacagtttatgttcttctgccatggcttcagctggtccctccgttcagggtccctgactttctgcaacagtaaacagtgctgcaatgaacattcacatgcaggtttctgtagaatgccttatattcctctgggtatatactcagtaataggattgctgagtcaaatggtagttctggctttagttctttgaggagtcaccatactacttaccacaatggttgaactaatttacactcccaccaacagtgtataagggttccctcttctctgcaacctcaccagcacctgttgttactttctgactttttaataatagccattctgactggtgtgagatggtatctcgctgtggtttttatttgaatttctctagtgatcaataatattgagctttttttcatatgcttgttgggtgcatgtgcgtcttcttttgagaagtgtttgttcatgtcccttgcccaattttaaatagggctgtttgtttctctcttgttaattttagttccttatagatgctggattttagacctttgtgagatgcatagtttgcaaatattttctcccattctgtaggttgtctttttactgtgttgatagtttcttttgctgtgcagaggctcttaagtttaattagtgatttattattattattttttagcgcttctcataggaaagtaacatacattgtaaaaaaacaaacaaaaaaacaacaaagtgcacatatatgtacctgccttgcatatacacacacacacacacacacatacaggcatattaaattacaaataaaaaaaactcttggccgggaatggtggctcatgcctgtaatcccagcactttgggaggccgaggcaggcagatcacctgaggtcaggagttcaagaccagcctggccaatatggcgaaaccccgtctctactaaaaatacaaaaaattagccaagtgtggtggcaggcacctgtaatcccacctactcaggaggctgaggcaggagaatcgcttgaacctgggagggggaggttgcagtgagccaagatcgtgccactgcactccagcctgggctacagagcaagactccacctcaaaaaaaaaaaaaaagaaagaaaaaacttcctaagtacactgtcatcgattatcacacattgtgtatagagtatctaaccatctaaaagtggctattagcctttttccatatgccttacacattcctgtcattgtccctatagaagtaactatcaccaggctatggatgaagagggaagggcaatgtactctggaatgtgaacaaaaataatctgaatatataaggtttggaaaagctcctttctgagtgtaacctattttccaaaacagttgataatcacagatgacagatagatttgatggttcttttcaactcccactgctacaatctagtggaaggccttttattgtcacatatgtgtcatggtaacagtttcctattcagtggagatctttactttctcctctacccaattaattctacataccactgctagactaatcttcctaacaagctactttaatagaatcactcactgtagatcaacaatagttctccattgcctgctaggtcaaatgtaaactaccctacttgactttcatgacccttcatgaaatgactctcctatattagtcttctatttattattcttcatttcttttggttaagccacttccttcattgtagtgtgtgtgtatatgcactgtaaaatttcctgggtggtgcctctgggaatgctctgtatcttttcctcttcacttatttcttctaggcttaaactaaatgactctctatacatgaagatttaataaattaataattaactcaatatgaatttatggaacattaataacaaggcatagtgtgtgtgtgaataatcagacatgttccctgtcttcatggtatagaaagaaaattaaatgaacaatcctaaaagagtgtgattagtactatgataagaagttttccatttttctttgatttctagcattctctcttctctaaacttctcttgcatgtataatttgctactctaaaaattagtacttattatagttgttatgattactaattatttcaggtgcatttcagtgcctctcaaatttaattttaaactctttgaagagagagaaaaccagctttattttcttatacctttggcatatcttgcagcacctgaatcagttgaggaagcttaatgatgaccacagcaaggagtttagaattgaatcttaggtttaattctccaatttaccatttcctactattattttgggtaaactacttttagaactttaatttcatcatatgttaaatagcaataacatttttcagggaatttctctgagaattatttgttaaaagcccatagaacatttgcaacagtgcctttaagaactccaaaactggtagctatattttgactgaaacattagtgaataaacagattttgtgtatctcatcaagaaaatgcctaataatgtaaaggtgctttttatgtcctttaaaactctaagactgacaaaatctgtgtatagcattgctcgtgtaaactacatgaatataatctttgcagagaacctaatattttacattaagaacgactatctcagtgattgtgtgtgctgtgggatggtccttatgggcccgctaaagtgggttcaggaaattctgctttatagtgtgaataagtaatttggctagttgggaaattttgtaagagtctgtggactgtttaatacctcaccattacttttagactgagaactgaaacttgtgcttcttatttctcaactcactgcctaatgtcagttcatgttaaaggcttctttcacaaaaagcttcttttgccctaaacatagttctctattgagagtcttaattagtatagaaaaataggtctttagctcttttttaaagggaagactagtgtggtggcgtaacagagcggactgattttaggctatgaaattagcctgatacagtgagaaggcatatgttttacagactttttcttttataattctcagagaaattccctgaagaatgtgtttcaaggtgctgctggagcatagcagagagaaatagcaaaaatggagaatttgtacttgatagtatccttcctcgtattactattgttgtttcatatttttcctgtaagaaaataaggatttatttgccagacagtctagtggtgctgatgtcctcacaaagaaagaaaaagcttgatgtgcacatctcagaaaaagaaagagaaagatagaaacatgacataaaaagtaattggtgtcatgtatttatcacaaacaatccattactcttcatttttttcaaactttcacttttaatagttttatttcataatgagtagtaactgaacatcttttctttgattgtttccctgagttatcactttgtagagaaccatgaaactgtgaaatttgaaaattgaatatgcaacagaggtaaaagcctactaatgctgtatggcattttgtggaataccttttattctcttaaaaacaaaagaaaagtttgtattaggttatctttaaaaatgggccacattaaataaattttaaattattaaaaaaatctttccctggatacagtttgattttagcagaaaaaactataaaaactgcttgtataggcatattctatatttggcagagtggatgaaagaaagggcttttctcctcctaatatgttttttctttgcttttctggtaaagggtctattttttttctttatttgtttttgtatattctatgttttattcatctttataggctaatatgcctggaagcacacttattttaacaaacacttatatagctcttgtaatatttgttgccattttatgaattttatagctcataacacatattattaacttatgtaataccccagctcatataactcattatattttaacttataatcctctagcaacccagtgaggtattagatgctaatattatccccattttgcagatgagaaaattgaggcatacaaggattgacttgtatgtgtgtgacttgtccaaggtcacacaactggtgaatgatggaaccaggatttgaaccaaagctatttggcttcaaattctctgtgcttaacccatctttatgctgccctgcaagttagtgttcaaaacattttattatataaatgaaagagaaaatagagtgaatgaaataatatttcctttttaaaaagtttattttcgttagtgttaaattttggagataaatcatatacatataaattaattttcacttatcccattttctagatgaggaaacaggcttagagagtttagacaattgccctagattatacaattatatataactgtataatataactgtataatacagattataaataacagagcctgtccttgacccaaatatcctgacttctgcctccagtttcttaacaactgctttatactgctttgctgccattatattttactgcatgggaggaccacaatctattttatttattagtgaagacatagtcagtttccagttataagcagtgctagcaaacgtttagcttcttcactgaatgaatgctctgtattaaaaaactacatttattgctatgtgggataaaagtaagtcatttcctcaattttctatacttaagcaactctattaaaaattttggtacagaatacagatgaaaatttgagaaattccttatatcttatttcttccttcagacacatagagtgaatagatatttagtcaagtttactaaaaacgacaataaaaaggttctagagatttaggagaatgacagaaaaattatatctaatcagtggctagttacaatacatgttaaatttattacaaatgttaaaaggaaaatgttttgatttgtagtctaacttttgtttagacacctcttatggttggtctttgctcactcagggaagagatcatcaaacgttttaaagtgtatttgctagatgtttaaacataactaagacacagagcacatatcatccccaggaagataatgaggctgtcacagcacaaaatgttctttgtttttacgggttctattagttaatgtattagcaattttctaaatgccacttttgcttattaagaggttttgagagcacatgaaaacatacattttattcttgaatgcagcatttctgagattattagcaagtgtgattctgaaggaatattttcaaatactctgaaggagcatttggggtaaaaaaaaaaaaaaaaaacacgttagacacttttgcccatgcagcatctacatgaaaataaagatatttttaaaactgtttctcctatttatagcatctcttattgataatcagaaaatttgcccttaacttgcagtttcattcaccatcattaaattagatggtaaatctgatagtgatttataaaacaaaatataatattttcatattgtaaatgagatctaattattaataaatttaaactaaatgttggtgcatttctaaaaacaatctattttcacaattcaattttgtgaattaggaaatctgagatttcctaatctatatagttagtaggacatcaggaaacataagcgtgtttcaacaaatgccaaaatgactattaaaaaattcaaagtcattcttttacaatatgtgtgtgtatatatatatatatgtatatatatatataatttttgcatgtgtgctgactcttctccatccccactatccttcttttcctccctggaatatattaccttttctcactcttctcaaattcttgtcccattactttaatgatgtctttcttccccactgcagcttttaatcattcccccctttccttctctgcctctttttctctccttagctcttaacagtttttcctatgacagtagttctcaaacttcagtctcacatggaaggcttgttaactcagatttggttgggctccacctcctgaacatctgattcaggaagtctggggtgaggcctgagaaaaatgttgaaagtgttccccggtgatgccaatgacattattttgaggaccaccgtttgcgaatcatgtttataaaaatcacctgtcactatgctatcattctttattgctgtttagtaccatttgaatgcattttttaaagaacacacttttaaatatttatttagtttcctaattagtaattaaataaaagcctaaactaacatttcatctcaatgcttggcaaagaaatgcaaaccaagttagacttctgctgaatttccatcctgttgaatagcaatctttaaaagagtctatatttttaggctttgaaaaaaacattaaagagttctcacttctgtttgcactgtcccaaaatacataagaaatgtttgaaatacgggctggattatatttttgaagtataatggggccatttttataaaatgataatctttttacctgaacttgatgaggactgttactgtctagaatattcagtctgccccgagagtgtgctatgtctgccttaaagacacaaattaatttgtaaggtttttccaatgttctttaaaagttagaaaaaattagaactcattagttcaggaaattagagctttccgtagatcatagagaaaaaaggttgcagatgcctgtttaagtattttagaatttctatccatttttaatattgtgatgaataaatgtttctaaggattcaaaatactaattttcagagaatttcaatcatatgaaaatattgaatatatataatataagcattccttaaaaactaacttggctcttaacttgcttgtaagtggtctagattaggccactacataccaacctagccgctgatcatcacacttctttagagaactttaaaaaatgcatatatgttgctttctgaccctatcccaagatagattccaggcccactcatctaaaatatataatcttaagttgtgtaccttatagttgtttaggcactaaggatccctgatgttgtaagtgctgatctgtcagttttacaaaggtattatcagtggctttttcaaatatagaaggatgaccagttgtgataagctctctctctcggtgaactactgaaatagcccaaacaaaagtacctctcttatttttcattttttgaactactggacctaagtacaattagctatgtttcagacaaaaggaaaggctttaaattggatgacttgatccataatcattactataacaaacactcttcagaggtctgtctgtaagtgctgacttgtattctgtgggtattgggaactgacaatatcttgttcccagagtatttaatttgataatcttaacgaaagaaaatttcttagtgttttctatcgagttttttaaacttggttttgcctcaatgtatctcttttatatttacatctcatttttaggaacattaatattggaaaattgagctgataaaacttgctgtcaaaattgcaaacttcatttgtagaagttagcaattctgtcttgtatttcagatttctgtgcatattatcacaagatgattgctgaataagaaaacaatgattgccctatttatttctctttaaagaataactaaaatatgtatctctttctaaatgcttatctttagagcagtaaaattttaagatattaacatatataccttaaataaacttttatcttgataaggggtaaacttttatcttgataaggttttttttttcttttgcaagcaactggttttttaaaataacctaattgtctatactgatgagctgatattatttttctatgaaggtatatatttaggtcaggtatacattccttaacctggaatccatggttcataagagttcatagcgaatttcctaggggaggttcataactggaactatgaacatataaaattaactctgtaaaactatatgaaattgtgcgtgcaattgtatgagtgtgtgtctgtgtgtttatgcatgtgcatatgtgtttaaaatagcatttatagctatcttcaagggatcggtagtcccaaaggagtaagtgtggtttagggtttcgtgcagacattttatgaaaaattattttaatcaagataacctgagaaataattgaaagagctctttagacaataattatattttttctataactaaattcaatttggtacctcctaatttggcagaagagattacaagtagtgaaatttagtttcaacatttgttataaggtatatttttttcctcttttgatggaatttaaggaatagccaaatattatagctttcaagatattttttgaagttttgttttaccttctcctggtgattttttttttattttttatttattttttttttatttatttatttattttttttttgtagacagagtctcactctgtcaccaggccggagtgcagtggcgcaatcttggctctctgcaatctccaccttgtgagttcaagtgattctcctgcctcagcctccagagtagccgggattacaggtgcgcgccaccacgcccagctaatttttgtatttatagtagagacggggtttcaccatgttggccaggacagtctcgatctcttgacctcgtgatctgcccaccttggtctcccaaagtgctgggattacaggagtgagccacaatgcccagccatcctggtgatattttataaatcacaacccgttgctggaagaggaacatgactatgtcaaaacttgttgagcaccaaagtacgttctctgtgtatctgtagttcatcttatgctacctctatgcaatacccaaattactgaacatgcattcatgagaatctaattgatgatagtccagatcttctgtactagcttttttctaaattgaaaacttaattttactggaaaggatgctggagatgctcacaaattttataaagatagttataaaaacatagactactgagtaccattactctgattagtcatgtagaaatataaatctatatatttggtttaaataattctttaaacattaaaatttattttaaaaaatatgacatgaaccagtagatatttggatggacagagctttataagtctggaatgtggttgatttaattaatttaaatgcatatatctcatttgttttctttaggacttgaacgtatttcagtggaaacctctcattttcatacttattaaaaagacaagtgtcttgttcacccttaacattggtagatacagacatagatgaaagaggtataatagcactatggttaagaatgagggctctggagcccaataggttggggctgatttttcactctactttttggtagttatgtgaccttgagcatatactgtgcttcagtctctctgcctcagtttatccagctatgaaatggaaattataatcaggcttgccatgaagattgagttaatacatgtaaagcactttacgcagtgcctaatacaaagtattcaataaatatttgctatcattcttatcaattactgtctgatagattgaatattaatgtaatgtttctaagtatgaacttaatttcagtttataaggccaataagtaagcataataacatgtttcttaaggccagaagtcaaggatgaaatgtcacttgaataataaaagaaacacatgtatctggttatttcatataatctcttcttttataaaatgagttaattcttcttaattagcacatcatatagagtttaaatattaaggttgaaataatatttctttcgacgtgttcatagcaatattctgtctttaaaatgaattaacaagaattcagttttaaaaagatattttaatgaggacagctatgttaggcagatcctttttctattggttgcaaagataacaaaaggggtaaggttaagcaaaacttgttcaaaaataacaaaggaagattatcaactttattctgaaagtttagagacctcttttatgattagaatttagaggtcgtatatcacagtttggggaacttgtttgcaaagtactggtatgcccttagaattcacaaaacttgattaaatagatattgctggtctggaccacttatgcttatgttagctggttctcttgatttcacctgccagcaaagtgaagtgacacatggaatcattacttcatgtatgacaaatgcaatcccagggaaggaactctgaaaaagataggatttccttgactgaagactgtgctagcactccttaacaagctattcaccatgcaaatgaacaacagtgtcccacactgaaacagctgttaactacataaaactgttaaggagattaacagtgccagaggctgaaatgtaatcaggcaggtgaaatagtggtaagataaatattcctgtgtgaaatagcaataatgtttaattaatttatttttatactgctgcagcaactgagtttagaatacttgtgaaatatactaaactttaaaacatttatttttctctttgaaaggtgtagaaagttagagatatgcaaaatgggataccttatctggatattttttgatatttttgatattttaatagacttgatttcattgtaattttcaattatggcaattaaaggtcagctgcccaattattgtttctaaagtttgtcatcatataatgtgaaagcagagtacagacagaaatgttcaaagtgtagctaacattgggatgtttctgcttttggtcctggaaagaaataagaaggaagatcttctgtggaaaattagtacagaggtttcgcaatattctgtttgcacatgaaactaagctaatgtgtgttatggaccattcataaaaacattcctattaatttactgaatgaatttgtgattgctctttttagggctctgtgtgtgtgtgtgtttatgtgtttgtatatttatgtaggttttaataattccagaagtgtaccttcacttaacgtgcgggagtttgtaattgttacattttgtacattgatttctaaatccaagtatgttataagctactttgtccataaaatattcactcaaggcatagtgctagtcagaggcatattctgtaatgtttgtgagaaatgaaagccatttgaggtttagaattataatttggaagattctgttgtgcacattttttttttcgccttccccacatgcctcagccacatgcaacaaactgatgtttgtaacatagcctgttgtccctgtactcactaatatcttaacaacaaaaaaaaacatattaacagattatgtttgtgttgacgtatctatttttaatctatttttcaaaattacactgatggtttttaaaccaagtatgttagcatatttttaagctagtccaaaatattgcattaaccttaaaaatattgagtatcaatcagtgtgatttgttactttttggaagtcaacagattgtattactgtgtctcaaataggtagagaagaaatgtgcaaacaggtataatctaatatcctgaatattaaataggcacacattcaaatatattttaatgcgaacttttaatgttgtagaattaagaaatatttttagtgtgagtctcaaagatcttaggatacagctttatgtttaagatgtctgttttgtgagaggtaaaggattatggaagtaagagactatacaaggaaaatctttaagtaagaaaattaatttttctttatcatttcattatcactcctcctgataatttctaaaaaatcaccttaatatgttttatacaaaatattccccaaatattatacaaattaccagatttgtgctagaatatgtgagaaaatgacaatagactataaaaagatatttacattttagaaccatacaataaattatttttattcacatacccacatgactatgaagaagcaaaaactgcaacaaaccttattttatagggcaaatgaggattaaaatacaaaatagcaaagagtgttgacaaactgtgcttcatgtaacaaatgaagttgaaaatgtcttcatcataggcagaattgaacttggaatattcttgtctgatgtcaaataacctgtgtgatggatgctttcttaaaagaaggagagggaggtggaaaaactaaaactttattagagtattatcaagaagaggcagctactgaaaatgaacataaattgtgtgtaatgatatttgtttaaatattacaaagtcaggaagtttaacacaaatgatcactacatttaatacccataagaaaatctgaggctctcaaacaaaagcaggaaaataaacaaatctaataatataggcttcgtataggactatattgtcatttatactcagtttaaaggagagaatctccatatttggtttctcctttgaatagatctttgacttactctagtactaccatgaaaactgaatttattcttttttgaaatttcttggtttctttgcctcttgcagagtgacatttcactttttaatctttcagctgaataagccatataaccaattttttaaagttactgaattttaaacaattatttgtccttttgctttctctttcaggtaaacaattatttgtccttttgctctctctttcaggtaaacaattatttgtcattttgctttctctttcaggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaaggtaaaggctggaagagaaaacaaagttgatgctgtgtcctgattttaatactttgattttaatttcttgatttgttttttgatttatactcttaaagttaaattgggcaagatggaaacctattgctatgaagacggttggtatatttttttcagaaacacttagccctgtctatctcaattttttaaatcattaatttatgttgtgatgttattttcacatatgagtaaattagttgcatgaaaaagattcaagaatagaatgtggcagcagagccgggaatagtcacctgcttgtcaaatatctgcagcctagtttgtttctctccatttttttttcccttgaggattaatgtagaatttcactacattttgtaacctttacacattaatacatcttatcctgtttcttgtatagtcaaaaattaatatggttaggactattatatacttacaaattagtgattctttaacttttagatatgcttaagttcctatttgttcaacttccagaaagtctttcttttaagattttatcctctaaatctctttaatagttcctgataggaaccttcaggtgataggcaaatggactaatcttaaaattaaagcaaacaagccaataaaataactgttgcaaattgtacaaacttatgcataattgacaatcatcctttatgttacacatgcttactaactcctatttaaacctctgtccatcctaagcatgggtgccatactgcacacaagaacatgcctcctgtttcaatcagatggaaatttaaaacaaataaacaatgatgtgcagacatactttataacaaaaatacactgcgtgtataccgtgtaacaataagttgggctcatttctagtctgttaggacactggtaaattatcaggatatctgacacaaaattctgttatcctgtatatgtgacagccatgtgacaattaaatatttctggttccctaccaagtgcataactgggacctggattttggttaaaatttatgcagttctcatgatctgagaattggaaagaattttagagatattcttgtcagccaaagattttggatattttgttacatgtcctcctattctcatggagataaaaatgcagtgttgagggggatccagacaaccttatgtgtttaaaatggtggattgtttcctaatattaaaaataagacagttttataataattattttaaaaacataaaacattataaggaagaaaataaaaatcacctgaagtcatagctattcctgtgtgaaacagcaataatgtttaattatttttatactgcttcagtaactgagtttagaatacttgtgaaatatgctaaacttaaaaaacttttttcttcctctttgaaaggtgtaggaagttacagacatacaaagtgggatatcttatctgaatttttttgatatttttgatattttaatagacttgattgcattgtaattttttgcatgaagtcatggctgcaggtgatttttattttcttataatgttaatatgaggttaataggattcttaaccttaggatgtgttttttagtgtttattttcatatattctgctaattttttatgattagctttatgcagatggtccccaacttacaatggatccacttaagatttatcaactttaagatggtacaaaagcaatacacattcagtaaaaccatacttcggattttgaattttgatattttcctgtatgcagtaggatactctctctcattgctgggcagcggcagggagccatagctcccagtcagccacgcaatcaagagggtaaacaatgatactccacagtacgttgtgttgccagatgattttgccctgtggtggactaacaacataagtgttctgagcaagtttaaggtaggcaagcctaagttatgatgttcagtaggttagctgaattaagtgcattttttacttaatgatattttcaagttgcaaagggcttaaggacataaccctatcataagtctaggagcatctgtacttttaaaatattgtgcttcctatttcatttagaattatagtatgagtgtgtcttctgccaagtaatatactttgaaaagaaataactgccaaggctgggcacggtggctcatgcctataatcccagcactttgggaggccgtggcaggtggatcacctgagttcaggagtttgagaccagcttggccaacatggtgaaaccccgtctctactaaaaatacaaaaattaggcaggcatggtggtgtgtgcctgtagtcccagctacttgagcagccgaggcaggacaatagcttgaatctgggagggggaggttgcagtgagccaagattgggccactgcacaccagcctgggcaacagagcgagactctgtctcaaaaaaaaaaaaaaaaaaaaaaaaaaaggagaaatgactgtcaaatattctgaagtatggccatgatttgctattgtaatttatacattcactttattttttttaaaaacagttttagatttacggaaaaattaagcagatagtacagagttcccatgtattccatccgtatacagtctcctctcttattaacatcttacattagtatggtatatttgttaaaataatgaaccaacattgatacattattattaactaaagtccagagttgatttaaacttctttagttttcaccaagtgtgctttttctgttttaagataccatcaagggtaacacattatatttagttgtcatgtcttcttaggctttttttggctgtgacagcttctcagaatgtccttgtttttcatgaccttcagagttttgaggagtgctgttcagatatattgcaggatatctctctattggaatttgtctaatgtttgtctcaatcagatgagatttggagatttgggaggaagaccacagaagtaaaataccatctttctcacctcatgtcagttacatactttctatgtaattaagaatgttggtgttggccttgatcattggctcaagtagtgttttgcaagtttctccacgataaacttgctctctgtcccctttctacaccatactgtttgaagcggaggagctctgtacaagccacacttacggaatagggagttatgttactagagctggattgtctacataatatttgcatttttctacatgggagatttatctcttctctaccatttattgtttcattcaatcattttttacatcagtatgaattcacgaatatttattttatattttgggtgtcatttaataccactattgtgcttgtggtaatgattgttattattagtttagcacttcttttctttctgactctgtaagatattggggattcattttgtatatttcttgctccagtgctagaatcatccatatctccaagaatctctggttccttttattggagaatattagaatgcaagatctgaatgcagagtatatcccttgcttctgacgtatcgttcctttgagggcctctgagcagacagagcaatgaaaatacatgtgtgtgtactaacctatatatgtatatatctataaatatttctatatttgtctatattaagctgaacatgagttcttactaatgtctctaactggaatccttttttgcatggattattgcagcttcatttcttactgatctgtacatttccaccccaacagtgagaaatatggctcctactaaccaccattaatttatataattgttcagttctagtatacatgtagaagagtatcagaataattaactgctactaccataggaaatatctttctcaactagagaacagtgtatgtgtccttttgcttttagtcttacagattccattcatttccaaagttactaaggtaacttactaacttacttttcccctaccccattcagtgaaattgtttcatgtatttttaacacagttaaactagttctgtattctttactggtgtccctcacactcctctatgattttttaaaattttgcttatgttaaggctcacttattatgttgtattatacatttatatgtgcaaatgcatagaaatgtacaatgtataatgcagtatgcattgacaaatgcatattgtcatttaccactgacagtatcatgtagaatagccttcaccactccaaactatcctgtttcacctattcatcccgcttttttccctagaatcccaagtaatcactgatcttattaccatgtatagttttccctttcctagaaaaccatataatcagaataatacagcatggggctttttcagactggctctgtcacttagtaatttaaggttcttccatggctgtttatagcttgatagctcatttctttgtatcagtaaataatattccattgtatgaatataccactattttatcaattctttttgcctatcaaagcacatattggttgcttccagcttttggttattatgaataaagcttctattaatactcatgtgcagctttttatgtggacataagatttcaacccaattggggaatgtgaatgctggaatttatgagaagattatattttagccttgggagaaactgccagactatcttccaaagtggctatcagattttgcattcccaccaggaatgaatgtaagtttctattgttccacattctcatcagaatttgatattgtcagtttattttattcattcaaataggtgtgtagtagtatctccttgttttaatttgtagtcctctaattttaagaaatgttcagcatcttttgtgtgcttatatgcctttaatgaagtgcctggttagatctttttttgatttaactgaatcattttcttgtgaatgagtttttagagttcttagtatattttgtatacaacttctttgtcaggaatgtgttttacaaatatttctaccagtctgcagcttgtgtttgcattgtcttaacattgtcttttgaggaataaacattttaattttaataaaatctaattattaattgttttgcatggattatgcttttgatgtctgtaagcaatcatcacataatccagggtcgcttagattttctcctatcttgtcttcttgaagttagtgtagtttttcattttgcaatttaggtctgtgatcccttttgagttaaattttgtaaaaagtagttctgtgtctgcattcattcaatttgtttttgttttgcatatagaagtccaattattccaagaccatttgttcaaaagaccattatttcttcgttgacttgcctttttccttgctaaagatcaattgaacgtatttgtgtggatctgtttctgccctctgtattttgttccattgatcagttggtctatcgtcttgccagtatcatcctgtcttgattaccgtagcttgataataagtcttgaagttgggtagtgtcagccctccaactttctactttttcttcaacattgtgttggtgtcctgggtctgttaccttttcttgtagactttagaatcaatttgttgatatccacaaaataacttacttggattgtattgggattgtgttatacctctagatcatgttgggaagaattgacaccttaaaaataccaagttatcatattcatgaacataaaatgtctccctatttatgagtatctttaatgattcctggtgagttttgtagttttccacatatagatcttaaacatactttgttacatttatacctactatttcttttttgatgtaaaaatttaaatgtaaatataaattatattgtctttttaattttatatttcaattgtttgttgctgaaatatgggaaattgactgtagtatattccccttgcatcctttggcctttcaggactcactattagctctagtagtttttactgattccttgaaattttctacgtagacaatcatgtcatctgcaaacaaagacagttgtacttattccttttaaagatgtgcactttcttttttttttttttttttgtcttcttgagttagctaggagtttcagtacaatgctgagtaagtaagagtagtaagaggagacatccttgccttgttcttgattataaaggggaaagcatctaattctcaccattaagtatgatgttagctgcgggatttttgtaatttttttttttttttaccaagttgagaaggcctcactctattcctagtttgctgagagtttttattatgagtaattgttagaatttgtcaaatatttttctgcatctattgatatgatatatgcttatttttcattagaccgttgatatggttttaaaatgccaaaccaggctttgcaaacttggaataaatcctaccaggttatgatttatagttattttgatagattgttggatttgatcagttaatattttattgaggatttttacatctatgtttatgagatataccattacattttatgtaatgtctttatctgtttttgttgctactgccagcttcatagaatgagttaggaagtgtttccctctcatgttaatttttgattttcatttgagatgcctttagagttcagggctaaggtctaccaagaaccagctttgtgagagtatgtgttgtattttaaaagtagcttttgggggctcagctttagatgatgttctccatggaaatatggtatatggccttggtattccccaatgtatcatattgatttctaagtggatacatagactcttaatttggaagtgtatgacatgccaatccccatgagtaagtcccaacaggaaagagcacaggagatagatacctcccccacctaattttcttagcaggagacattaagaaatactgggggccaggcacagtggctcacacctgtaatcccagcactctgagaggccaaggcgggcagatcacctgaggtcaggagtttgagaccagcctggccaacatggtaaaaccctgtctctactaaaaatacaaaaaaaaaaaaaaatagctgggtgtggtggtgggcacctgtaatcccagctgcttgggaggctgaggtaggagaatcgcttgaaccccggaggtggaggttgcagtgagccaagatggtgccactgcactccagcctgggtgacaaagcgagactccatccccgccccccccccccaaaaaaaaagaactactgggaattagaaaagggtaatatctagtaagaacaacttgggtataaaagaagaaatagagcaatagcgcgtccatagcaggaaatgtagacacaaagaaacgtcactattgtacctgaacatgagaatgtttttattttatttcctacgacaatgtaccttttgtactttcttctctacaaatatattaaaagctgagctgaggagtgacttggtaaataaagacaaagagaaaatacagaggtagtatttatgaaagattggaatataaattgcacaaagcaagcatctaaaagtgttagtttcagaaaggtaattttagcataaacatagaaccactaagatgcattgatgtttacatacacaagattctttgacatgtactttgaatatacaaaactataaatagactcacttttattgagaatttgctatgacaagaacgtttatttaataactgcaatgatgggagagatgcatcaaggagtaatttatgtatttgagtaaggcaatgatcttaatcaccaaaaaaaacagtaacaaagcaaaaattgtatcataaaaaagaatagtagaatgttgacagaactttgtttttctaaattacaaagaaagaaaaatgggtatatataatataaatataaatatatgtaatataaatatatattatataaatataaatatatgtaatataaatatatgttgtataaatataaatatatagtatataagtataaatatatataaatataaatataatatatataagtataaatatatattatataaaaatatataaatgtatatatattatataaatataaatgtacattatataaatataaatatatattatataaatataaacatatactatataaatataaatatatattatataaatataaacatagtatataaatataaatatatcttatatattatataaatataaatatatcttatatattatataaatataaatatatcttatatattatataaatataaatatagcttatatattatataaatataaatatagcttatatattatataaatataaatatagcttatatattatataaatataaatatagcttatatattatataaatataaatatagcttatatattatataaatataaatatatcttatatattatataaatataaatatatcttatatattatataaatataaatatatcttatatattatataaatataaatatatcttatatattatataaatataaatatatcttatatattatataaatataaatatatcttatatattatataaatataaatatatcttatatattatataaatataaatatatcttatatattatataaatataaatatatcttatatattatataaatataaatatatcttatatattatataaatataaatatatcttatatattatataaatataaatatatcttatatattatataaatataaatatatcttatatattatataaatataaatatatcttatatattatataaatataaatataaatacatattatatattatataaatataaatatatattatataaatatatattatatatcatataaatataaatatattatatatacacatgtatatatggagatgtatacgactcttccaacaactggtaagctacattggcttcaatgacttcattaatcaaagggtatgatttgacctgagaatagtcaccaaaaccttacatcatctaagcatcaggacagtgacactatgtacagcacaaatgttccaaagctctgtgatgcaacatagtatcagaaagaataaaatacttaggagtaaatctgacaaaataactaaaaaacttatactctaaaaactacaaaatattttcatagctctgtaatgggaacaacatcatgactatgagggaagcaaagatagagtgaatgtaactaaatgttaagctcacaaatatatgccacagaaaaatcttttcttccctcaagctatttttgccattgtttttcaaaggccattaaaatgaacagcaggttgtgatgaaaatttcattaagccccagctaaatcattatgagggtgccatattcatgtctttgcttcctttcatggaggtggggaacacagatttcaatagaaagtccatattatttccgaccttacccctgccaacagcaaactaacacaaattcagaagttagaaaagaatagtgcaccatacaaaaggaggccactgaggtgaaatggttacaaagaaaattagatttgcatatgggttgaagaagagacagctctctttcattttagccagcctatttttcaagtgattaattaaaatattttgcaacttataaataggagaataatatattgatatatttggcttgcatctttttttctatcagaagttttccctgtcattacacaaaaagctctgattcttatttgttcttatttatccagtgtcactctaactgaatgggatgctaaagtgcatggtctattcatggttttaaatatctggcctatgtaacatagttacattatattttgtgataattatggtctatcggttggtcttcagcaattaaacctaacagttaagagtgacaatgaaatttaatatgacgttatgtgacacataatttctataattcctctatcaagacattgaatatataattatgtattgaagggaaatgcattaaaatatataaattactatatataaattgttaccatgtattaagtgtatattatgcattaactgcaatattaaataatttatataaaatgcttctttcaatctcgatgaaaaccttataaccagggctcctgtgtatagccattccagtttcagggaataccattcacatgatctcaatatcctcattcctattatctccatttccagatgaggcaactgataattaaatatgttttaaagtgaccaagtcagggtcacttttcagcctaaagtcaaccttagactagaatctatgcccttaaccaatacttattgctattccttccaatgagagattttgccaaataatcatttactattatcatttcacacatgtgtatctaaactttaaatattgaataatatattatctgaaatatttaatagtattgaataatagtagtgatcagtagttttctactaaagtaaatttcttatgcctcaatagagatcaattttccagaaaacttttaatgggagattaactcagtttttactgctcaaaaataatgccttggagggtaccttaagaaaaaactcattttagaaaaatgtctgagggcgaaataattgtggaataataggaattaaatatttgggtgaaacatagatacattttaggactccattctcactgtagaaagagagagaccaagacagagatatatatgcctgagatcacacagcagttgatgttaaatctaaagcaagaatccatttcatgatttatgggtccaggttccttttttccctttcagttacatcatacattcagatattcttttctcgcttttgttttttatattttagaaatagtgttaccatcttagttttaaagaccatttcattaaatttaaacaaatcgaaggcaaccgactatcttaattttgccaataagtaaaggtagatgactatccctcagtgtcttgtgttctctacttccgggtgtccagcagtggtcataaatgtggatcagcagttaaattgaggagtctgatttaaacttgattttcattcaaactttaggctaattacagtttaggtgaaaataatttttaccatgtcaagaacgttagaaatctcaattaaaataaaatccttacagatacaatattttaactggcttattttaatctttctatattcatgtctttgtcaccttcagcatctctttgaaatggccatttcagcttattcacacagttaagtttcttcctcctagaaccacaacagacacaactcacttttcattgatttccatcccttctatctacaagtctattcttcttgcctccaagctattttcaccttcttacctctttaagaactgttatttgcctccattgttatccttactcagataaaactgtccatttatttgtcagtgtcttctgcagtgttaaactccttacttttgagggaagtgaaatatttgtgaaaagaatgtttctactgcttcagtgttgccctcttgctgccttgggtaaaggaaaggagagaccttaacaaatgtccaactctcctgccaggtgttaatgtgggctgtttcatgtaatcttcaaaaacacttaaattagtataagttcttatcttaaaaatgagtaaacgaggcttactgatttgctcgtgttattatatggaggaacttgaattagaacaaaagtactatcagctaaaaattccttagcattgactaaaaaatcatatgtaatctgactctaccctattgttctcccttaactttattttccaccactcttcaaagtacatgttgtcatgcaatcttgtgaaatcacgtgcagttctctcaacactctttgtttttaatattactgtgctgttttatatgccgttccactgccttaaatgtcgtttcccgtcttacctacctgatgaatttttattcacttcttaagactcaatgatcctcaaacaactttgtcagaattcgagtcagtctacactgctaatgctaactcatctctatagttcttaccacattattattgtttatttacattctgtcttctacagtagcatgtgattgtctaaataaagtgttcttgacttggggactttggaggtgcttgtttctcttaactgtggatgacagtcaacctactaattgacattttgtagccttgctaactctcccctacaaactgactaggtgtaatttgtctttttaaacaatttctgcctttctctttttaaatatatcctcacactcttcttttacctccttccctatttgactcatttattccatcttctccaatcttctgacatgtatacccctatccttattgaattgtaagatcatttcttttcatttttttctgtgacttagaggttaaaatattctcctaggtcataaagcaagatattttaatacccaagatataaaattgaaatacacacatgaagtgatttttatacaagtgaaaactttatatttacattaatcttttaaatgactttaatactgcatacttctctaagaagatatggtaacgttacctatggattagtggccatagataataattctcttcaattgctataggtaaagtgagaagtgaattggcttgatttttgaaaaatgttctagaatttaaagctgtaacttgttctttaatagtgtttcaacataatggagacaagcacccttttctaggtaaatagagctggtatgggagacagtttgtatttcttatgatgggctccagattggggcaattttattattggatctttccctccacaacctctcctttcctagttcttcttaggggatacggtgagagaaatgtaacgttcctgttaagacctttcctgttccttctagtcttccaagcttccctcagaggtagcagagtttccagactcaggattcatgagtttcttcagaggctttatagatcctggaaattgtttgcaaaatgatgaaaatatatgtatttgtacatttttggggagataatccacaactttggctttcaaatgaatccacaatgtaaaaagagtaattagactgttagtattcagtgtttgagtttcagtcctgagtctgtcactgattactaagtgattatagtttaacatctatgtagtttagtctctgatcaattttgaagggataatttacagatatttagcaatatttggggtataattttatctattttggttcttgaattttgcatcatttgcaggaaatgcaaattttaatttaaagtaagggtttttttttttgcctaaaagtgagcatctaccttgtaatttacgttgtaaaaaaatatatttacttgcctttaatttgctataataattgtattaatataataaatatctgccctcagttggcaatgctaactgccctactttcatcaggggattgttgaaggagacaaatgaagtgatgtatatcaaagtactttgtaaattataaacaacttggaattgtaccagttattgtcattatttcaccctggctaccttgaaacattgttactttagatataccagaaacattatgtatttcaatataattctcctttatacatttttaatattatgtagttaaaatctgctcctttcccagaatacttttatataccgaaacaccggattcagagctgcaaatatctggaaatttaggataggtagtcaagaacaagaacaataatgaactcaacagtcataaaaatcctaggacaggtagttactttgaagtttatttatatacatttccccaaataaatatgtagttgggcagttgcctaaatgaacaacaactttccaaaattttttttttaattaatggggattaaattgaaacttgtgaccagtgtgaaaccaggaggggcagttttaacattggatttgtgatatttctgtttccacagtaaatgtgaatatgagctgaagacaaatataattgaagcccacattttcatactttctaagattttagctttcctttacgtggtttattccccctgccccatcactttactttttttcttttccttccttttgtgtgcctgagtgtgcgcatgtgcctctgtgtgtgtgtgtgtgtgtgtgtgtgtagttcccctttcagatcctacatatgcttggttttatttagcatctgtatctgtcagtgttcttccttctgagcaggacgcctacacctccaaaattgttttgccatgatgagtgtgctccttgtgtgtgagaaactgcatttatttgtgaaatttttgtttctactagaactagactttatcattatttaaacaactagaactttttccctgaacttcttcagataatctttgctcacaattttatatttcaagaccctaaaggcacaacttattaccaaacttacctagtgttactttacatgaagcagttcattgcctttagtatggactttaaaaaaagagttctcttctgagaactaatgcaaataatgcaatgagtttcaaaaggtatgtatggtggcagacctcaagccttcaccctcaggatcatctatagactatagaccgttgttgggtaaaggaaataccaggattttcattcacattcccccatccgtccctctctgtcctactgtgcaatgcaatacaaattcttggagtcaaatatcctaaaacacccacttaatcccacctgtaccatttgtgggactggattggacagttttatgtttattcctggatgtttatgaacaaaacagtaacatatccattgttcattatttatccttttaaaacttgaaaaaaatcaacattattgtttcatttatcgttttgatatttgcatctgtcacaaaaataattcactttaattgattgcaccttctatgatacttgtattttttacagaaattatgttaatgtctttttaatttttcttacaaatgttttgacctataagaccattagatcctctaaatagatataaaatttatttccctgttttaagacttattttatgggtgctaaagaaggtattattagcagtatattttcatctgtgctgtgctacagaattacatgtaattattctgtagcaaagacaggcccctggtgcatgatatttggccttgtgaacatccctacaggcattgcatgtttgatgtttgagtttacattataaatcacaatgcttgttcttataatttaaatgtctgttgttgagcagccctttagaaattaaactgaaccatattacatcaacaggcaagttaaactagagcttcagatttaccccttaatcttaccaactttttaattactatttttatggggaaattatggagatcggctttcctaagttcaaaatcccaaagcatccattaattgggcaaagggggcacttcgaaattcactcttgttttaaaatcgcatttgatggggtgggaaaaataaaaagtgaacggatcaggggaaaagcctaaagatactttaattggcagaggtttgagttgcttttgtttagttactcactgtccttttgacaaagtacatgttgaagaggctttgtaagtgctgttccactgaaggacaaacaagggtacttttcaattgagcccttttaagttttgttcctcacactcccgctgctgttggaggctactcctaatgcattgtggctatgtgttcatctatgcagtctgtcactgaaaaatgtctctcttcttgttgagcaagctagagtctaacctccaggcacccttttcaaaagcaccactgtatggaaatcgacactcataaaatgatgataaagaaaagagtttattttttaaaggtcaggacaagaagacaccctcaaatgctgtagagcctatttcttcaggaataagtgttttaactttagcactgagttagctgagtttgaagcctcataatttttcaacactgaagcgaaacttgttcactgtcatctccttttcaagtggtatccatcatagcagtttatgctgatattgtttatttcattagtgttataggaaattatattttcctgaaatacctctggcttggattgtaaaggctcagaaattctgcttggtaatctttttatatagcaggtcctggagctgagtaccagtgttgtctttataagaaaatcatttgtcccagaaagcttctatttttctttttaactagagcttgtacttttgctaacaaaatgtaatgatatttaagattatagccttcattttcttcatcttctcttaataatcaagccatcattcttttcttatttggctatttgactcaataaaaaaagaatctatttgattcctgctgatacattagtttgtctactatcaggtctatgtaagtcattccaaacctctctttacccaagcatttctggtacttcttaagtccctcagataaatggtgtacctgttttcttgtccttcactgaaactagcatatccagactttcagtttcaattcatagatcacttaaagaaggcccattgacccagactctacatttgcaaataaacatgaggagaatgtgccagtccctcttgttgcttatgtgccacagcttttggggatatcacttattcaagagtgaagagccagccacctgtttctgaggcctcttttccctcacattaaaggtccaggcccttgctgaatagtaacactctaatctgggcagcatacatagcatttttctgaaacagatttgtcaagactagctggaggattttgtgtgtctgtgcgtgcatgtgtgtttttcactcagttacccttgaggcacttgtcaggaccgtgcatattaaaattaatcagacctcctaggcctgtgtggctgtgtgtttaacatgaagaagtggatatcaagcatttgccctaattaaataggcctgtttgggttggttctagtggatgcttggtcttttttttttaaataggagttgtttatgggaaaggcatggacagcactagagtcagtggagagctcactcagaatttcctttgccacctgctcccagagttctgacacctcaaggactcccagtgtacccatctgaactactcttgatgttgaggacaaatatggccagcatcgtgaaggagcagtgaggctagggcagaacaggatgagcatatgacctgggcattttggatgattaagatagcccatcttacatgttgataatctttgaatgccagattgtgctccttgctctcattttttggatgaccaactttggaggcttaggagaagaacttgtttgaaattaagaataagtgcttttttttttttttgatgtcctgaatttgaaaagcaacttctattcatctatcttttatattaattgcttccaaggttatttacatattatatagaagtcatgtatgatataataactgcatatatatgagttcacttctactgtgattgtttctgggctgtcacaggacatttgaacacaaacttttatgaagtataagctcagaatactgaaaatggcacagactgacacaacacaatatttttcttatttgtgtattaaatgtcataaataaggtaaattctaaaacactgacctctgagtttgtgcagtttattcccaattcatgtgtgttattcacactcttcttgtattttaaaaaatgatatagaaagatatatttagaattttataattagatctgaattttatacacatacatgtgtgtgtgtgcacacacatacacacacagtcatgcatcacttaacaatgtgaatacattctgagaaatgtgtccttaggtgattttgcccttgtgcaaacgtaatagagttcacttacacataactagatggtgtagcctatcgcccctaggctccaagcctgtacagtatgttactgaactgaatatggtaggcaattgtaacaaaaaagtaagtatttgtgtatctacacataaaaaaggtacagtagaaatatggtattataatctatgggacccctgatgtatacgtggtctgtcattgacattcatgttgttatgtgtagagttaactatatgtggaataaatcatagagccaacattagaaaccatttgaaaataataataaattcccaaatgttgaagagtttgaggttatagttcagcaaatttctgaataaacacagccagtaatctggtgaaatattgctctggcaggacatggtacttaaaattcatttgctccttcccaaattgaaagaggtagacaattcaaaaaacaaaaacaaaaaaaagctattgcttttctgctttttatccctttctttccatcacatttagtattttaaaggatccatctattaacctatatcctctgtcttttatgtgagcatgcagctcatatgtagagaactgtatccgcagtgccaagcaactgtctggtacctgacagcaacatcgaaaccctcctctgttcacttagttgctgctggttatttattaacacaatgcagactgttcagtgtgggtgtatatgaaatagaaagaaaaataaaggccctgaacaagtaaatacatctttcatcatttcttttgtttggtgtgtttactgtgtgctattcttggtcaatagaagttgtttgacagttctgcaaaggggtaaggaacttttcttgaactttatccttttgtttgtctctgtagaaaaagttttcaatttaccattctctttttattgtaaattctctatgtaaaataatttttgaagattttattgctatgaatatgacaaatacaggtgattatgaaacatgatagacagtttaatttgtttgaaatggacagttaagagactagaatttcaagatagtttttatatgtaaactttttaattagaagcagataacgagatgtcttttttaactccttctaagaaatgtaccatttgttctcaggccttatgtaagctccactgaaatactgagtcttgatttaattattatttaagttgtctcctccccacacattaacataatatcaacgtagagctcattgcatggtataattactgaagagatcagtagctgcagaagcacacaataattgagcatgtctgtttattatagcaggacagtgctcctattatggtatttactgtgttaatagttaagaattgattcactgtttcacggaattaaatctctgttgcttagacctttcttttcggataagttatgctttgtctgtaaaaatttgcctgagaggtttgcataccacagtgtgacattagtcatgtggaagacttgggagcagaaagccatataaatgaacaaaatgcaccctctcccatttggagttctgttttccttctctactttttttttttaagccctaattttcttgcatcagtccttgctccagtactttaggatttttcattagtgtcaagataccatgtcttagtgaacacataaacggggaggctgccatattgggagcagtgcagtataaataagggaggtcagttgtcagtccttatatagtatagctctccagctttcagggagagaaaagcatccatatccaagtaaatgggataggaattagacgtgtttgctcatgttttaccttctcattgcttaagttttgaaggagaactatagccatacttgttctgggctgcaataggacaagccgttgttgctttatttattcttttctccttcggtggcatgggaatcattagaaatgaaacagtgtaactcacacactcattctcagcaaactaccgcaaggacaaaaaaacccaaacaccacatgatctcactcataggtgggaactgaacaatgagaacacatggacacaggaaggggaacatcacacaccggggcctgttgtggggtagggggaggggggagggatagcattaggagatatacctaatgttaaatgacgagttactgggtgcagcacaccagcatggcacatgtatgcatatgtaactaacctgcacattgtacacatgtgccctaaaacttagagtataataaaaaaaaagagaaatgaaacagtgtaactcaagataagttgaaattgttcattttctttgacacagccttttcacttaccggattacaattaggagttaataaagaatattagttaagtaaaaaggaatagtaaatcttagagttcttaattttttgccagattttttttctttgctttttaaattaaaactatttgaataaaaaataattggtcagttttaaagtatacatataatatagatatttatacactataccttttgaaatgttctatctaaattgcaaacaatatgaaaccttctaaaatattatctatttgttgttttgaaaacatagaattaaagtagtattaaatctatctctgtcctatagctgtttctatatctatgtggatactatccacaggacaaaattttgccaactctgtcggatctccgaaatttttctgaataaatacacgcatacaaacacatacatataaaataaaaataataggggcccccgggcaagatggccgaataggaactgctcccgtctgcagctcccatccagaccaacgcagaaggtgggtgatttctgcatttccaactgaggtacccggttcatctcagtgggactggttagacagtgggtgcaccccacggagggtgagcagaagcagggtagggcgttgcctcacccgggaattgcaaggggtcagggaactccctcccctagccaagggaagccgtgagggacagtgctatccggcccagatactatgcttttcccatggtcttcgcaacctgcagaccaggagattcccttgggtgcctataccaccagggccctgggtttcaagcacaaagctggacagccgtttgggcaggcactgagctagctgcagttttttttcataccccagtggcacctggaatgccagagagacagaaccgttcactccccctggaaagggggctgaagctagggagccgagtggtccagcccagcagatcccacccccatggagcccagcaagccaagatccactggcatctaattctcactgtcagcacagcagcctgaagtcaacctgggacactttaactgggtgaggggaggggcatctgctataactgaggcttgagtaggcggtttaaaccacctcacagtttaaacaaagctgccggaaaattcagactgggcagagcccaccacagctcggcaaagctactgtagccagactgcctctctagattcctcctctctgagcagggcgtctctgaaagaaaggcagcaggcccagcgaggggcttatatataaaactcctctctccctgggactgagctcctgggggaaggggaggctgtggacgcatcttcagcagacttaaacgttccctgcctacaggctctgaagagagcagtggatctcccggcagactgcctcctaaagtgggtccctgacacctgtgcctcctgacggggagacacgtcccagcaggggtcaacagacacctcatacaggagagatccggctggctctgcccctctgggacgaagctttcagaggaaggagtaagcagcagtctttgctgttctacagcctcagctggtgataaccaggcaaacagggtctggagtggacccccagcaaattccagcagacctgcagaagagaggtctgactgttagaaggaaaactaacaaacagaaagcaatagcatcaacatcaacaaaaaggacaaccatgcaaaaactccatctgaagatcaccaacatcaaagaccacaggtacataaatccacaaagatgaggaaaaaacagctcaaaaaggctgaaaattccaaaaaccagaatggctcttctcctacaaaggatcacaactcctcgccagcaagggaacaaaactggatggagaatgaatttgatgaattgacagaagtaggcttcagaaggtgagtaatagcaaactcctccaaactaaaggagcatgttctaacccaatgcaaggaaactaagaacattgaaaaaaggttagacaaattgctaactagaataaccagtttagagaagaacataaatgacgtgatggagctgaaaaacatagcacaagaacttcgtgaagcatacgcaagtatcaacagctgaatcaaataaacgaaagaaaggctatcagagattgaagatcaacttaatgaaataaagcatgaagacaagattagagaaaaaagaatgaaatggaatgaacatagcctccaagaaatatgggactatgtgaaagaccaaacctacgtttgattggtgtacctgaaagtggcggggagaatagaacctaattgaaaaacacatttcaggatattatccaggagaacttccccaacctagcaaggcagaccaacattcatattcaggaaatacagaaaacaccacaaagatactgctctagaagagcaaccccaagacacgtaatcgtcagattcatcaaggttgaaatgaaggaaaaaatggtaagggcagccagagagaaaagtagggttacccacaaagggaagcccatcagactaatagcatatctctctgcagaaaccctacaagccagaagagagtggggaccaatattcaacactcttaaagaaaagaattttcaacccagaatttcatatccagccaaactaagctttataagtgaaggagaaataaaatcctttacagacaagcaaatgctgagaaattttgtcaccaccaggcctgccttactggagctcctgaaggaagcacaaatttgaaaaggaaaaatgggtaccagccactgcaaaaacaaaccaaaatgtaaagatcttcaacactatgaagaaactgcatcaaacaataggcaaaataaccaactagcatcataatgacaggatcaaattcacacataacaatattaactttaaatgtaaatgggctaaatggcccaattaaaaggcacagactggcaaattgggtaaagagtcaagaaacatcagtgtgctgtattcaggagacccacctcatgtgcaaagacacacataggctcagaataatgggatggaggaagatttacaaagcaaatggaaagcaaaaaaaagcagtcctagtctctgataaaaacagactttaaaccaacaaagatcaaaaaaggcaaagaaaggcattatctaacggtaaagggatcaatgcaacaagaagagttaactattctaaatgtatgtgcacccaatacaggagcacccagattcataaagcaagttagagacccacaaagagacttagactccaacacgataatagtacaataatagtgggagactttagcaccccactgtcaatattagatcaacaagacagaaaattaacaagtatattcaggagttgaacttagctctggaccaagcagacctaatagacagctacagaactctccaccccaaatcaacagaatatacattcttctcagcacttcatagcagttattctaaaattgaccacataattggaagtaaaacactcctcagcaaatgcaaaaaatggaaatcataacagtctcttagaccacagtgcaatcaaattagacctcaggattaagaaactcactcaaaaccacacaactacatggaaactgaacaacctgctcctgaatgactactgggtaaataaggaaattaaggcagaaataaataagttctttgaaaccaatgagaactaagacacaatgtaccagaatctctgggacacagctaaagcaagtatttagagggaaatttatagcactaaatgcccacaggagaaagtgggaaagatctaaagtcaacaacctaacatcacaattaaaagaactagagaagcaagcacaaacaaattcaaaagctagcggaagacaagaaataactaagatcagagcagaactgaaggagatagagacacaaaaacccttcaaaaaatcaatgaatctaggagctggttttttgaaaagattaacaaaatagatagactgctagccagactaataagaaaagagagaagaatcaaatagacacaataaaaaatgataaaggggatatcaccactgatcccacagaaatacaaactatatatatatatcggagaatactataaacacctctatggaaataaactagaaaatctagaagaaatggataaattcctgggcacatacaccctcccaagaataaaccaggaagaagtcaaatccctgaatagaccaataacaacacatacagcaaaaaaagaaaatttcaggccaatatccctgatgaacatcaatgtgaaaatcctcaataaaatactggcaaactgaattcagcagcacattaaaaagcttatctaccacgatcaagctggtttcatccatcacataaatagaaccaatgacaaaaaccatatgattatctcaagagatgcagaaaaggccttctcatgctaaaacactcaataaactagctatttatgacaaacccacagcccatatactgaatgggcaaaagctggaaacattccctttgaaaaccgtcacaagacaaggatgccctctctctccactcctattcaacatagtgttggaagtgttggccagggcagtcaggcaagagaaagaaataaagcgtattcaaataggaagagaggaagtcaaattatctctgtttgcagattgcatgattgtatatttagaaaaccccatcatctcagccccaaaactccttaagctgatgagcaacttcagcaaagtctcaggatacaaaattaatgtacaaaaatcacaagcattcctatacatcaaaaatagacaaaaagagatccaaatcatgagcaaactcccattcacaattgctacaaagggaataaaatatctaggaatacaacttacaagggatgtgatggacctcttcaaggagaactacaaaccactgctcaaggaaataagagaggacacaaacaaatggcaaaacattccatgctcatggataggaagaatcaatatcataaaaatggccatactgcccaaagtaatttatagattcaatactatttccatcaagctaccattgactttcttcacagaattagaaaaaaactacttcaaatttcatatggaactcaaaaagagcccatatagccaagacaatcctaggcaaaaagagcaaagctggaggcatcacaccatctggcttcagactatactacaaggctgtagtaaccaaaacaccacggtactggtatgaaaacagagatatagaccaatggaacagaacagaggcctcaaaaataataccacgcatctacaaacacctgatccttgacaaagctgacaaaaacaagcaatgggaaaggattccctgtttaataaatggtgttgggaaaactggctagccatatgcagaaaactgaaattggaccccttccctatactttatacaaaaattaactcaagatggattaaagatttaaacctaagacctaaaatcattaaagccctagaagaaaacctagtcaatacaattcaggacataggcatgggcaaagatttcatgactgaaacaccaaaagcaattgcaacacaagccaaaattgacaaatgggatctaattaaactaaagagctgctgcacagcaaaggaaactgtcatcagagtgaacatgcaacctacagaatgggagaaaatttttgcaatctatccatctgacaaagggctaatatccagaatctacaaggaacttaaacaaatttacaacattaaacaactccaccaaaaagtgggcaaaggatatgaacagacacttctcaaaagaagacatttatgcggccaaaaaacatgaaaaaaagctcatcatcactggtcattagagaaatgcaaatcaaaaccacaatgagataccatctcacaccagttaaatggtgatcattaaaaagtcaggaaacaacagatgctgcagaggatgtggagaaataggaacgcttttatactgttggtgggagtgtaaattagtgcaaccattgtggaagacagtgtggcgattcctcaaggatctagaaccagaattaccatttgacccagcaatcctgttactgggtatatacccaaaggattataaattattctactgtaaagacacatgcacacatatgtttattgcagcactattcacaatagcaaagacttggagccaacccaaatgcccatcaatgttagactggattaaaaaaatgtggcacatatacaccatgaaatggtatgcagccgtaaaaaagaaaaatgagttcatgtcctttgcagggacatggatacactggaaaccatcattctcagcaaactaacacaggaacagaaaaccaaacagtgcatgttctcactcataagtgggagttgaacaatgagaacacatggacacagagaggggaacatcacacaccacggcctgtcggggagtggggggactaggggagggatagcattaggagaaatacctaatgtagatcacgggctgatgggtgcagcaaaccaccatgacacgtgtatacctatggaacaaacctgcacattctgcacatgtatcccagaacttacagtagaataaaaaaaataaatttgcagttacatttagagagcaattttttcactcttaatctctaaactaaacatattttcctagaacaagtttttacacaaagaaagtacagtcaagtgccacatgacatttcattcaacaacaggccacatgtataacaatggccccagaaaattgtaatagaactaaaaaatgccttttgcctagtgacatagtagctgttgtagggttgtaacacaacatgttattcacaagtttgtggtgatgctggtgtaagcaaacactgtgctgctggtcatttggaagtatagcacatacagttatgtacagtacataatacttgataataaacagctatgttactgatgtatatatttactatgccatcatttttatagttattttagagtatactcctacttattaaaacaaggtgactgtaaaacaacctcaggcatatttttcagaagtattccagaagaaggcattgttatcataggagatcacaggggggtctcatagcccctgaagaccttccagtgagataagatgctgaggtggcagatggtggtattgaagattctggccccgtgtagtccctgtgtgtttgtttcttagtgtttaacaaaaatgtataaaaagttttgaaaaattaaaaatttaagaatagaaaaatagctcatagaataaggatataaggaaataatatgtttttgtatagctatatgatgtgtgtgttttaccctgtgttattatagcagtcaaaaagttaatttaattaattataaaattaatttaaaagcttataaagtagaataattgtagtaagctaaggttaattcattattgaagaaaaatatttgttatagatttaatttagtctaagaatcgagtgtttacagtctattgtagtgtacagtcctgtcctagcccttcacattcacctgccactcactgactcacccagagcaacttctagtccttcaagctctgttcatagtaaataccctatatatgtgtatcactttttatctttcatacctcatttctactgtatcttttctgtatttagatatgtttgaatacacaaatacttacagtcgtgttacagttgcatacggtattcagcacagtaacaagctgtacaggtttgtaccctagaaacaagaggccataccttatagcctatgtgtgtagtaggctacataccagctgggtctgtgaaaggatcctctaggatgttcacataatgacaacatcacctaacacatttctcagaagatatccttgtcgttaagcaatgcatgactgtacacagatcaggatctcaatacagaatgggaactcccacttctgtcctatgttctattattttgttcattaccttatgattcgtgttttaacaacttgtataaaatctctctaaatgcccaagaaggagtcaatatctcctttctttacaactttaacctttgttttttgtgtgatcacctattcagtcattctctcattctgacagcaaacatttatggaggtcttactatattctagttattttataggttaatgaaaagacaaatcaaagatatagttcctgttctcaagttgttcgtggtcttttgggagagtaactatgttatttttggtgaatgggagtgtgagtgaggaagcacaggaggctctgtaagtagagaggagggaactcataccaaagcgaatgtataatcagtgcattctattatatatcttttaaaatgaattaatatttacatattgatagacattttattatgtatgtcactttttaggtcatatggttattatgactggtctagccaatttgctttaagtgcttatgcaaaaacaattccaatattcactggatctatctctctatgacgcaacttcttttaaagtagtttcactcatcatgccagcttatctggatattttcaaactattcatttctgcttattcacaacttccagagaaaagtttacaactgtaaagaaaatattttaattgctttcctttgggtgctgcaactaataaggctagacatataatgtatgattttcctctatccatctttaaccatcacttactttaaagagtagaggatattatcttgaactctgttttactaccagcagaaagatgcttggaaagttgagtcaagattatgataagaataataataatgggtacctaaccttaatcttactcggagggctaaaatacacttagctttgtaaatttttgattcatgtgctgatccataataaaaacatatatgcttagccaaaattcattaaaatgctatttgctctgtaactgtaaccccaattttaaccaaaactgcttgaattctaacacacacaaatatataacacaaatatgggacaaaatagtaatacattaatagtgacatgttcagatgtcatgctggctcttaaaatgtaatctatatttttaaatatttctgcatgaggggaaagacaatggaggagcaacctcagtgatatgagagtagaactgtttaatatcttctcaagaatggaaaaagagcctcagtggcgtgtgatgtggtatttgtgccatcctatatgttttattgggtctcccagagacctgtattaaagtgggcatagtcaacctgcagccatagtgagctcacttcctgtgtaactctccagtcccacttctcatttcctacttttccttgcatcacccttttatgacatttgctctaacaatgctcagttgcctgctgtttttcctagtcaccttgcttttatttgcttaagatatctggttgcaatgcctttacctcactctgcatttgaatgatggccattcatccttactatttagttcaggtttcccctctaccaggaattttctgctagatgtaaacctccatcctgccttccttaagaaatcttgtcctggctaggcgcagtggctcacgtctgtaatcccagctgaggcaggcagatcatgaggtcaggagttcgagatcaacctggccaacatagtgaaacgccatctctactaaaaatacaaaaaaattagccgggcatcgtggtgcgcacctgtagtcccagctactcgagaggctgaggcaggagaatcgcttgaaccctggaggtggaggttgtggtgagccaagattgtgccactgcactccagcctgggcgacagaccgagactccatccaacaaaaaaaaaaaaaaaaaagaaatcttgtccaagtgtctctcctccattagattttgacctcctagagcagtggtccgcaaatagggtccacaggccaaatctacctcagcgtagtattgtatgttctatgaactaagaatgttcttccatttatgagttgttgaaaaaaattaaaacaagaataatgtttcatgacacatgaacattatatgaaattcaaatttgtgcctataaataaagttttattggaacacagccatgctttttcatttacatattaatgtaatgtaacgctacaatggtagggttgagtagtacagcctgcaaagcttaaaatatttcctatctagccctttatagataaaatttgcctacccctatcctaaagaacagcaataaagtcatagtcattccattatccagagttcctagcatagagactcctaattgaacaagttaattaaatggttgaataagctatctccgaccagaaccattcacacaagggctcctggctctgatcctagtggacatttaatagagaaaatactgaattatgaagacctaggaggtagcattttctctgccattatctgtatcttggacaagtacttcatttccctttatttgaaaataattactttaaaaagttttgtagttcttttcaggcatgaaattctagagctatcaatgtttttattaagtcaatggaccatttaagacatatggacctaaagaagaaaagaataatgaactcttatcagttatcagttttattattggtgttgattaggtgttctgtggtaatccaaattttaaaaaaggttgttgttggtacatcggaatagaagatctcgtgttgtaagatttgtggtctatatagtaatttgtctaccttgctttcagtgataattttgtccaaataatgaaagacagacactttcaatattagcttttactagaatcttgaattatccggtgtttatttctatcattttctcctcctttatatggcccccacccctagctagatggaggaaattgctggtaactgacctgcatgctttatatagattatgagatttgcaaagtccttacaactctaaagtgacttctttgattctaacaggaatgaccattgtaatcttggcccttccataaagatttcttgaaggaaaatatcacaataattatttaaggagtctttggatgaaaactcttttgcagtttatagctgttcttaacctattttaaaaggcaataagatatttcaaaatattagacttttaaaatattcttgctttctcaagaatatgcctgagtaaagttgatcagcataaaaacttataaaaataaaaaaggaaaaaggaaaatgaatagaattttttaagtattttaatggatagttacattttttctaccttttcctatatattaaaatgcagcgtggaaatttaaaacaatgtttgcagtgtttgcttcagtctctaacgtgctttgtgaattgctcatttaatagaaatggctaacacaataatctttcccagtttttctaaatgtgggactgttatcttaaaagaagttgacaaatagcagaaacaaaaaatgcttccagtaattcagaatctgttaattgaagtgaaaaattgtgtacgtccagggaaattttcagaaaaattgttttgtagaagatctgtcaacttttatgaaataagctcaagaaatatcttcaagggaacttttcagtttcctcacttccagtattggggtcctgcttctctgttgtacagtcttttccactgctttctacaggaacctctcatattgaaggtctggaacccttcagtatgggacatctcattgtgcaagagtatagtttcctataggccactgcttcagggtttgttttggcgtctatcactgaatcaggttagttaccagcaagtatgtgaagggcaatgcaagagaatccatttcaattagatcagcacatgttatgtgaagacatttttaattccacaggggatatatgttaggggaaattggcattattgatactacttctagttttctcattctttttattactgaaaaaatacttaccaagcactaaaatctctatttggaattttgaatgccaaaatacatctataaataaatattcttttaatttataaaaagaaaaagcattttaatactcttaaattctcatttagatttttctttcgtctgaaaattcattattgcttatatgtcaagattcacattgtgatattaatgaaaaaatatcgcccttattttgccgcatatgacaggctgattaaatgtcaaaatattgatagcattattttactcttaaaaatgtatgaagttatttcaataagaataattcggcaagtatctcccaagttatagttataatatttaaagagattattttactaactgttttaaaatacagacacacttcccagaactcagaaattatgaacttcctaaataaaattcaagcatgcatgctctttcttctgtagcaaaatggtacacggatgaggaatgacagttttaaaatatgtcatttttatctaaaagaaaataagcacttacttgctgaagataggtttctacctgtgataatgattatagaacaacatatacttttattaaagcacatgtggaataccttctttctgtgtatttactttttgctttttccgaaagtactaaatgctcagaaatgtggtcatcagatcttgtgattggtatgcaggtgaatgagccgatgcatctgcaccctcctttttccttatcttctctgggtgtccctgagctttccccaagctgagacagatggctgctggtttagttatgtgcgtgggagagagggacttccacatgtgatttttaccatttggtagtaattagtttgttgtataaattaacattaactgaaccattcttcaggcattgtttgtaattatcttctttgagtctctgagttgtataaagaaataaaaagcaggaaagaaactgctccttattttttaaaagttgaagaatctatcattaggcagaatagagtgacaattattgttgtatgcccgatacactgaaaactttaaaataaccataaggcaaaaaagccaaagatttttctggaatggaatggtttagaaatacaattagattttctgaaaatgtgtgattttttgctgttgtttagacagcactgaatgtgagagaaaaaagaaatgtaatttgaggaatttttcttcctatcatttagcaattttagttctcacaataactgccacttgaatgttactgtcggacttgtctttttactttttttacatatgacatacttcatatagatactttcaaataaaagtgtattagtgtaaattttatgagaatagtgtgttcctgagatacagtacatcagtattcgtctttttaggcaaagctcttcatcagtcagtgggattttgatatttcaggctttaaagtatgaatggtggttaagtcagtattccctctgacactccctgcccctgatgcaggtattggatatcaaagaaagaaacaaaacaaacaacctgtacttcttaaaattctcctggttggtttggccttgctcatattatttatgtgctcaaaattttattgtgtctttctctaaagagatctaatagctaataccatataacagattgtcctttaaagtataaatgtttctttccggaaaaaaaaaaatccccatctgtgttttctctttggaaattactttaagatattaccaagaagaacaaattactgatagacatattttgacccaaagtatgtaaaatgtgtcatcacacttttactgtctataacacagtcataactttgatgttggcaagaaaatatgatggtcattatttgaccatgagtttctttgttgcagcttgtttgatagatgattaaaaaaacagtaatatataccattagtagctgttttctatcatacagcttcatttactgggtgccagactttagttgtagaaactaccagaagtgattaatttattggcttttttcttttgagtgttgtttcagttcatttcatgaaatgcaatgatttgataggtcttcaagatttaaaaatatcccaatattattgcaaattacttgaaaaaataagaacattttgcctttatttatactacagtgactacttactatagtaactaactataagttaatgagcaaaactaaggtactttaaaagctggtttttattgactaagcttttcatatattctgaagttaacaaagagataagtcttttttaaaaagtgagtgtttcaggaagactttctggtttattacaaattaggcttatttttaactacttctaattcagaacttatttttatgaaataggaaaactggaagtactgtgtgcctagaacttggctttcccataaagtacttcatccagtatttctcaccattcatcaacattttaaatcatgctcttctttaaatatatgccacttttgaccattttaaaagccctaactttatttaatattcaacaattttgcctctcaacatagtttatgtacatatattttctcacaagtgggaaaaaggaaagcattattgtcttatctctttattttggctgtaaatcaaataaacataaaaaccttaaattttgtgcttttcaatattgagagctggctaagaagcaaggagccttaatcctaaagatatttcctttccctgcctgacaggatagaagtatattttcttttaaatagggcaggtattgaacttggtaaaattttgaagggcaaactttatgtctgctgaaaaattcattttatataatatgtgttactggcaaacaatatgagtgcaatctgggaacatattttaatggtatggttttcaatctgtgaatattaggattcttaatattaggccaaaatattcctctgtgtagggggtgaataatctttatattcctcaagttaatttagagcctaatccttggaagtgaagcaaaatgaacacttctgctttcagactgattttgcttcatttatacacttgtgttcataagaatacagaaatcgaggcttttacaagcatcttttgaggaaaacacaataccttactcacccccactcagattaaaataatcaactactgataaatatcttacacaaaaaccacctctgaataagtcttttggcaaccatttgaaatgcaaactcttgtatgacatattttggaactaaagataagaagagaggggaaaaaaaagcagctcttctgtggctgtgaagctcaaaaagaatatattaattaacccaagagaatttctaggaagctgtagtgagaaactgtagctttgaaatgtagtgatctttatccactgttgggcttgggtcaaagaccttggacaaggaaggaaaaaagggaaggagatacattatagaaaccagatgttaaaaactgataaaggctgaccagccccctgctgctaaaatctaaccccacctccatcaaaaaggtgacattctcctctgaagcccctctgtccttctaggagaaaaagcgacacaattctggctctgcatttttcctttggcctaccttgtcgaatggccctagaagactaaacaggtgttatctacttttgatttcagtgcatttaaattaatcctgtcagctcagctgttaaaacaactgtcatctccagctgttagtaattttcgactgggcactttcacaggttgccaagatctgagcctgcattgtgtgtctctctgaatgcactagagtaacaatttgtgggctttttaaaggggactggtattgtgatgctgtacacatgaaatgatcataataataatttcaaaatacagtctggtgccatgttttgtaatatataaataaaccgtgtgctgcatgccacacttatctatattctgtcgtgtgttacataactttttggtgtacttaattcaatgaacaataagtcaacttggaaagcataaaaaggcgagatatcataaagaagttaggagacagaagatagtattgcacctgcttttgatagcttctgtgtttccagaaacaatagttacttctagtagatgtatgttttttctctttcacgaaaatactcagtaggatgttttgttgcattttaaattagagtaactctatactttcaaaccaaatatttcgtttgaaatatttgtctttgactagatcctcttttattgaacattttaaatcataagaggcatttactatataatttcagtacttgggatctatttcattagtggcattctaagctaatattgtggaaaatgtattgggaaattcagtctgttatcaattggagtctattaaaaatgtgtagtaatgtcaaatctttcaaaaaaaaaaaaaaaaaaagactttcatttgtcactgatgtaaccatctggaaccaatgagttttcctcctggtttaaccttacacattaaaaaagggaaaaactatagattttctgcttggttaagcaagattgaatttgagtattagtttttttttttaataaaaaagtatgtttcaaaaactaaatagatgattcttaaattgattttaaggtatttaagaataatataaacagatcattaatgaaaaccagctttaataaaatgtatcagccacataatttggggctactttataattttttttaaaatttatgtaatactggtgttgaataaatttacactaacttagttgaataatgctctatactaatttataagaaattctggttttcacatttatttattaaaatggggcttatttcttgagagaatattatatgcacaaggtactcagtgaaaaatgtaatagaaggtgtaaaatgaaaaatatttctcttttctactcctattcctaccactgcctctccctacccaccagcccgttcctcttttaggttttatgtaacatgtttccttctggatatctccagagatgttctgtgcatatataaatatataaacacgtagaaatatcagtttgtgtgtgtacgtgtggtttatatcagaaggatgtctcccatacacacaccaaatttgtatttcattatatctggatttacatgatgtctgttctctaataaagcatatgaatacatgagtttgaaggataatattacaacgtatatgatgtgtatatgcaaattacttattttgtgtctgaggattataatttaaattgaataaagaatattgaatgttaatatgtcaatacttatcaatattaagatattctcaaacctaataggtccactattagaaactgttggtatgaatattctcacacatatgtgctagaatatgtaagaacatatgacattactgttacagaaaaactaaagacattctaagtgtcaggggactggctaaggttattattatgtattcataaatggattacgataagactgttaaacagcaagtatcctaatccataaaactatggaaagatgcccactagttatatttaatttttaaaagtagaatgatagtagtgataaaattatcttattttttatagtatatatgcatgcttgtatagaaatttatttaagtatgaaatatttttatcttaaattggatataagttacaaataagtgttttattttgaatatttactttggttattttaaattaatatttgattaattactaagggttaaatcttaaatgaaccatcttcagtgatgctaataaaagtcaattaccagtggattttgtttttagtttctataaacatcagcttacattggaagagagtgtcatgaaaaactaagggaatatacaaaacttatatgtgaaggcagcaagtgagagatggtggggtgggaagggacattacaaaggatcgtgggaaagtcattgaaaaggtggtagaaatacagagttaactttgattcatttccacagctatatttgtagagatatctccccttaaaatttgctggaagaagaagctcctgtgaacatgcttgttcatataaaaatatatatatatatatatcagaattctgaagggaaaacaaggatgccttgctcaaacatatattctgcacatattctggtaactattgagatatttgaattaataatatgctctttgtactagtttcttaggactactctaacaaagtatgacaaactgggtggcttaaaactattggaatttttgtccagatgcagtggcttgcacctgtaatcccaacgctttgtgaggccgaggcgggcagatcacttgaggtcaagagttcaagaccagcctggccaacatagtgaaaccccatctctactaaaaatacaaaaattagccgggcatggtggtgggcacctgtaatcccagctactcaggatgctgaggctgaggcaggagaattcacttgaacccaggaggcggaggctgcagtgagccgagattgtgccactgcaacccagcctgggcaacacagcaaaactctgtctcaaaaaaaaaaaaaaaatggaatttctgttctttcacagttctagagtctagaagtctgaagtcaagttgtcagcagagccatgatccttctgaaacctttggtagcatccttcctacctcttcatagcttctggtaataactgtcaagccttgatacttcttggcttgcaactatatcagtctaatctctgcctctgttatcttgtgatttttttatctttgtgtgtctgagtcttcaaatggccaccttcttctgaggaactcaatcatactgaattaggacccataggacccactctaatgaccttatctcaacttgactaaatctgcaaagaccttaatgaagtgtcccaagtaaggttacattcatagtcgctgggtattagaattttcgcatatccttcgagggacacagatcgaaccataacactctaaaaatgtaaagacaaatggatagatgggccaattgaccatttctagattgctatgaattaatctaatcacggtatgagtttaaattgatgtcacataaaattaaatattggtgtgtaaaagaagaatacataatttttgatttcatggaaacattgatatagggcactccaactaagtggacttttaactgggaaatttggccatccaaaagctggccacaaggctctgggtagatatctgaaagtggagaaaaggttagaaatcatgctgaaagggaggtgaaaagattgcaaaaaacaaacacactcttcttccttgtagcagaaaatgctcacctgtccctgaaagtcattttatcgcccaaagatgctgatcctgcctattgtaggcatgaagaaaattatagtaccttgtgactggaaaagtttagagggtttatagatgtttcattgtaccttgtattctattcttactgggactgtggctctattctccaacactattattgttttaaaaataaagccaaaaacgactgcaacttaataaatccctgtctttttttttttttccactccactattctgtgatgctatgctttcttgttttaggaaaagttttttttttcttttttttttttttttagtggaaaaaggataaattttacattgtaaaatagcacctcagtctttggtttacattttacattgatctgatgctataaaccaaagaaagatcaaaagaaatgtttgagtaaagttgtactctttgtatttatgccagagttaaacatgtctctaccacctgttaggagcagagtgttgtagccaaagctagtcctcccatttcagtgctccagattggggaggagaaggtgttgatgcgtgcttcttgaccttgcctctgttaggcagggttgtcctttatattcttgtcctaatgctttctcatggcattgttagcagtggtgttgagaaatgttaggtttcagtgtagaaggctgatttttttcattgaactgtagaaggctaatggaaatttaaaaacaaaactgagaggggaaatggaagatccttacttttctttagctctctaaggctattattgtaagttaaagcagaaagagaattgagaggaattgccacttttaaaatgtttgttttgtcagaaaaaaatgtagttactcataaaattgatcatctaaatcttagcatattcctaattttataaattgaaataatatttgatataacctaagtatgtattctgtctatatctgcactacccctagaagagtaatgaacaaatacatttcacagcatactttgtctaattgggcacataccaaaatttacacatacagcaaattattcagtcaaatattaaagctgaagtttgtaaaatgtgaaggaaatgttaacagtatatagaaaattttctgattgctaaaactttcacttagatgataagtttgactttgttctgaattactgtttggccgtatacatttgtatagatcatcctgattcctgtcctctagatttctaacatattgtgtttggccatatatatttgtatagaccatcctgattcctgtcctctagatttctgacacattgtgtttgggttgtataaaatgcataaaccattttctttttttcttttaatggttgggaataggaataaaagaagcagaacaaaataattttggttactttgaaaggttgtactaaccttagtgatgctactttttgataacagtagataacatttattgagcatatgtttttttttcaggcattgcgctttacatgttttatctcttttagcacttttaatccttgcaactactctatttaccaatatatgcctatttatttattattcatatatatcacacacacatatgcatcaacatataccactatagatagaaaaactgatgtctaaatgggctaaataaattgcccatttacaaggttagtaaaagcaggattttatctcagagataatccagcacaaagctagcttttaaactattacactatattatttctcacaagttcaaaacatgtgatgagcacagttaatatgaatgaattatgatgtaatgaatgagttcattcattccttctttcattccacagatttttttaaaaaaacgtctagtcatgcaaagcactctcatagaaaacaagtaaggtgccaaccttgtcacatagaaagttacatttttatgttgaagattttttaaaggaatatatatatatatatatatatatatatatatatatatatatatatatatataaaacaatgataggtaaatagagaaaatgttaaatatcaggaaataataaattccataagaaaggtacagatatcgtaatcagaaacaaagtggattatttcatgatggagtgatgaaggaggagtttaaggagaaaacggtattcaaattagtcatcgaaggtggtcagtcagtagttccatcaggggaggacaccagggctggatctggagagattgagttgggatgaatagttcaactaagagcatagaggttaaaatgcatcgggtaccatcagagataataaataattattgaggatgtagggcaaataaattgagaaaaggaaaccaaattagattccacatggagagaggttaggattgagaagccctgaatgccaggctacagagttgaaactttatgggttaggacctgaaaagctattgatgattttccagcagtggtgtgatctgatcagagttctgttccacaatccatttttctcattgcctattcttcctggccacacacttactggaatttcctttgactaacaacaataaccaaacaaacagtagcacagtggatatgctgttatagatatggatctatggatttttttctatttaaatggaatttcagattggagatactatagtgtgatcagttaacctcacgttaatatgatgcagccacccatatttctgttactttatagaatttgtattttactctattccttgtaatatttatttcttccatgagattttgagagtattgaggcttaagaagcttgtttatttactagatagcttgacttccaaatatgatcattgcctaatatttgttcattgaataagggaattgatgaggaattgttgaatacttattaattatttttaaatggataaaatgtaaacaaaacctataactttttgttgtcctgtatctgaacagatgtctgtaactacctgaacagatatctgcatctgagattttgtggactttacggttaatcacacagatgagattctattcatgctgtgtcatccttatgaaagctcttaacccctcactttctggaatgcggttcatgtgtcttttcaaattcagctaaaaaaaacccattctgggaaggactttcttatggttgtcagcctggttagaaatgatatgtctgtgctcattttttttgtgcttacataagatttactgtttctacctcacagcacttaatcacactatttcacaatttctttcttcactagactataaatttctggagggcagggactatgtcatttcatttttgtgttcctaggctaatacagtatttggtagatagcagattagtattaaatattttataaaagagttatggatcaaaggtagggcaattcattagtaggctatcagaatagggaaaaatcaagagctaaatggggtttttggctttacaaatagagaagagagcaagaatttcagaaatattgaaggataaaaattaatgggacttggtgacagatggtatgtgaagataaaaacagagagaagttaaagatgcaaaatgacttgtgaaagaaaggtgccattaactgttgtaagagagcaaagagtaggagctgatttcttgttgggacagataatgagtcctcttttggatatagtgattttgaggtaacagtgggccatactgagatgcttaaataagtagttaataagaaattagaacttgaaagaggtcaagaaaggacataggaatcagtgaaccattcacatactaatgacagttgaagtgctttagtgggagagattgtgatagagaatttagagaagcatgatggaatcttgtagagaagctaattctggcacattcggaggaagagtccaagagaatacctagtgaaaaaggaaaacaaggaaataataatttcaggaaagttaagattgaatgtagttttaggaatgttggagaatgttggggaagaggggcgggagtagcaatgcttaacaatttaatattctgtagtgtggttgagaagtaggcagttactaatcggatcagaagccagactgcaagactacggacacataaagggacacaataagatggtaaattatgtgagttgcagagttaagataattacgtatggggtatttccacttttacctaatatgacatataaacccatggaggatgtttatatggattgtattgaaatgtattgtagaaatatattttacaaaacaattatagctgatatcatctatcatatctggggagatataaaggttaaggtagatttttttagagggtgtcacaattccgtattgaggataatcacacagacaagctatgctgatttccataagcaagctgtgtttagaaatgtgtcaaattttgggatataagactccaaaattggttaaaaaaaaaaattacaacgaatgggatggctagtatttttaatttaagtctcattgtgcatatccatagacttgctgtcttataaaactttgagttgggtctcatgtgatttaaaaattaagaaaaggccgggcgcagtggctgacgcctataatcccagcactctgggaggccgagacgggctgatcacgaggtcaggagatcgagaccatcctggctaacaaggtgaaaccccgtctctactaaaaatacacaaaaaaaaaatttagctggacatggtggtgggtgcctgtagtcccagctactcgggaggctgaggcaggagaatggcatgaacccgggaggcagagcttgcagtgagccgagatcgcaccactgcactccagcctgggcaacagagtgggactccgtctcaaaaaaattaagaaagaaagaaagaaaaagaaaagaattaaatgttccgtaaagtttgttctacgtgtaatatttttaattttattctataattgtagcatgcatttcccagaaaaagactttcatattttaatagttgatatgtaaattctgaaggacgtctgtaaattctgaattgacgttgtcaatcctctttctataggactgttaagaaacagtagtagtcaagatggtgaagtagctaaaatctctagtttgtttcccctaactatacaacttatcaataaaagtgtaactgaaagcatgaataaaatttacatctgaagtcaaccgtagggttggaatccaaatccaagcgctattacatttaatttatgtaatagtacttaactgaaaaattaaatagattttagtattaataatgttaaaaagtggagaaaatcctaggaacaataatacatgctttgctaaaaagaacatttttatatataaaaggtgggaaatctaatatcctaatatttgactacattaagctactttttaaaattttactcacaaaatgtacgtaaaaggaaaggaaatcatttagatggaaatttgggctcacttccttggtctttagcatgatagataatctactggataagccaggggttcactgtggttcagttattaccatcttttgattgccacctttaaaaaactgcaggtttaaatgggtttggaagattgaaggaaggccttataactgtcacactgttttcttattccttgttcatgttctctttggctccttttctttctcttctattggtcccctttttccttcaccctgtcttcttatagaccaatgtttcataattaaaacaggtctccagttttatcttggcaaataagtcctatgcactggattttgctgttaatgctgtcactaggcctgggtgatgtaaaattgccttaggagccaagggacagacaagtaacaagacttcctattcgtagtatggcttctcatctgcgttttgtgaaaatacatccgaagaggaatgggctgcaacagtatagtgttttccttgagaagcatctctcaaggtttggcccagtgcgctactactggttgtttcaaaataacagggagtggttttcagtatgtttgtgttttaacaagttctccaggtgaccaaatgcttttcattatctaatttcctattgcaatcctataaggtaggattgtctcaatttgacagataagcaaacaggtaaaggctatatatatggtgttgttaatggaatttctaatgagaataatggtttatttcatgatataccttctttcggacctgttactattgtaaacatagttttccatgtgagcagctgcaaggctcttttcccccaaatgtagtactttagaggagcatttaatatgacaggtgtaaatggaaatagaataaaattttctgttcctcatctatattaacagtttagtggtgtagctgcttagcccatttctataccaaagttgttttttttttaaattttaaagagtgatacctaaacgttgtatcattcatgtcccaattttgaaatattaccgtctctcactagtcatcatcatgtacgttttaagcatcctttgcacactgtgttcattcctttggttcatctatctgacagtgtttcattcatatgctagcaaatatgtatggagttagtgtgtttgggtattgggttaacataattttgtgcaaaccttatcagggtttcctatcagaattaagaaagtatcactataccctccattattctcattgacattttgttaatttatttttgtgtgtgttccaacaaaactttacttatagacacaaatgtaaattttatatcgttttcacatattgtaaaatattcttctttttttcaaccatttaaaaatgttgaaactgttttcatagctggtagaatttggcccatgggctgtgtttgactgactcctggactagcatctcaaccatgagcactcaatgacattttagatatcactctaagaatattccggctgtctttcaagtacactgttatttgagccaatgacatattttatttaaacatttacatttagctcaatatctttggaagattggcattgaacttacattattgaaaattaatctaggttattacctgttgtgaaatgcattatgtctaactctaaatcttcacagataaaataaataagttgttaaaatttcatatagttgtttcaagcagaaaagagcataggtctgtaatatggtatgcttaatcttgcctctaggacactgtctgtaattttattttggataaattttgttagtattaataatactgaaaatattttctttattgtgtactttatggaggcaaaaaagtattagttgaggaggaccaaacttattgtgaaataagcattttagtatggacattaacatgaatttttctagtataaatttctcttggagaaatcctccctatgtagaatgttttcacttcggatattggttgctttatcatactttaaccctagctgaaactgctgagggtttcactgtttacccattttatagtcactatgggtagggtgtgcctacaatatttttgtcccgaaacacatcaagcatcttagaatgatttggctacattgttagggagaaaggatatagtgtttacttcagaaactcattatcattttaagataattcacatcacatcatatgaattaatgggcattagaaggaaggtgctgactctaatgttcaaacagattttgttattaccctgttattacagcatcattgttagtatcagcactaccaaatccatgaacaagaataagttagaatgcttatacattcttaacctttgttctttaaacctttatctactggaagaaaacaatataaaatggctgatatcaccaaaatactcccttattttctgtgtgtggggaagaggagagtggaacccccaaaaagctcttaaagagataggaccttttgtaagtattactatgttgagcaggagggaagaagtcttccaattatagtacgatgacaattttcatgaaccaatcttggtttttaaattaataatgttgatgtttctattttggctaaacagtaccatcatacctcattgtatacaatagggttgttatgaaaatgtacatgtatatttgctttttacagatcaaattttctttacaaataattttagtatgtttctaatatgagtctcaataatttacttgctttaacagagttctatattactttagtaatctcaaatttatcaagtttttttaaaatacagttttatgttttgttatgtcctgagagtagaaatagttatagaccattgagtgacaagaatgactggtcacagctttaaatttaaacttaaatgtgtgtgtgtgtgtgttgtaagagagaactggtttttttttttttttttggttcttttgccattttaggaataaaaatgggatattgctattatatatgtgtgtgtaaatgtaaacctatatttgctatatgcatgagtatacatgtgtaactctgtatgcatctataaagttatatgcagtgagattaaccaaagaatgaaggatacccaaacttaagacttgccatgtaagtctctgcctctaaaactactaaaagagtatgtgcccttaatttgcagtgtttcaaatggcaatcataggaaagagaaaaataagaattttgtatttttttcaggcagcacaaattattaggtccttagatacaattcaattcagtgaatgtttgttgaatgccaagtcagtgttctaggtacagaagatacagcagtggacaagatagaaacgcctatgtttttgtatctccagtgggagtaatcagattaaaaatataatgaataggtaaaatatatagtttgccatataacaataagcaatataggaaaaataaagcaggagatggggaatgagaatgataggaaaagataaatgtaaaaatccatcctgagaaaatgacatttgaacaaaagacttgaaggagttgagggaatgaatcatgcagatatttgggggacgatcattccagttaagagaacaaaaaacaaaaccaaacaaaacaaaaaaacaaaggacctgacagttttgaagcacagcaaggaggccagtatagctagaatgaaataacctgaggcgaggttaggaggtagtaagttgagagaggtaaagagaggctacattgtacagtatcgaaggctagcgcatagctttatcttttacggaaagaagtgaaagctattggaagctttcaaacacagcagagaaatgaaatgtctttacagcccagcataaaatatttcttataatttcagacttctttagaacagtcccaaacttttaggggcttcaggaattatcccagaatttttaatccaaaatcatataggtacgtggcatttgctctcactcctggagctcttttcctgggatccattaggacctactctaaggatatggatttttttcttttttgtggaagggcgagaggggtgcaaatgccgaagagttatcactttgaagtctgtctttcaggattatttatagccaaaaactcaagtagagggtgactcagtggtctcatcattgcttcataacttaggaaattgttcaaccgacccacatagcctggtggagttaataaaagcatattatatggccaagatacatctgtgtatatcctcatacatttaaagcaggtatttgaaccactgcccaaaaattattaaagagaaaccctgcaggtttaagtatctctgttaatctgattgtaccaatacctagtctgaaataaatgatactcttatttttcaagagttcaactagttaaggtaccaaaagaagaggagggtgtcaggaatccattctagttatatgatttgaattgataaagtgtattagtgttaattaaggctactttgaagctgtgtttttttcagattttacgttggagatggactcgtgttttgattttcaacatataaaaatagttactaatttcccccttaaatgtttaaataaaaatacctactgtgcagtagcgtggagcagagcatcaaacttagctctgctgagtatatatatatataaatatatatataaatatttatatatatttatatataaatttataaatatattttgtcttaaggctttgcaatgtgaaaaaatgtttaaatatacacacatatatacgcaccactatataagaatgagtaaatacactatattagaatggaaatcactatattggtgatctgtttaggtagtttcagttagtttttttcatgcattagaattgtaaaaccctataattttgcagttaggaacaattggtcttcatttaggagacacagtttagaagctaaacacagtttgagaatttaatccagacttaattcctcctacctagttcctagtaaggcccagtagaatatgaaaattccaccaccagtgatacttatatttggtgcctgcttgttctacagctttcagtgtcattaaactccttgatatgatttttaagcattagctatgcaactcagctatgaatatgtgacctttgactgctgttaacttatgaaattcaaactactcattcaaatgtacttctcttttacccttttcctgaaatttatcctccagggatacttacaggtctttagaataatgatacatttactttccctgcttttctccattgaccatcaccatcttattggattctgcagggctttgttcaatgttacattgcaatgtttactattaagtaagaaagaattcagctgccaggcaagattttaggcaaaaggactttgaatgaagtggcactgtgtaattagagtcctaaacaccatggattcattataatttaaaagtgttcatcataactgagttgtagttaaaaggattttttaaaagattgggtatcaataagtaacagttagaggttttctagactcccctttatgtggctgaatgacagctgcacatcaggcaggtttcagactcttaaattacacccgttttcttgaccttgtcgcccagacttcagaatattttttgtttattagttaaatactattcagtaatttaaataccagaaaggttcattctttgaagattgtttccaggaagagaaaatggtaatcaatagagatgttacaataattttatatttcatatacatacatatgtgtgcacacaaacacacattctcctgagggtggctgtctgtaaactgtagcttcattgtatagcagcaacctttggaaattcactaactgatacacagcaaaggctctgttgcctggctagtcctacccacaaaactcccattcagcattttttctgttttcccggattatttgaacagttaataggcacatacacatgagcacacactctcacacactcacatacgtgcttatcccacatcacaaaaaccaccctcacatttggctcgatctgatgctcaatttagccacaaggcaagacttaaaggagcttctgtcaactctgttaaaaggaaatccaaaggtagtctaaaaaggtaaaatttgaggaacatagttgaggtacagaaaaggggaaaatgtatttaaagtcgtaatataacttttctgtgataaacagaatgagtctctagagcatctgttgccagaattttttatgagctgtgttctttgaaaaatcttatacaagtccatccatcaaaaaaaaaaaagtcaatggtaaaagattccattttgaatctaccgtttttaaaaatgcactactcttattttcagtgccacctacactgattcctcccattttccagaaaattcaaagggctactctgttctaggaagaggtgaaatcctaactatgttaggtgtcatgtaacctatcccttttaagatactgcaacatgaatcctcatggtcaaatctgccagtaaaactttaaattcaagagccgtagccactggatgttattccagtttactgtggagaatttcttattgtgtttttgttagaaataaatttattaaatttttaatatattagcggaattgttaaaaaaaattctaatctaaaatagtacactttaaaaatcattgagatgcttaacatctgtaggaaaatctaaatgtgacttatttgactaagaaatgatactattttaatgccagtactataaaaatgaaattttcttttgtagacctaaactagtcctaaggtaatcagctgttgtatcagcagaatatatgaacatatgtagctcacagctatacttttatgaaaaggatgaaataaaaaattatttgtatatttttacagaaatagtttttaaacgttcttcttacaaggaacatgaagtatcatctgtaaacattgcgtttttgtttttgctacgttgattaaatgactactatatgatagacatatcttttggagggaatgctaaaataagtaaggctctacctctaaccctgctggaggtaaaaaataaagaatagtactatcatttttggcagttaccttatgtcatttcatttaacccagtagtttacaatctactgggagacaatggtacatatagtagctgctagactacaagatctgtgaaaaaatatgttgacatcaactctaagattatattcttgaaaactctaaagagaatttgccaaataagactttatggggagtaagatttataagtgaacctatataaacgtttatttaagtaaataagtattaggtaaatatgcgtataaatacttatttttctgttcactaaaataaaccagtaaacagcacaccaattaaagagaaaatcaataaaactcttcatatcatataggagtatattaaaatagaggattatctagataaaacttttaaaatatttttcctctctggtttcaatgaaattcttgttaattcatattacattaaacatttcaatgatggattataaagaaaaactgtatacatctttgtaggtttatctgtaacaaaacaaatatgccatagtcaccataccctgtgatggtaacagacctggagaaccattctgtctcttgggaaagttagtgtaaattgctagtacctaggtgacaaaatttaagaaggaatgcattctcagtgtcttgaaaatacagaagagttgacagtgtgctacctcaagagtgaatgcctgcttaaattttgcaccttggtgcttttcttacttcaccattgtctggtccagctctgaagacagagatccggtttatgttgcttctggctgtaccctgtagttatgatatatggacatttaatttttgtgttaagttcggaacctggcttcttagagcttccccactattttgcttaatcttcacacaacatgatcttgcttaccctaaatttgcgtcaagcaattcagcaaattctgcagaaaggcactttttagaattccccacctataccccataaaatacagaatagttttatttgtttttccttcagtccagtatagttcttcttaaatattcatgtgctgaaaagttactctttagggttgggtactacaaaatacatattgtaccttctgggtaaataaagctattttcaagggttattttctttataagctacttttggctaatgtactgattttagtgtctgcccctcaccctaaaggcctagcagagtgtatgtcaccgagtaggcacttaataaatgcatgttaaataaatggcttacactgtaactaccaatttttttactttaaaatttgtagtcattcatgattcgcatatattttatcaagaattcttgcagtgatgaaaaatatacaaatgtatatctacttattttcatatgaggagaatttatagttacaggaagattactgtaatttcagaggaagttcgaaaatccttaggtgaaagtcttacatgaaaaacgttttaggtctctcctctattttccaggttttatccttgaaattttttgtcttgactatcaagtccaaatttcgaaaaccttaattaaggtctcagtagatttctttataatattagccagttttacctttaagactacttagtgacagagaacagaaggaagaggtgagttgtcttcaactagtcactgatttctttctgttcatccaggacagtaaaatattttttgaaaagaaagcaaaagtaagagcaagacttctcagctcgaaagacagataccacaacagatgatgaggtcaaagcagtttaaatcatcacatacagacaatacagttgttttccaaggaattctttggcagcatctgaaactgctccatatcgcagtgctttgtccaagttttttttttttttttttttttttttttttttttttttttgagacagagcctcactctattgcccaggctgcagtgcaatggtaagatctcggctcactgcaacctctgcctcctgggttcaagcaatcctcctgcctcagcctcctgcatagctgggattacaggcatgcaccaccacacccagctaatttttgtatttttagtagagatggtgtttcaccatgttggccacgctggtctcgaacttctgacctcatgatccacccacctcggtctcccaaagttctgggattacagtcatgagccactgtgcctggcctgtccgagatttttatcgccttagttatgtgtatccccatgtgtgaaatgatgggtcattactatttttcctcagttgactgtggggttttcgtatctctattctatattcccattgtagacactctctcaatctcttccctatacttaacattctaagctttccttctggtctttcatcagcactttacaataaagtttttctatatagttgtgtacacgtttgacacctgcaaataactttctatattataattttcacatataaaaatgaaaacttagatactatttaaaaatcttccctgattaataaatttgattttaaaattaaagaataaatcttagaaagagataatttaatatttttactctatatcccctactaatttttgctagagtcagtcttgtctataggtattctatatacaagtaaaattaaaaagtgatacctatttcaaaaaagtgatacctatttcaaatactttatttgaaataggtatcactttttaatttcactatttgtcaaaccttgggagtttcagtatttcacttattataaactatgtttaaagaaccacatcaaccacaatttagaagttactgagtctcagtaattcatataaacaaagtaagtgggtgatcaaatttataagatctcatcttctctgattttttttattggttaaagtggtagtctaattggtctgaactttagtatgtgatataccttcacaacaatgcaggttgtggataaggaacttggcaatgaaatttccatagtacattatggcctttatgtctgcaggatacctgtcagcccattgaacactgcagctgaaatgctctgaaacacaattatctcattccactataaacaactaaagcccgtgcagtggcacatgcttatgcagctactccgggtgctgaggcaggaggatcccttgagccctacaatttgaggctgtagtatgctatgattgcacctgcaaatagccactgcattccagcctgggcaacatagtgagactctgtttctaaaaacaaaaacaactggaaattcaagcacacttgcatagttcaggaaaacaatatctgagacaatagaagccgaatatgtaattatgattactccatagtcaggagttggacccaagaaagtgttttgtgtagcttgagtcctgtcatcttctacacctgtggtaataaccattcttaagaaaagctgcctctgtgtaattaacaagtcttcattactggtagataggttggaaaaaatagaaatttcctctgaaattttgatcctcagcagttgttagactggtaacgttatttactgagatgagggacattggaagaatggaagaattagggttttcccaagttgaaatgccaatttgccaattacttgctgcaagaatgtaggcaacattttctcagttttaatggaatattaattgtctaccttatagagcggggtgtaaatattaaatgagattgcatgcatagaaaaagcctattactgtgcttggccctttgtctgtactcaataactagacactaacttttattagtagggtacagtctggataggccggcttgtaactgaaagacaatcacaggtatttaggagacagttgaaaacatgagtctggtcataagtagaatgattctggattaatttacatagaagtgataatagaaatagttaagatcaatagtggaaaatgtatcaattgaaaagaaaggagtgttcacagaactttcgtgtgtgtgtgtgtgtgtgtgtgtgtgtgtgagagattgagagagagagagagagagagagttgtgagaggtaccagggagggcaggcgctgcaagaagggacaatgaggttgtgaaagaaataacagaattaagagtgtgacatcataaagtcactattatttattgaatgtatggtatcgagttcttgacagaatttttattttctaaaacaatgcctttcttgaaaactttattcatatttaatacatgcgtatgtatattttgcaaatcatgacacttaagatatgattatgaaataataaaattcacataaacacagaaaattatgtaaatgaagagaaataataatgtcttctggcaattaagtagaacacataaactggaaaaattaaagcaaatgttgttctatttcatacatttgtttttcagttttatagttattatcatagtgattatcatattgagcccaaattgttaggtacattctatatgaacatattttctgaatttgatgctctttaggcagagtgtaaggatttgttacaggtttgctttacatagttctcttaatagtgcttataaaaagcattctgtgatatttaccatacaaattattctaagaatggacttgcggggttgagcttgaaaaagctggagtgttacattttcctgaggcacagatttgttgtttttcaaaagtatgaaatgtatcagtgtttctatgtacatggttatttttcttattttctttctcacatatatctggtaatatccagatcaagatctgattttattagttgcatttcaactgcagtaaaagtaattttgtgttctattacctttttctgtgatctccttataaaacttgaaattgaggttggcatatttgtaaatatgattttctttcctagatattttcaaagtgtatttacttgacagataaattatcctgagaattttaatggtagcattggctatattaatacaataagaaattagcctttcaagatctaggttaatattttccgtgagaccttgcccctaaacacgtgatacttcaattgaaagaatatcctaaaaagaaacatattctcctttaagaataggccagaggcagatagaataaaactggttcacactctccttcggatcacatttattagaaaaggaagatttccattctctcacttaaaaggttaatactgctaagaatgggaaaaaaacgcatgttccttggatattgttggcagtcaccattgttaccctcagaattaaaatatatgttaagcacacggcaagatggcctttgaaaatggtaacataatttaatgttttttttttttatttcaaagaaaggatcagaattaaaggaggaaaatggataatctttgattgcattatgatctagtcactcgttcagttttctttctttcttttctctgccctccttttcttttctgtgtgctcttgcccatacatatttcttatatcagttctggagatttatgatttatacttatgttttgacaacatttttatttaaatgtggcagctctgctctctgaagaaaagattcattggcagaccttaggaataggttacaaatattctctatggcccttaataaatttatttttatcttgtattaggtttcttcagctataataaacacagaaacagtataattttttggtacttaatctgttttgttgtttaaattcaatactattcatttctagtgaatgctgtgtggcacatggtatgtgcttaattgatatatattaaaatattgattaatatgaaattacttatttcatcagtttattcaacaatatagaatttctgctgtgttcttgtcaaattgtataaaatctgaactctctgccgttaaattcttatcaaaagctcacttacaaaatagaatattcatatctgattaccccaagtccaagcatacctaaaggtttctaaattttatccctggatgaaacagaactttatcatgtttcattcccaggccattatacaattgcttttattaaaccgtgctttgacattacctcgtaagtccacccagaagaattttaaaagaaatgttcattaaaaaaaaatgctattacaagcacgtagtttactaaatcaaatcaagtgttccattaatgaggacccatgggaaaattttcactcaggtttgtgtgttaagaaagcttgtttctgtgcgactgatttgtttttatctgatggacatcataaaactgtaaactgtttctcttacagctctggacaataggatgccctagcaattgtactaaaccttaggtttacatttgctactctctgacctgaatccttctactcattttatttccaagtccttctttttctgccttttaaaatttatttttatttttgaactttgtctttctgtaactccaattttgtttttttaaatgataaaccataataaaaatgaatactacaactttttaataacactttcacacctgtgtttagctagtatttagtctttttgttatatctagtataatatatattcaaattccaatatcaaataaatagatgagcagtatctttctcattgtcttcatttcataagactctttgctcagatcctgttacttctgctgcagcatctcgggtctaagcaggagcactttctcactttcctatgtattatctctgctaaagttgatgtgtaatggttatgagcattgagcctgtaactacagtgtcatgaattttataacccttattttactttacaactaacatcaataatgtttctagttttttaatcaacctatactaagttgaagtctctttgattgattagacgacaacaatcactgtggtttgtttccagaatagactagtatgtcacactatgttcctagtctgttttagttgagtatattctcttactgaagactttaaatttctatgttagcaatgggtgttacttgaaaggaatgtaattttgattctaatgaagttgctattgatatatttcagatgactgtgttcatcgtgtatgcaaattttggatcgaagaaaatgtgtaattttcttttaaccaatgatatggaaaagaaaggtttctaactgccctttaatataaaattagtcggtttaaatcttttgttttaagtagtcacaaaggaattgaaaatggaaaaaagtgagaccaaaattctttcatactgttttaaatagtttgttcacagagcagacgactttggtacttcagaatgtcagatctcttccgattggtgtatttaaaatcttaagttcctttatcataccagttactttcatatatcctaaatgcttgttttatcagttgtttgtgcagagataaacctacagttaagttttaatgagtatctaatgcttctaaattacaatttgaagatgtatagaaattatgtggttctaatgcatactctactccttcctccatctaagatcaaaagaagttctgtgaattatctaaagctgtttattgttggcagagtgcttatggaagaaaataatctcctctgaccttttttgttctggcttacagcaactatgtgggtaatatcaatagttctccaactgtgatcacagtaaacttttcatttcactcactacaaaactcgaaacaggaaccttaactaattcagaaaaagaaaaaaacatgttaatagatattatttgcataattttaagtttttgttttataacttttctccaaaatcagtgatgctggtcattgcctagctgatacaagtcaaatcaagaatgggtcaggcaaatattaataaaaattcagagacagtaaatgttataatacttggctttcaaatgtatctcatttgtggatttgtcatactttgatgttatagttgcatacctacgctattgttacaatttcttctagaaaaataatacgtgattgatacagtaggaacactgatctcctacaaaagcactatgatttctaggtctcttttttcttttttttttttttgagatggagtctcactctgtccaccaatggaaaagtgggtgtttattaaatgttttagaacagaaacaaaatagtcctttccagatttgattttcttccatttacatgattattttcccaggattttcttaaaatccttggttaccaaggaatatctaagcagtaattatcattcctgaaaagaaaaatgtatgtttaaaacaaggactttttataatttaaatagctacatacaatagtttgaacttactgcctaaaatctattaccaagaatataaaatttgttttttaatatttgtaagtggaagtatgtctttctggtatgattgaaacactagctgttgtgggataaaccaataatttcttaagattcatatcctattataacaaaacttcactatccttaggaaaagaattggatgagcaatggaaaaagaatggtttcatggttctttttaaaaataaaagcactgaattgataactagaaaagaaaacttttcattttaaatttaaagaagcttaggtaacttgttttcccactatttaaaaaatcttcacagttctactttcctgtttgtaaattctggcccaaacaaggaaagaaaatgccaacaaaaatgagaggaaaaaaatttttaatttaacaacaccatgaaaaaaatctaaaaaaactataattcttctattgcttactttgagagactaaatagatttggatggacttactaaaattaaggagtcttatgttttctcgacatcaagaagcatccccaatgcattttagtagtgtttgtgtgtttgtgtctgggcatatgtatattccaactataagtccctttaatgccttacgaacatttttttaaatgcatagcattattcaacattattgtccatctaactgatttatttgtgcattcctagtgagtgagtttagaattgataaaaacaaaacaataaactaccactttatattttgttcatgcattctttcttaggaaggcaggtgattacataaaaagtaaacttttggaataaattatcaaaatttactatttgaaatgatttaggcttttcattaaaatttttttatttaattttgcaacattccaccgcttgtttcttttccccacaaataaatcaatgtttggtttaaacacaaatgacaccaattcagcatttatactaatcctataacaacaaaccaaaggaaatggaaaaattaggtatttaaggtagtaggtttttgatttacaacttctcaagactaattttaaagtaatgtctaaattctcaataaaagctctcaggttggggaacagtcacctcttataaaatttactttgtagaattcatgtcattaatggtaaataaattgcatcaagaacacttgtcagttgtgatctttctcaaagaagatgcgcaaagtgttgattaaatagatgatttttaaatttaatttttgagacagaatctccctgtgtcacccaggctagagtgcagtggcacaatcatggctccctgtagcctagatctcccaggctcaagtggccctcccacctcagcttatcaagtagctggaactacatgcatgtgccatcacactcagctgatttcttttaattttggcaggcagagaaaagatcttgctatgttgcccaggctgaccttgaactcccgagctcaagcattcctcccaccttaccctctcaaagtgctgggattacaggtgtgagccactgcgtgtggccaatgattttttttctgatgccatgaagaaagagttgcaatgcttcttcaaaactgaagaatcagtagagccttggagaagtctgtgtactcacacaacaccattctttattgcatattcccattttattttggtttttatgtaaatttgatgtgtaaataaaatatatcggccaggcatgttggctcacgcctctaatcccagcactttgggaggccaaggcaggcggatcacgaggtcaagagatcgagaccatcctggctaacacggtgagaccctgtctctactaaaaatacaaaaaattagccgggcgtggtggcgggtgcctgtagtgccagctactcgggaggctgaggcgggaaaatggcgtgaacccgggaggcggaacctgcagtgagcagagatcatgccactgcgctccagcctgggtgacagagtgagactctgtctcaaaaataaaaaaataaaatgaataaaataaaataaaaataatcaaagaaccatccataggtctagatggcattttcaagattttattatccagttcctcattttgctaaggagaagcctatgagatttcatgatttgcccagagctattcagtgattgataaaagagccagctcaatgagccaagtcttcccaccctgaggcctgtgcatggttactttttttttcctttctcgtcatcataatattgcattaaatatactcaatttgttagcttattttaaatatctttttggaaattttagatgttaattattcagcagttacattctgattgagttttgttaagaagagtagaataacggtgtcacaaatgtttagttgttgtttttataacaatcctccaggtgataaactccatgaaggcaggtaggagagcccaacttgtttattgccagattcccagacacttgtccaatgtctgggaatctacgtggtaaattatctgtatttgttgcatgtggaggaaatgcgctttagtggtggcctctttggagcctgtcagttccatgtcaattaaacattatcaaaatatctgtttttttcctaaaatttgggtaaagttactgtgaagtaaagacaaaaagaaaagaaaaatttctaagatcttgtgctatatggttttcatatgaattaacaccttcctttttgcttctttatttgcaacagttttattattttctgtttgctagaacaaaaaataaaggcttctagacaagagtttttcatattgaattcatgttttgctatataacttgattctctatttcaacttaattcctcagcacatggtcaaatttactatatttctaaattgtaatacgctaaaactacttttaaatctttgcttagttctttctggtcaaacaaaattatcatttgattatctgttcttcccccagaatcagtacatctttcaacacaatgaaatggctaaggtactatccttctcattaaattactgttatacgaactagacatacttcctttagcttactttcattccacattaaattacatttataaggggaacataaaaaatattgttctaggcattggagatacattgaatagcaagatagacaatgtccttactctttagaacttatatactagtggatgaagacagattataagaaaataagaaaatattatttcagacagtatatgccttgaagaaagtgaatcaacatgatataagagacaatgactatgatgagctaatttagatacctacaatggtcagaaaaagtgtctaagaaaggagcatttgaactgagaactcacaggtacggcagtgtgctttcttcagaggaaaggctctcaaagggccttacagaatatttattaaatttgatgatcagagagcttataaccttgtaaatctgattttaccaccgcacacacacacacaaaaattcatgtctctgttgtagatttgcttcatccaagttcaggagactaaactatttaactggaatccaaaactatagttttaaaaagcataatttttcctaagttcggaatactgaagcactttatgacaaacatttctcttcctgtagaaagagataaatctttgtggaaagacaaatagttttcttaaagatcatgataagcgtgttagtagaacaaactagttttaagaatttgttatttgtagtaaatgcaccttcaacaatagggatggccttgccattgtgccagatctttgatcattttcattaaatctgctgttcttcctctttcctctgttcatcaaaccttcactctccttacatccgaaagttttagatacttggaactttctccctgactttttggatacgttaacactttcaaacaaggttacgttaaattcttaaggtttccacagtcattctgcttctgcatatctctgatttgtctattatgtcttgatcctgagatttattatctctttattaggtaattgtattttttactaccgaattcttggagaaaacacagatcacacgtattctcattgtccacatgtttacctagttgaaaatgacacaaggtaaaagcttatctagaagaatgtgattataaactattgatgaagaaatatcaatatgacataaatacttatagctctatagtttgtttattctacatctttccctagagttggaaactgaaattataccactacttaatatactagtggatattagaatgaagttgacatttcacatttgttgcatgcttctatatgctgagtgtaatgctatggaattttctagtcaataaaaaaaaagtgtatatccagtcttaccaagaaatccaagtctttttaacttgagtttccattcatttcttttaaccttagaaagttattatattctgttagtttaacaatatcatgactcattgtttctatataacttcacctaaataaaagtagtttctgtatttggcctttaatttagcttcagttttccaaattctccttgatcctgcgttgatttaggaataaagaaaaagcattatttccaaagaaagactgattgtgttctaaagaacagacaaggaagaaatgcatatacacatataaaccccagaaagggggtaaaagcgggggagagagagagagagagtacaacacattataatgtgcttgaagttttacttaaagtgttaaattttctttggctaatatattttgttatttattttaatagtctacctgaaaccatttcctttcttttactttcatcattttaaagtagtttttgaattactctaaatgtagaaggatagtaagtagtaaaattaaactgttttgttttcctttttatgttagaaaaggcaatcacagctgtttttaacaggtagaccttgtaagcatgcatgttttctttattttcatgttgttttcagttatctattagtaacagtcatctgttagcagtatcataacacatagattagaaagggaggcagcttttagtcctgtggttagttggccagagcagagatggaagattaaaaaaaaaaaaaattcctccatggtaacagcagaggtttccattaaaagcatgaaagaaaggaagtacagaaaagttgagctgtttttgcttccttaggtaagaaaccttacctttgataccgtgccctgtttccaaaatatggggactgttgtctcttcatagaacatttaaccgtctgggatgagacaagggaattacatgggcaatatgactgccaaaatcagtaaatgtattaagagtggttaataatcttttataaaaatgagcttttctagttcataagtggtgcatacctctagaatcttccctgattcttcctccctttcagaaatttccttcactttctgcccagctcctcatgtctagagtagagcctctacatttccctgccattactgccactccctaccagcatactctatcttataatgccagactcagatttttaaataccattcttagtattttacatcttattaaaatactttcttggctctatagtatatgcttcatgaaatgcaaattcttagcccctttttaagacttccaaaatgtgatcaaattaattgctccatattcatcaaatagtctacctaccaggattgccacacaaaacttttcacttactctgtgtgcttgctcacagcccatttttgtactcttgttctaaatctactggtttaaaataaattctccctcattcaagagattttgactaattttagccctgatacgtttctttcttctctaattttttattacactcaaaatcagtatcacccagttagcacttattattcctttttgcttcatgcatatcagctaaaaaaaaaaacaaaaaacctctcactacattgtaagatccttgaaagtagatgccaatcttttataattgaagaaaaaaatctataaaatacctaacaaagtgttgagcatataacttagccttttgacttaccggttctcctttttttaaaaaatgatgtgtataaatctgtagtcttgtaatagaaaatttataaaattaagaaaaaaatagcactctttctgctgacacgagaattaaccagctttttattaaagaatgtagtttattagacattttacctctagtacataaaatgtccagtattcagattgcacagataatcctaaaatgacaatatcaatctttattagaataaaaacttaaaaattcttgtcaagacaacattgattagggaaaggtgcttgtatcatcacagtacttgttaatggtcagtatagaaccttagactcaaatacacacacacacacacacacacacacacacacacagtctcgctgtgtctcatgcacacacataaacacatgtctttttctaattggagcacacattgtatcattaggttattagtcatgtatgcacatatatttatgtgtatgtatgcatatgtgtgtgtgtgtgtgtgtgtgtgtatatatatatatatatatatatatattttaatctgtgaaattgaagattcaagaaatagtaaagcttttgggaaatttcccaaagccatatgtttgagatcaaaagaagttgccagaaaacagaaataagaagttcccatgaaattggatttaggctaatgtttcttccttatgatgcactttaggtcaaaccatgaacaatttagttttgtcatatggactaggaacagtttttaaacagaatatgactgtattataggtgtgcatattaaaatcacagatatcttcgcattagcttctgaatttggtaaaaaactaaccatgattggttatttttgaatatgtgtattaacatttattagcattttcctgctgcttgttcatttattttgtcatttggatgtgcttgatggcacatactagatagcacatttcaaaagtttgagaagggcctgagttagtctattcagtggaagtaaaatcacatgattttactgggttcagatgattttgtaataagtgtaatctccccttttttgcaataattgctcttgaatttgctattgtgcctgaagtgtcataaaaaaataaacatttctcaaaatagcatttttaaggcctacattaggtgagtattgctaaatgacaatttatgaaagtttccattttgtatttagggacataatacttaaacattagaatccaccatggaaaagttttactatgaaagtatcttatgctggaagcagtgaagccacacatattggtcataagcttagaatagtttctctgctacagtgatctgcctttccagtaaaatgacttaacagtctttattgcattcactgagattgtgctgtcatctaaccattttgatctgaggtgctttgttctaatttttctgacttttcagtttctaccttcagtactctagcttctgaggcctactgcagatccttcttgccttcacaagccatttaaacactttttggccttgagtctcaccactctcttatgaagaagaagacatgataattttcctctcattttttctcttcaagtatccagagctctaggtaaaagggcctgcaacacaagatcattggcacaggaccacgtcatccagtttggctctcccagcccttcctgttaaaggaggggaatttaccaatctgcttatatacatttcctgattaaattcattaaattccttgctgtttccttattatgctattcaagatccttcgtggtatgacttctctctacctttatagctttagctctctctacttaagatacccattttatgccctacacatatcaaacttcttttggcttttgaaacatgctaggctttctctctcatgcctttttccttatttcttcacctgcttaggatgatattgtcccgttcattcatatggaaactccttttagcttataaaacttggttcacttaacctcgttttcctctgtagaccttccacattcatgtctttcctttgtgtctaaatgttttttagaaaataatagcaactattcttttagttgaatagaactagttgaatagaaaactattcttgcctagatgtgcatattaaagtcatgattcaatatttaatcaatttttatttgcaagaaatacaacggagtcacatttaaactgggttacagttgtaaagttaggaaggacaattacatttggaaatacctcaggaagtttccatgatgaagactatcatgcccttgtcatttgatcagtccatcaaaccactgcaacatgttgccatttctttggtggagcctcagatgaagttgttgatttgtgtttcatattttatgaaaagtatgtatctttaaacacaaacccactcttggcacagtgagatgctcaaaccatgagagccatgctagaactgagaccaactaagggaatagcaatctcatctcttatgtatcatgtgtcagcttactcagtgcaagtacgttgaaggtgatggaagataaaattatttcccctgcttaatttgttttattttatgttttctttcaattttttttttcaaatgagcatagttgaatttagattagttaaatgtttgtatagtgtgactctgcagtaaaggaatgaaagggatctttttgcttaatttacccaaataattgtcagttttatatatgcttcagaaaatatatgcatgcatatataagttagactgtgcaaagaaaggtatgtattgtgtgtgtatgtgtttactgaaatttgagaatagaggcagacgttatggtcattgctctctgacataatcagtgtacccaaaaagagtctgaattcattaaaaattggaaaaatgtgagctcagaattgtttaagaggacaaggaaattatatcactcctagttccctgtaacttttgatattctgattactgtctgtcttaatatatttaattagatctaacaagagtatccctgcctgtatccacagtataactcctttgatgtatagcatacatgggagataattaagaaacttagataatgcaaatttatcatttcttttactgtaattatgagtaatccaaatcatggtctttgctcacatcaagaatgatctccaaatcctatgtaatcttgagctgccttaaagcaaagaggatctctaagagtgtagcagaatattcatatactcatttattcattcaaccaatgtttgttgtgtgtctgacatatgccaagacagataacttccagttctcctagaacttgtgttctagtggggaggaagagaaaataaataaatgaataataaaattacttctattagtgacaagtgctataaaaataaaggaaaatggatagaaattgaaaataggaagtgacaataaggctatattgctttagatcaggggtccccaacccctggaccgctgaccagtactggtccgtggcctgttaggaaccgggctgcacagcaggaggtgagtggcgggcgagcatgactgcctgagctcctccttctgtcagatcatcagcagcattagattcttataggcacacgaatcctattgtgaactgcacatgctagggatctaggttgtgcactctgtatgagaatctaatgcctgatgatctgaggtggaaccatttaatcccaaaattatcctcccttccaccatccccctgttaaaaaaaaatgtcttccacgagactggtccgtggtgctaaaaaggttggggaccactgctctaagggaacctcaaatactccttccttgtcaatggcatggtcttgcctaagtcttcaacatctcaaggaatgtgacttctaaggtccctttcaactctaaagttctgtttctatagtttcttctctgataaattaatttgtttcaaaaataaaatttcttgccttcctcagtcatatccttctttaaaagtttgaagactgttacttgcagttgatagtttatttttgtcctttttaactgtgtcataattctacattcctatagcaatataagacagtgaggaaaataaattgttactaattaaactaattttatataagttcatttaagttacaatgaccaggagaacttaattggtcaaaaaaagataatgttttcaatggaaatgttatcactaagttcatcgatttgtaattctgaaagttttttgtgcttgaattttcaacttataaatttcattttctctgagtacgattatatttattagcattacttaattcagtgaaagaattataagcagtttaattccttatgagagtctaattaatgcctagtgatctgaggtaaagcagtttcgtctcgaaaccatcgttccccactcccctccccctgcccacagtccttggaaaaaactgccttgcatgaaactggttcctcgtgccaaaaaggttggagaccgtggcgttagatggtatgtcaaagaaggcctttctcaaaaagtgaaatatgagttaagatatgaataagagacagagtcaatcaggtgaggtttttggacaagagtgccctaaaagtgcaaatagatagtggaaacacacagaagtgacaatgaactcagctaattggcaaagcatgtagatggccacagtggctagtggatgatcagttgaacagtacaaaataactgtggagaaataaatgaaggccaaatcttgtagaactctgtagaccttggtaagaagtttggataacattctaagttcaaataataaggattaccctggaaaactcagaaatcatcaccaacaggagctcagaatggtattgcattatatgcactcagttctttttgtgttatgccacctattcttgttagtgggcttggtgggtcagtactgttactgattaagagagcagtctttgaaattcaacagacagttgtttgaatcctggcttatttcctcgctaggtatatgtccttgagaaatgactcaacctttctaagtttcagtttcctctgaggagatgatgttaatgttacctacctattaaggattttttgaaaattaaataattatataaaccacagcaccatgcaaggcgcattttaaacagtcaataagtattaatgattttcatattattatgtacaagatagggaaaaggaaacaatgcctaatatagctccaaaatatacaatatgcatgctatttagagcatttgtttaatgacttagtgtgacaaagttgtctctttattattacaaagttgtcttgtaatttttatcatttgttaaactatgtaggtttgtcatagccgttacaaatgcagagtctgctttaaggcaaattctattttgcatacatacaaaaggagataagtagttgaattttgaatattttaaaagagcatcactggaaaaaaatctttctttaaagtcatggattcagattaaagatgtatatcacaaaaatctttttaaaacttaaatatctgtgtaaattgtttaatactactttcttcatattttcccaattagcttgactaatattccagtactatttttttttcttcagagaaaatgactacaagaatgagacagggtaaaaatagaggacttctcagtgcacaattgctcttttgcttagggtgatagaatgtgaagaatttctcatttgcctttactttctctctttgctatgctgatgctgttggagtataattataagcatagtgaagacattaacaatttactataactttataattgaatcaattattactattttatacatgtattttaagtaacttcttaaaatttagtacaaaaaatttgactcagcagaatatcattgaagttagaattttgggtgcaaaggaagaaaaataaaaatattatttttcaatggcagtcttttatatcattccgaaatttgaatgaaacttattagataaatattctggctagtgccacttacaattataaccaaaatatgtaaaagaattgggtttatttttcttagcttttattctttatttccctgtcattttctagtaataggtcccagatcaaaacatcagtttggtttagaaaacatatttaaacccataaataattatttcagttatttgttctagagtaatgtttctataggtatatttataacggcagtaaaaggtaacatgatgatattgatgaagatgatagcagctatcccctattaagcacttaatgtgtagacaccgtttttgtctctgtctctctttttgtcttcctttttctctctgtaaggcgagtgggcatcataattttactttttaaaatgagcaaagacagaccctggctaaataccttgcctacatctgcttgtcaataaagaacagaaccaaaattcaaacctggttttgactgactctgaagttttcttctccctctactattatacctttgataaagtaatgaaactgatttatttagcaacctgcaaatgtcagccttagtacacttgatttccattaacattttaatactttgcattgcattttaggttttatattgatttttttgactggtgtctttgtatctccaaaacctgcaaatatgtaaaactcaatttttttttttcctttttagaaatcagcgacaagttttaacttaaaaaatgccctggtaggccaggcacagtggctcacgcctgtaatcccagtactgtgggaggctgaggcgggcggatcacttgaggccaggagtttgagaccagcctggccaacatggtaaaaccctgtctctactaaaaatacaaaaattagtcagacgtggtggcacgtgcctgtagtcctagctactcggaaggctgaggcaggagattcccttgagcctgagaggcagaagttgcagcgagccgagattgtgccactgcactccagcctgggtgacagagtgagactctgtctcaataaataaataagtaaagccctggtaacaatgagaaggctgcacagaggttttatatttacagttttacagtttggtttttcagaatagattgtattttgccaactctaccaccactggatttggtgaacaaattatttagtcacagataagggccaagaaattagaagtatttattattttatatactcatatctatatatataaaataacaaaaatagtcatgcttaaaacttttagctagaattaacaatgatttaaaagatgatggaattcagaatgttaagtatttatatcaaactcaagagttgcagaaataagatttgactcctttattagaataatgtttctcctacactttggcattgcaaataactaagcatagtagatgctcagtaaatgaagactgatattattagtaaggaaatgcttgcagataccgatttgcttgaaaaagcaaaatgttgtcatgtgccctgccactcactgagctgcttgagattcgattacttggtcaataaattactttttaatatggtcatgatgctgatgacaatgatgttgatggtgacaaacacctaaacgtatttagtatattgaggtacctcacttagagaaagtcatttaataccttaaattgccctatatgttaggtatattaggtatatactaattatatggatgagtaaaccagatgtcagagcttgtaaatgaaagaggaaggctagctataaagttcttgttcttcacaactacaaatagcattttgtaagaattaaaaataaacatatgtaaagcacttaaaggttaattatcatttagctctcaattagtagctgctatataaaaggttttcattgcgcatttgagagaactttttcttttattttaattacagataaacaaaagacatacacgtatttcaaatatttacagaagatgtaagtgattttccataatgttggtcattctcatttttagccagctttgttatttaatgttggtgtacttttcatataatccattggatatcatgtttctaaaaggaatctgtattattgattttaaagataaatagcgtcagtggagaagataagttatgtgtaaaacacctgttaacacaaagcatggaataaaaataaagggccaaagatgaagacatcaaaaaattgccaacgtcttcacagctacctgatatttctaccatttctcttatgctttattgaattggaaggtgttcattcaagaatttcacatttgtagatatttaggaaaagtacttgaaaatttatttttttaattccatggtaaccacttagtataagagcaggcatgcaaatatgctgggagaaatttcatgtcttcttgaactttgagagagacgtccattttggcagaggaagaaggcacatatttctatgaatttatatgagcacctcaaatttgggtgctagtctgaactgccaaacttcagagttttcacattttttatataccaaggtgggttaaagcagcctctttgtataaggaatatttttgaaactgttgacatttggctactggtctttcaggcactgttttgtagtcttgacagaaacttggtttaacttgcagagagaaagtgaaagacagagaaaggtgtctatatgaaatgccccgagagaagcagaactcctgtaaggcaacatttaggcattgagtgtgacactgtattaacctttttaatggatgtatgtaataaagtgacatgtaaatggagcacaaggggagatatgacactatatctggaaaaggataaaacagttggttgaatactgggctattatagcagtttgcaaaccttggataaactcagtcagcggttgtataattggttattcaatcccgacccttgttcacagctcaaagccaggaacactgagacctgttgccaatttgagtgaatatagtgactgtactcggccggggcctaacattggagccaggccttttcctgtgggctggtttccaccatgtctgggactggctcagtgacagtaggtcttttgttgtgaaaggctggctggtactcccctcctttgcaaaatgtctaacagctacacaaatataagaaaataggaaaaggggcttactgtagcttttctcttagtaatttaatgtggagttattagtttttctttctttctttttttttttttttttgctccatttttgggaaagtatgtgttaagtaaacttaaaaattgatataaaagctccttctagataagaattgaaacttggtagtccctgattagaatacgatatgtatgaagaaatttataataatctgattcacaaaaatggatttttgagtaagagattttactttttctcgtttctcctatgaaagttcatgtactgagaagactgtttttattgaatatctccactgtgacagaaagatatagcatgtttataaacctgttatgtatttagctttataaaacaagcaccccaccttctctgcccaaaccaactgaatagaggccaacaaactgaccacttactgtttgtagtctagtaaaatttgagaaataagtcagtgaagattttgatttaactgcatgggataaagaatgcccagtcttcttacagtgcccagttcataaaggaatctttaacaagcttgtagtatttgtcagttaggtgctgcttactgatgggatgacagttcccagctgcaatcaattatgcttccattatttctgttgtttaaacatgcctaggaataccgttcagagaatttcacaaaatgtgtataagttccataacaaagtaaagagcatgttgaaaaaaaaatctgaaaaaagaatttttttctgagatttttaaaataatttttttgtcgctctctcccctccttgattccaccttacacacccagcatttatgaaatcacacacacagtgtttgaattaatgcagggttgcaattcaatcaagaaattgctgaggtcatataaaataaatggctacagtcctttttggctcagttatggccttgataattcagggttttctttttgttaattgagtagtagtcctctgcgttgggtgggtggggtaatgggggtgagcctaaatatctttgactatacatcattagaaacaatttgggggctagaaagtggtggtctggcaggagggaagaggtgagtttctgccacggataggggaggaagaaagagctggttctgaaaacatgacaggacaaaggaaaatgaagcaaattgttctttgatagaaaattaatcattgaaaagtgactggttattgtgaggcaaaaaaaaaaaaaaaaaacagagggagcatttaacttgaaatatatgaaaaaaggcactatagaaactccaacagaggcctttaatggaaaatacacccggccatctcattataaatacatccctgggagccaagtgttatgagcattagtaagaaggtggtattataaaaaattgattataatcaagcttaatgtatttaggcttaataaaatattgtatggaggtagtgagtatcatggcataatagagacctcttagcattggattgttcataagtattgtatttcataatgttgatcttcagagacctttacttcctgatgggaaaataggaatttgtattggcaaagagaagatcacagagttgtagaccggcccctattaaccccagaagatacaattcaacatatatcttatcatcttaatctctcagatattcttctagtttattttatattacaatgttgtatatgacaaacagatgtctcccttaggtcactgtttgtaatttagtaaattgtaggtgtccaactggagagcctagagctgctggtgaagaatgaatgcttgagatgcctcattaatttaatgtaggtaagagctggtgggcttaaaggatttggtagtagccccatagagaactacctacaggtaattcaaatagtgtgaaataaactttttcccctcttattttttttttttccttccatgctgtgaaacttcactgatcattattttttaagtactttatatgtcacgtcaacaacagaaaggccaaaatatgtatggaaacaagagattcaattaagctcaaatcaggtactttttaaaggtgctaggtttagtttttaaacaccttcatttggcacagaactcttcacatgtttggagatttggctttgctgcttcataatttctgagggtgctactctataagctgaatagtttgctaaggaaaaaacaagagagaaaaataacccaagttttatgtctagaattatggactaaaataatacattgatacctactgtatgataggaaagcttgttagattatgtatctaatgtaatttaaacattttggaaattttctgatgaagaatttaataccctcattatacgaagtaatttatcttttgttctttggtagctaccagggaacaatagcgtttttgtttctttctttagaaatgaaacactttatttttaatctcataaatgtatgttttaggtagataatacagctttcagtgttgaaccctgtcaagcaataaagatcaattttaatgattacaaatttattgcaatgacttacctgtttcacttcccagatttcttacgtgaaaatatttgccttgtaaaaaaaaattgcaactagattatgagcagctactgtagttggaatttcaagttggaatgcttgtaatttaattgatgatctcaactcttattattggaacactttataagagtgattcaaatatatgttcctaatttatcctaattactagcaatgtttcatttaaatcatctcctttgaagaattgggagaattcttccaattagttgaggccagtgaagtttttttgaagctttcatattcatcctggtgttcatcttaggtgagagatgtaattgttctgtaaaagagaccctgttgggctgagacaaaactgccatagcaggttcctgggtgtttttttataccttagagaagattcccagcggtataaacacctttgagtttctgacatgtggaacacagaccttcatggctttaaaaaagaccatttccaagtttgtaaaagcttgctctctgacccctaggtcagaaaattgggtggtctcttattttattggacgcatccatccctttgagatgaaatactgatctataccttaattttttaactgcttatgtttcattgcacttcacaaaaacccctagactgttgtaaataagcatttttctacctttgaaaatgtcattcttttaaatgggtgactcattaggaaagcatggaatccatggcatagtatgatgagcatccttggagccctccctacccccacctgctattgttcctcagatacattcgtaatgaggggttgagttcaaattatatgtaaatatcatacattaactatactaaatacacatgtgtgtgaaagagaaagatttaggtgatataaatctacagatctgtatctttatcatttattatatatatatatatatatatgagtgaagatattcaacatttatttctgaaaagatcagtgcaggagaaagaatattcaacaatactctttctcttgccttccccatatttcattatcctttcgaatatttatagatcatgttttcctctcagttactagatatgagacatgattttatggatattactcaccgatggttttaagaatatagaaagaataaccattcaaaatgttgtcctgtagaaatccctgttagttatattcaaggtacatagactattttgttttctaccataccaccctttccaggatttgtaatttctggtcctgccattcccttaaagagttcacatagggaattttctgaataaagaggactttatctcctttgttcttctctgattcattaaattgcttgtaacgtgattctcccattcttctctgaggctgcttcacctcagttctcaacaattcagagatgatgttctggtcatttggctgacacctcaggagtttctcttttctgtttgcaacttacataaacatatgtatgcttcttatgtgtatagtacattatgttgatgaatatatatatgtgtgtgtgtgtgtgtgtgtgtgtgtgtgtgtttctgtttttttgagacaaggtccattcttgcccaggctggagtgcagtggcacaatcatggctcactgcagcctctacctcccaggctcaaaggctcctcccacctcagcctcccaagtagcagagactacaggcactcacaaccatgcccggctagttttgattgtgatagagacaaggtctctcaattttgcccaggctattaacttctgggttcaagagagtctctcgccttggcttcccaaagtgctgggattacaagtgtgtttctaatatgtggttacatgatttataatcccttatttaagagttatgcaaaatctttgatcaaaatacatcagtaaataattttcttcattttccccgatataataaattatatacaatattatccccttagcagtttttactgcattttactttgactttttttcttgcattaaaaatgttacatttcatggagttgtaaaacagcaaagtattggaatatatttggattttttgttgataatatttaatatttaattattattcatgatagtgtggtgttagtaaaattcttttaactttctaagaagaattcagtagattttactctttcacatcttagtcattttaattcaaaattttggatatttgttatgatgcttttatccatattttaataacccgtcagtgttttcatcaaggaattaccttaagtcttagaaaagttcagattcctgggattcaaacaaaatataatgaaccatactctctgattgccctggaattttgcattttaagaaagcctcctatgattttgacctttaggtgggtagggttcaattctattatgctcttgataatatccttcatggctggaaaaatatgtagtatatactgtatgttgaactaattgattctactattcttatccatgtagtttaaatttaactttatattgcttatgtgattcaattattttcctcattatagacaagatgagaaactgctcccgtttttggttgtctagtagaaatttttatagcaggtttaactgatgaccagaagattactttagaacttttactttatgggaatactgctatagtagcatttagaaaagtctgtctgcacatttatttactattcactaatttaataattcaagtaaggcatcgttagttctaattttgcgtcaataaatgaaacatttggaaaacaactcagtgacactataacaatttgaataaatggttttagtgatggtcacaattggtgtatcttcctcaggagatgatgagtttcctaaggtacagaggccatgtctttgttcttatcacagtgccataggaggggtttacccaatgactgttagataaatgaatgaatacacaaataggatatgatgcctcttgatcatttgtgtctgtgtatgtgagcatgcatgtttgtgtgaactgtgcaaaataaagaagatggcagtatccataaataaagtgtattttaatttttgaaagtagtctaatagttctaatggtactttatgccattaaaagcaaagataatacctttcatatagttcagaaattaaataaatatttcaaaagattatacataactaattttataaccactgcctttatcattaagaatgagaagtctctggtgatgcaggaaaagtaaaactccatactctgcttttctctttttctgtgtatccaggcttcctttaattatttattgttgctgattgtttgcttcttttttaacttatttcacttattccctctaatatgaaaatacttccaaggaaaactcttttttttttttttttttttttttttgctgttttacacttttgacttcacagcaacatcatagctaacacatgactgcaggtttccttgttgattagatcgtatcgaagtttgtgaacattaaacgcccttttgcaaataaaactgttgtattttcttacctaaaattgctctgagaatgacaaaaatacaaaatacatgaaaggttataagagaccaaataataaacaagttgttaaggcagatggactactttggttgagaaagatatgtatgtatatacaaattttaatatacgattataagcaaatcagagggttttttaaattttaaaatctgattctatgtattagaacataaaaatataacttgaattataactagcttttcagctcaactagtcgactacctgcatatcacaatctttgatttatcatatgaatcatgtcagcttttattgttcatatcttttcaggcatctggcaggctgagattgtgatttgttttcacatatgttgtgatggagaagattcaggatgtgtagtgctttatcaggctgtatgtgctttaattctcacttccagtggtaaaacattctgtcataattttaaagtattgaaattcttattctaatgtatgttaaatggttttctatttctatacattttgcatcttctttatctctaccacccactttcacaattttgaataacaataacaaaattctgcaaatattaatttttgttttcaacatggcctagacatccaattacacaaagtgattatgtgaattcactttttatagtaggataattgctccatttataattcaaatacatatttaggtagttttttcttaaatatatcagtaggcatatataagttgctcagaactacgcactctcatctttactaagctgcaatatgtttaagatatcttaagtttttcctcagtttgtttataaatttgccttgtgaatttaactgtttttaaatgcctgattcttgtatactttatgacataatgtatagcttatagttcttgcagtattcttttctattattttgttctatctcacatatatacagttgagaaaatactatttcaaatggaatatatggaaaataacagagttattacaactggtctgtaagaaagttggttatttgatggatggacaacaaaaatagtcatgaaaatcttttgttggaaatattttaatttttataagttgactgttatggatgcatcataaatatttttcctctcaatattttattaagttgcttttgctttttcattctactcctctcgccttagtaaccctcctgttctccactttcacccttctcattgtaactaatagctagaatttgattcacatctccccacccacatgctgctgacatcataaattatttgaatccaaatggacaatattcattagctgtgcactttactgaaagagccttacacaagagtgctgcactctcccatttttattaaaagttaaaatgtttttgctgtcaggagggttggatgagttagccatgataaaggacagggctcagtgctaatatataaaaataataactattaccattggttgaatgaccctgggaaaagagcactacaaagctatttgttgttctctttcacttgtcaacagcactggcttaaaagctttagatattgttgaggacctaatagaacctttgggaagttagaaagacaactgtcaaacaaagaaaaaaaaaaggcaaagattaattgagcaattttgtatttgtgctgtttacgggcgttttatacattaacttaatagaagtggcacctccccagtccttcatacttactacattcctttatcatctttattgataagatcaaactgaagaagtcataggaatggtagataaccaaatacattaatagtaggtggttatttcataaaaatgggtacaagtagccctattactctttgatgaaacttttgattttggggtagttttcatgacaggcaaggtgaagcatattttacttgattttttgaaattattttcctaggttgttttatagtaagttgtagttgtaatgttagtcaacatttttgggtgtcactatgtgcctggcactgttttaatggcgttacataaattatctcatttacttctcacaacaagcatatgaagtaagtgcagttattagcctcttttgcaggtaagtgaatggaagcatagagaggttacattacttgccaaagggcacaaaacttaataagtgatggagtcaggttatatgtgacattatattatcattgtaaatatttggtagtaaaatataaaggagattttgtgcatgaggactagctcttcaatttcttgttgaaatgctgggatttaatatttgaaataagaacaaaacaaagagttgtagtctatataagaaaatgcagttactttgtgagtgatagagtggatgaaagaatgattttctatcacatatgaataatgcctatcttttagtggagatttttgtatagaaaatatgtcttgtgaggagtaaacctaaggttattgatatgtagtaatgataccatattgattatggcataatcatgtgataaaagatattcttctaaaatgtgatataaaaccaattataattgagcaggttcagctgatgcaacaagaaaatttaagcctatgactaatgatttaagtattacattacatttttctaaaaacttcacattaaaaattgtaaaacttgagtcagccaaagacttttttttttttctttttgtattaacaggctctcattaactttcaagtggaaacaaacaagtattttggcaatactaaacgtaaagtatttccagtgtttaattcacttcaggacaatcacatataaaaataaagcttatctaaatcttaatgctatggagtttcttgtgtgtttctattgtttgttgtggtatgtgttatattacgaattttttagaggggggaatcttgctacattgcccaggcaggagtgtggtggctattcacaggtgcaaacaaagtacgctacagcctcaagctcttggcctgaagcagtattctcgcctcagcctcctgagtagctgggactataggcccaccactgtgcccaggttattttttgatatttcctagaagaacttggtatgtccagtggccgactagctgtaatacttgactaaggggactgttaaggggccttctggtttttagtgtacaaatagctttccagatatgtaaaggtcaatattacttaaactgtgctgtttaatatttgctccctaatattgtgtagatatgcagctattgtcaacatgaattgaactcttactgatatatgatttccagatttagctcaatcttcccctcaaaaataattttattatacataacttaataaatagcaacatattaaagtgtaattagccttttgaagaaaaataaattcggttaaataaatgcactaacttgtatttattcttcagtttcatggtgctaccagatgaaagcttccaagagtagaacatcaagttaacagtacctaatttaaacagattatcgagttaataatacttagttctaaaacagactagcccacagtaccacctatcaaataattactaatttaagctagacaaagtgaataaaatagaactacaatttcatttttcaagagtttggccgtctatttaaaaaactttgtggtagtatgtgatatactgttaagaacactgaactggaaattggactgcaagttctgcctttatataggtttgtgatattaggcaagttatttagcatctctaattggtacttttttagtctgtaaaatgaaaagtttggtctaaaccagttattacccaaatcgtattgagccatacacacggtcatctcccaacactaatttccttggtcaaatattttaaaaatactacataatctgtaactagtttaaaaattaccaacctgttagtacctaaaatgatctaaatcttgtagagaggaaatataaatttgtttagtgttaattagatttgcatgacaatcgaatgcgtgtgttgttttagttttaagtagccaaaccatttatgttccatttatgtcagatatatgttttcctcaattgcttttatgaagtgcttatctaaatgatatataaagaccttttcagctctataattcttattttatggcatgaatagtctacatgtgcttttactttcttactttgaaggagatattggtatattttgaaatctagttacctccagaagacaacttccattcctcaatgtgtacactatcacatgtcaagaataaaacagcttagtttaagctgcaaaattaaagtatcaacagtgataggtttggtataacctaactcctgtgactttgtttaaaagtcaaatatcatacatagcgtactttttgtttgttcgatttttcaatgagctctgccacagcagctgaagggagattaaggaaaaaaacctacataaacacaaagcaaatacctgagcttgtgtgtaaagctactgcactggagcaaatgtggtttaattcttggcactggcagcttgttggagaattacaatatgttggcatgagtctctaggtctcattgttccagatgagggagtcggtcttaagagtgtttggcactgaagggaaaaaggagtgagagttatagggaatgagcaggccctaaagaggcaggatgctgttgtaacaatggctggcacagttggggggggccattcactggtggggattgccataggcattgatgtgaagaagcatatgtgagcaaaagaggcaagagtgagaagggaaaagcaagcaaatgtatcagaagggtcctgttggcagaaagaaacaatagcgagccaattagactcatcttaatattagtgtgttgatgatgaagggtatattttattttgaatttgtcttatatccgtcctatttcctaactttatgttcttttttaaaatataagcatttacctttcccctaaagagacagatcctgaaattaagagaacctggttttgtattccatctgttctacttactgatgagctgatgttgggcaaagcatctttctgagccttagtttcctcatctgcaaaatggatataacaattatatatgccactgacaaaattgtatctggcagcattctgtaaatggaaatgctatgcaaataatgattattaactcacacttatttttaatctagggagccctagttcttactttgaaggtaatcatgatattccagtacttgggagaatgaactctcaggaggaggaattttcaggagactcttttagagttaagtgaaaaacatgacacatcttaaaatgaaaatagaagaaactcataaatacatacatctactgggtacgcacaaaaatttaaaaaaaattaaaggaaactccagaatttgaacatttgcaaataactgggcaccccacataccatattcatagtacaaaatacgattctatgcttgtgcatttttaaaatcttattttagaaaattaaatatttaatagataattactgtattcacttcataagcagtgaagcagcacttacacttacataattgtgtcaaatttcactttactcatattcacacgttaacaaacaggtgtattgtaaatattgggcttctgccatttggtcctttacattttgaaacatgcattttctaccatatctttaccattttcagagaaatttaatcactgctacatgtccattcattgtgctcattattatgagattatttcttactgttatttcaagaactaccagtggaaactagcagttagtagagtattgaatgtggatttttttgaagctctttgctttacataaattcagagagaggggtgaagtgggtgaaatgatgtcttatgatccccttccctcgtcacccccacaggccaatctagccagtgtcactgtcttggagagaacccaggttgtttgaattatagcccaatattccttctactatataagtaaaattaatttcattgtatatctctgctatatacttataggttgtcactaaattatccagaatcctagagtgcaaggcatataattggaccacaccctgaaaacaaaaactgtaaaaaagcctaccttttaattccacagttgctgctcatacatatgtgttaccctagaacatttatcaagtttttacttcatctatccaagggagttagtaagaatcatttttcctacgatccagaactgttttgtagattaaatgagggacagtgtgtgtgtgtgtgtgtgtgtgtgtgtgtgtgtgtctgtgtgtgtgtgtgtgtgttttgtgttgccataacagaataacacagactgaatgatttataaagaaaataaatttatttctcacagttctggagactgagaagtccaacctcaaggtgctagcatctggtgagggccttcttgctgcatcgtcccatggtggaaagcagaagaataagggagtgcacacacgagagacagatggaacttgtaccctgaagcctttctataatcagccttaatccattcatgtgggtggagcccttatgacctaaataccttccattaggcctcacctcccaacacttttggattaggggttaaattttcaacacatgcttttgggcggacccattcaaaccacagcaatgtatgtgctgcaaagaacaaagattttgggatccaataggtagaatttagctccacattgggcaagtcatgataacttcctaagttttggtttcttaaatggtaaaacagatgtaccaatatctaattcagcagattactgtgagcagtctgagataccacatgtgaaggacctggtaccttgcttagcccttagccctctaaatagtagctattattatcattttgttgttgataagagagttaggaatgtgtaggaaaaaaaaaaaaaacttagttcaagacctcaattctgcccattacattttgtggaacctcagagcaattctcttttttctttttgctggtgctgcttcatctctttaaacccgtaacatggatgttacatgatctaagtcttcatttggttattaccattaaatgagagaatacagataaaaacctctagcatagtttctggcacataggctgctaaataaatgtatttgaatctgaatttaaagtatatacctcatctaagttgtaagtatgagtgtctttattcatccacagacatgacaaccgtgatttagatatgtttctgattttacattttcaaaataacttagtcttaaagaagttattctttttttttttttttttttttttttttgtagtgtgtgcttaaaagtcaagtacttgaacaaactggctctgtttaccagccttatatctttatgctagttaataaagaggcctggaatgttctgcaggtttcagaaatctggctgctgtttctttaactctgcaacttagacagaagacttctgtttctttatgagcacactacagtgaatattttgtctagctgcaggggaaaagctttgtcatggactttgcagacaatagccttaaaagtaaaatggtctgcttttggtgcctggaggttcaggggcctattgttagtgcacaatggatttctattgctgcattcctgctttgcaaaggtttgttagcttttaatgactgacagtactctattgcaaataccgtattggctgtgccctgtttacatgctactcaagaatttttgtagagtgctggaaaaaagagacagtggtgtttgtttgacctactctgataaggtttaagaaataattttactctcaaactgtttactgggaatgtagaaatgttggaagtccttgtggaagtatttcaaagttacttttaaagcgtcaatgaagagaaatgctggttataatatgaagatatttactctgttttatgactcctagagttgctgttaatattctgaaccaataccatatagaaattgggatattttaagaaaacttaaaagtaaatttttcggtattagttccttaaatgtgaaaaatagagctatgtattttgttctgagggaaaaaatccatttttcattcattcatttcaactgcattcattcatttcaaattcattccgtaggtaaatgtgcatttatgaagttgttgtaagggcatatacatatttgcatatatgtatatatgtatacatatagactatgtaaaagagtaatcattcagagcttttcaccattttattttccacaagtttctgacatgtgagacagaagtgttccatattgttactttttttttccaaggaaaattgcacctctgctttgttgaaaactccacacaggctttttgactctgctagctgatcgctgtaaagatggggccctggaaaaagtagacagcattaactaaacgtgatgatgaaaactctctaaaatgcatcttactgtggggaaaattaaccagtttctaataatattacggtctctaggccagacggtccctttgataagttaacatgtactccctttatgctcctagtagggagtaaacaaatgcctgaacaaacacacatacacataaacaccaatgtggagaatggcagtgtatgtccttgatctatataataagtgtgggtattgttatttagatggagcatactgggacacttatcttttagtacattccatcttctaagtgaatgctgcgctaatcacgggattgaaagccattgtaattgtgtatccatctaagtgctgacaagaatatacaattatattgtttgaaactgagtttaatgtttgggagtttttattggcatttatatttacttatacattaaagttcaacacaaaaggaaaggtcaaaacctatgttatatgtagaaacaaataccagactaaagcagcaccttgctttctaaaatgtgtgtgccctgtctgaatacagggcattttaaaagagtgtgatacaaatctgaaataagcaaataataggtttccattataggcagcattcctcacttctctagattttccaatctttttaaggcttcttttataccaattttttttttgtttttttttatgttcgcagtactggcaaatcttaccacagtgtgcttaccgccacacgatgttaaacacatattataaagtggatgtaattgtaaacacacagagggatataattacatgtagcagatttaagagctaattctttgcctttttttactccgcattttatcaacataattattttttgactgcagactaacaccctgaaattgacaagcatccattatagcaagaatttgttcactaaattgaaaaacaatgaaccgcaaggtttatgtgtacccattgtcataaagaatcagtatggctttgttccgcaagaggaaaaagctaatgattttgaaacagcaggtgacaggacacattctttttttccacccctgttatcagttttttgatgaagccattatgaagtggggctgggatagggatggccttatttttagcagatagacttttaatgagctccattgtaaggagagtcatgttgatttgctcacttctttttttctttacttagaaacccccagtattgaaaaactactctcaaaggactggaaagacaagcttcttgcaatgggatcggggaactttggcgaaataaaaggtaatatggtgtgattgtttttatccaaaatgtaccaaaatgaagttgatattcagaaatagtaatggtgataaagtatttctgccctcacctcttctgcttcttgcattctctgtgtttagggtttcttctttctatcttgaaggaggatgtagcagggttcttatattctttctttgtttgtgccttatggaataaatgatatgttgttttcaacagaatcaccccactatacctctaacaggctctgattttcatcattaaaattaaattaaattattttcaaaaattaaattattttataagtaagaatgtacctatagcaaggttaaaaactgtattttataagattttgtacattgtacatataagaaatatgggtgtgtagaacctaaatttaaaaccagaaatgatgaaaggggagagcataataaaaggttgttttgtaccagtcaaggtaacaatttgttttggttttatttgaatcagcaattacatccagctaagaaaagttctataaaactattcatatcttaataaactcctactaataacaaggggagaagatttaatttcctcatataagataaaagcaaattatcctttcaattaatttaaaagtatgttttctcaaaacacagtaggcaatctatgatagttttctatttgttgctagtaggacacttaagattctgagttctacagtaggattttaagaaaatcaagatacttagtcatccgtataaaatatttagttatatattactgtgtacatttttggtagaggctgaatatacatttaagacatcactagatttatattattatacatgtagaaataggtgtataaataacttttttgcatatgtgtgtccgtgcaagtgttttcccaatgacagaagcaattttctctcttaaggctttactccatcagtgtatcctggagaaaggcaaagcatcagtcttaaatgtttggcctacatgacatgaacatctggatatctaaaaacttccggaaaatgtttggctgaatatttcactttccatgcagatcatttggaattacatgtatttaggctatgattacttgtgaaagggtgatgagaaaatgaattggtgctaatcaacaaattcagtaaccaaaatctacaatggaatcaaattcaaatgaatgagaatcaatatgccttaaagagcttgaagagaaagtttaaggagaactgagaagttttcatcttcagaggcggcaggtccttgatattattttgatggattttaacccatttacccctgaggcataagatgcattctccaaggttttttattctcctctgacctaggtaataactcagagtagagcagcgaagactgccttttccaagccttctgatctcattccaatggaggacaaacgttttttcccctccctcgttttccttcacaagtcaaacttaaaagcagcaacagcagtgatgacaagcttagaggaaagctcagctgtccctttcaggcttgccttgggggttagtttaggaagctacagtacaatcacaaaagaagtttctgtctttaattttgagttttttaagcttcacattcagagtataagttaggttattgtcctctggttctgttcaaaacactgttttctgatgcattttaaaagcaactgtaggtctttcttctgttcagggcatggttattaggtgttcaactcaggtttggcagtaaacctagaaaacagcactgggttacttttcctactgactgcccatgacagttgcaattactatccattgttcataggtggctagaaagtggagaggatacaatagtgtgttgccctctgggggtaagtgaatttgatttaaaggttcttgttggggtcaggcacaaagattatgtagggcccaggaatgtagttttcctgccgcttcagaagttagacaagaacagtggcgtagttgtttgggaagttattttttgaggcaaataaagatgtaagtcttatgctctcgtatacttgtttagttgagggagggaacaataagtaatcttttttttaaaatctgaaaatatgaatgtattgaattgttatttatgaaggttaatttaaaataatgtatttaaatagaacctttgcatatgttaggatgtttccagcctttacagtattcacagagtcttggtgtgcatggaaacttttctcctccatttatattagccagtttgcatttaatttttaattagttccaggagatgtgtgagtgaataagtgtgtgcgtgtgtgtgtgcccttttcccttttctgaatatttcatactatagccaagtgagaagtgagctctgtttttaagtgctgttttaaattcctatcagtgaattagtttcagagcatttggacaaatattacaatcatagcttggaagggtttagagaagtgtttcttactattaatattcaaaaagtaaaaaatgatagactttttaaaataggaaaaatgaatagcatttgatttggagagtttagctatcaattaatggttgtcatgcccacttaaagtcaatctcatttttcaagaaacaatgtgagttagtaaaggtcacctacttctaagagcataaagttatttttcatgttggattattttacctgttagaattcatgccattttatgctctggtactttggaaatgtgaattaggttttaaagttacattagaaacaatcctctagcaaacatgtaaaaaggacactcgatctggttttgcagaacaaaacagtttgactgaaaagttctgccaacaacagtcaatatatgctataaactgattagctgcccaaaagaagtatttgtttcttctttacttataagcgatgtagtataactggtcagtttacagattcttttgcccttatctatagcagaagcactgagtaacaataatgtgaaaggtgaagaaataccttttagagtctcatagttattgagtgcggagggagaaacaatgcctttactccggctggcaaccaatagtcacacacaatttcagctagcatgaaattccattacaccgaaggtcattcattgcattggtacctcacctgaggatagtatctggggatccatgtcggctttaactaatctaagcagatcatttgtttttcaacaaagtaattgcaaaatttgtattttgctgacttaatgtttatttgtagaattataacacaaatatctgcatgcaaaatactctcaattgtttttatcttgataaaagcagagctgtgtacgggaggttctctggccaagtcactttaaaaaattctagaccagtttctctacctgccttatttcaagagtttttttagagcctggtttatttcccctcagaatctctgatgcattcttctgaccctggtcacggtgcattaattcaggcccacaaactgttgaatctgtttttaacaaaagtgctagaatttaacaaaaattctagaccagtttctctacctgccttatttcaagagttttttagagcctggtttgtttcccctcagaatctgtgatggattcttctgaccctggtcacggtgcattaattcaggcccacaaactgttgaatctgtttttaacaaaagtgccagaatttaacaaaaattctagaccagtttctctacctgccttatttcaagagttttttagagcctggtttgtttccccttagaatctctgatggattcttctgaccctggtcacggtgcattaattcaggcccacaaactgttgaatctgtttttagcaaaagtgccaggggcatttgatgtaattcaacaactggttcttttgcaaggctataattttgtgtattctagaagaagggctataaaggcaaacaccaaacacttctagaactgccaataagggattcaaggagataatccattcagcaatactatagcctttcagagctcatgaattaaagacatgggcaatgtagattctgtagattcagtgtgtggatgaaagtagataatcttttaggtggcatgtaaatgtttgagatagaagatgtatagagtcagtcagtggcttgaaagggataattacgtctaaataacattagatgatttgaaaaaagcaggcttagaataggaatcagatcccaggtaaaaaatctagtaagggatcctataagttttataaatttaaaacatggaaactaatattcagcatttcaatatgtaagggtttatatcacttcaaaagttgtttcaaacatgttcttttaaaatccagtaaagatttaagaatcatgtggtttacgaatagtaatcttgttattattacatttgtacattaacctaaaacatgcatatctgcacatttttacaaaggggttggaaatgtttattattttctgagagaactgttggatctggaatttgttcaatacaagagtcagccacaaggaaggtacacaacatgtagtcatttacttctaaataaagtaaatgtttaatgtttttaatctaactaagcttgttttatagttcctctgtagttgcttatgagtaatgttttcactttttgtaaaaactatttcacaagaactaaagaaagactgctggcgcgtagaatataagttttcaaaataagtttgacaatgtctataaaagcaaagagtgagtacattttctataaaccagtgatttgctccgtctcatgacgccggtgtcctcatgccagtgtgtaaatacagctagtgatcagaagaaaaggataggtcactgtatctcaattgagctgtatattgacagtccagttgacaattaggaaattttatatactttgtactttttaaggtacttaataatgtgtgttttaaacataaggttaatcaaatactaaactcttacatatttaatctgggctttatattggaaaaaatactctcctcaacatgtttctcatttaaaaatgcattcattcatttaaaaaaattgcttgtttgagaagcataaagattctaaaattaaaataattataaacacattatttgttttcttgtagatatgaattccaaagcttgtttaaatactctccagactattgggtaatgcaattaacctaaaaccttttcctgttttgtactaaaatttactaggaaagcatggtgtagccacagtgatttgatgttatgtggactgattcttccaagtacttgtggaaattgggctaccacttttggtttatttcctcatctactcatttttaaaaagttgccgattatgatttattgcctgccacttagtgaacatcttcttacaggcactgcgtaaacatctttcttacaaaattattgtgacaacattatttaattctgattttacatatgaaaaaattgagactcagaaattaattatcagacaccacatactctagttgtggcagagtcaaaatttgaacttaacttctcactgcctttaaggcctgtgtttttttatgtaatgcttagcagcctgtcttcaacagagtttgactgggtgatctctagaatctagaattaaaactggagaacatttctagacctaccaaacctggatgaagaacttctataatttgcatccaagatactccgtccttagatctgtccctagcacacacacacacactcagttttgtatttttccctgtttacatattgaccagccccttgtagactacctaatattctgttggctcaaagtttggaatgtagtgcatatttgaggaaggaatgacaagtgaaaaatgccatgttttgggataactattattgactacattccaaatgcagcagatttaatgtgatattttaaaataatggtttttatatttcaagtacaataagtaagtagatggaatagttttggaaaaagttcctaaaattacagtctccattaaaaggtaacattttttaataatatgttttatagagcaatacttttttaaaaaggtaacaagaataaccctttcactcactatagaaattataatgcgtacatctctttcataatgtcccagaaacaaaacatctaccgtggggcaacagtggtgaagactatagctacttgttcattattttattcactctaatggtgtcacccttaacatggaaagttttccacattagatatatttaaatctaagccaaggcccaccttttaagatactgaagcaaaaacaacaacattatcatgtcaaaagaaatcataaacatatttaaaaaggtaagaatacttatagtattagggtacaagaagatgtcaattaatttatactcagtcatgtaatgaactatagtattccttacataattttaattgattccaacttctgacgggtatctatattgcagtaaagaatatgtagctaaattttgtcaaagtctgattaaattctttcttaatgtaaagaactaattaatagatgtttgcatgtaggataacctaacaaatactccttttatgagctgtaatagtgccatttttatttagcctttttgatgaggggaggtctaccttttctctttttgttggataagagtgctgctgaaagaagcttccattataaatttagactaacttagtttttattcatgttattttcagtttattcaacaaaggctgttatctgtcttgccatgtggtagctctggagatataatggtagcaaataccattagtatttagtagacagattcctgccctcctagagcttatagcctagtagtagttcttcattaggcggaatattaaaaggcaatacaatgaatgatttttagatgtttcaagtggaataccagttgaaagtgacatttccataaaaaaattaaactaagtaaagtcttgttcaaattgtaacactagtagtctgacaaacacaaatagtaaaacaaacaaaccaccctggcacagattttcactttgaaacaaataattaaatttttggtaagttttttgagggaagaaacgtaattagtttatttttagctctaaacttctaggacatttttttctaaagtgagtttacttgtactttttctttatttggacaatagttcccaatggtttactttgattttgatgatttgatttcaagccatttatctatttcatttgtgtggagtaaaacaatattggggaaatagcaattttcatgtattttttcttattatttcgatgtttttgagatcatctttaattcaaccctgatgagggtcattcctgtgcataaaattgtacattatcagctaatcaaggacttttctttgttcttaagtttatttattttattcactcaacaaatggtcatatatctgtataaaggtatccactatgttgttaggtattattctatagatactggaaatacagtgttgaacaaaacaaattataatagtgtcctattaccataaagcttatactctactgggagatacaataaataaataactatatcaataagaatataacatataatgctaactactatagtataaaaattgggtgatgtgatagaaagtgagatgtgattgcttttataattccagtggtcagcgaaggccctccgaggagctggacttttaagttattaccttggatagatttgattgtattcgtttttttttttttttaatctctttcatttaaatttaagctatctgaaggcatgcattcttttctggcttgttctcttagtatcctcaacacttaaaaacagtatgaggcacatgggagctgccctgtgaacacatgctgaatgaattaaagaaaaaagccagtcatttcaagaggaagattttgctccaccaggaggaatttgacaatgtctggaggcatttcggggcattataactaggagtgagggtcccacctgcatctagaagatggaggcaagaccactccccatgaaaattgtctggcctaaatgtcaactgcgctgaggttgagaaacctgggtctgggcgaagagtcttctgagggtaaaagttaacattcaaaggtcctgtggtgggagcaagtttgcatattggtattagaggaactcatagaagcatattgacaaaagagaaaacgggaagagataatgtcagggaagaaggcaagggccacaccattcagggctttgtaagggtaggagtttgcattttattccatgtgcagaataaagctttgaaacagttttatacagccatatggcatgacttgatttacctttctaagcagataactatgaacgtttgtttggagaatggattttagtaaggaaacaagtagaaatagagacaatgactagaaagcaattgttgtagtaaaggcaagagatgatagtggcctggattaaggagtaatagtggaaatgagatacagagactgatttataatatgttctagggttgatcaatttccaatgaattatatagggaagatgaggtagacaaaaaatgaacacctggattttgactaagcaatgtatggatggtgtattagtctgttttcacgctgctgataaagacatacccgagactgggcaatttacaaaagaaagagatttaatgaacttacagttccacatggctgtggaggcctcacagtcatggaggaaagtgaaaggcactaaacatggcggcagacaagagaagagaactagtgcagggaaactcccctttataaaatcatcaaatcttgtgagaattattcactatcacgagaatagcacgggaaagacccacccccatgattaaattacctcccaccggctcccacccacagcacatgggaattgtgggagctaaattcaagatgagatttgggtggggacacagccaaaccatatgagatcatgatgtcttttgctgagctggagatgactgaagctggttcccttccctcatgactttgtctcattatattaaggcatctgacatgtgctgcttttatggaatacagaagtataaatgactgctatgcctgcagtttttaggcaggaagaagactgaaacaatatttttgtgtcttacttcagttatctttcattctaaggggactggaacaggactagcatagattaaaaacatacaagaatgcaaataactgaaacatgaaaataaattactatcagtcacacacaagtgaactcatgacattagctatctgactcagatggagcaagttcatatatacatgactgtgtctccatagggttatacactatatagacacacacatatataagttatgactcttaaaaacctgaatctaggtgaataaagagtagctcctttttgctgggaggcctctggagtactccaaggatctagttaatattccttccacttttttaaagtcaaggatgtcttgtgactcttgctactttctccgctgttcacagaccacttattaagttctctctaagcacttggggatgatcatgaagaatgtgataatttagagatgaagccgtgggatggacttcttcatctcagtttagtacttttgtaaaaatggtgaagatttcttttgcaaaagcttatttttttggctcaactctcttaagccaaaactagaattcctatgcatgcttaaacttgagaatggtttaaagggaagcggctgtattctttatgtcattcattaaacggtgttagatgattttctatatgcaatacatatgctatttaccgttacctgtagtagataatgaggatagaaaagtccatcatttacagttgctgctattgcagctacctctcctgactttgggagaaaaatgtgaacataagataatacaatgcaatgattcaatactataataaagatctacacatatgctgtgtagattcccaaagaagagaacaaatgttatccgtggaaatcaggaaaagagccacaaaaaacaagatgcatgagctggagcatgaagaatgaatgtttagggagagactggcccaggcaaggcacttgttaaggatggcatttgcaagtgctcagagtggtggtggtggtgggataatgttagaacattcagtgtggctagaatttaggatgcacagaggaagtgggacaagtaggtgatattttgaaggacctcgttaattcgcaataatgacttgacagttttttctgaagccaatggggagcaattggaggtctttaaacaggggaaatgacaggactagactctgacatgatatgactttgttatctaggaaagtaattttggtaccagttttagaggatagatttgtacagagatcaattgatgacaggaagttctattttaaaagttctattttaaaaatttgttacaaaaattcatgaaaaaagatgacaaaaatggcagtgaagatagagaaggcaggatggaaaaagtgctctctctaagtcagtacaacagtatttatgttatgttatcatttgcgtaaaaggcattcttatgggttgaactacgcactttcccctacccaccaaccctaattcatatgctgaagtcctaatgcctagaacctcagaatatgaacgtatttggagacaggatctttacaaagggaattaaattaaaatgagtttattatggtgggtcctaatccaagatgactggtatctttataagaagaggaaatttggacatgggtatgtacagaccgagacgatgtgaacacatatggagaagacagacatctgcaagccaaggaaagaggcctggaacagatcaaccctgttgacaacttaatcttagacttctagcatccagaactgtaaggcaatttctgtcttttaaaccacccagtctgtggtactttgttatggcagccctggcaaactaatactgaaatattattgtatatgcttaaatctgtgttatcaaggataagacacacaaaaaaataataatagtggttacctttgaagggacagtgttgggaggagatcttttactatacacttttatcattatttactaatatgaacataataatattgaaaaatataattttcattaaaattaaaggaaaaacaaacctattttgaggaaaaattactgtgattgattaatatcaatgcagggatgggtagttgagaaggaaattgaagaagttaatattttagaatgctgattggtaataatgctttaaaattacaggaaagtggtgagtttcactttatccatgttgaattttatgactgagatacaccctcagagataccccattctgcatctaaaaataggttaatagggctgggggacaatcttagggttggcacgtaccttattatttcattgaatgtgaaactatgtattttagaactcaggaggttaaaatctgtaaagcattgttgaaatatagttcttagagtttgaagcatgttagttcaaggacggaaaaggtaaagaatgggactggggagaatatgggcattcatgggtggcagaagaggagtcagtgaaaaagattgagaagaaaaggttagctaagtaggagttgaaatagaatgaaatcatgtctaggaagtcatgtgagaatgctgaagatgcagcaagatgggctgaaggttcaaaaagtttgaactgagtatggactataaaattagaaattttgttttaaatttgaaatcttatttatgtctttatgactaagtgaaaacaaataattttgttaatctttcatatacttaatgacaaaatgatatttgttaattctcatcaccaaatatatacagttgacccttgaacagcacaggctagaatgccacaggtccacttatatgcagactttttttcccagccaaacacagatccaaaatacagtattcacggaatgtgaaacccacctatgcagagggctaacttaagtgggttttgcaggaccaactgtaggtgttgagtatgtgctgatttgcttaagcttttaacttatacttccgcatgttgaggtgaaataagttttttctgagtgtggaagtaatgtaataataaccattgtggaaaaattttctaaatacaaaaatatgaatcctagcactttgagaggctgaggcgggaggatcacgaggacaggagttcgagaccggcctggccagcatggtgaaatcccgtctctactaaaaatataaaaaaattagccaggcatggtggcatgcgcctgtaatcccagctactcaggaggctgaggtaggagaatcgcttgaccccaggaggcggagtttgcagtgaggtgagatcgtgccactgtactccagcctgggtgacagaacaagactctatctcaaaaaaaagaaaaaagaaaaaaattaaaatgacctataattccaccacttagaaatagctactattaatatgtagctaaatttgctttcagtctttattcctataaacatagacatgtgcatgcattgaggtgagtatacaaatgtttcatttctctccaactgcttttaaacctagctttatatcataaactagatcccatgtcattaaattttcttcaaaaataattttttatggttacaaaataccatggatgacccataattatttggttattcttatttgacatttaggttgtttctagaatttcatttaaaacaattagtaattaacccacatttcttatgatatttttggactagatttttttttttttaggcagtgtatctcactgcaacctcaaattcctggactcaagtgatccttccacctcagcctaccaagtagctgggattacagctgcataccaccatgctcagctaatttttaaaataattttgtagaaatggagtcttgctatgttgtccagtctggtctcgaactcttggcctcaagtgatcctcctttctgggcctcccaaaacattggaattacaggcatgagcccctgcacccagccttgggctaggtttctaaaagcagaattatccttcgtaggttatgcgcattctaagacatgatgtgtattggtattcctagtgtgtattccttgaaatgtggtagaaatttacttctctattaacaatgtaggaagatgtttatcttgctagcatatgaatattttcattaagaaaatcttcccaagatatatttatattatttaatattaggatataatagtcatgtggctattattcatggagttagtgttcattcattctgatggaatccaaatatctgagatataataaattattagcaacacattattgactacctgccttgaataaggataggcattgataataagaaagagcataagaaatggttactgccttattcacacattttcttttctgaatatttcttctctatgctatatgtaaaatatgttagaacccttctttctattccaaatggtcatataaaaattataagctactaactatagctgctacttcctaaaatagaacaaactgtttcagcctaaattggtaggagaaatgcactggggttaagaagggtgattgagttataacagatccttctatctaattatgtatacaggtggcaaatgcagtagtaaaacagtgcttagtgtcttatgtttgaagtgaaaattgtaattaaagagggtgttctctcctactggtagtactttatcataggggccttgtctatcttgtgagttctaaaagaacaattaaaagagatactgtttccttttcagtgaacagcacatacttctcttatattaaatataaattttaacttaataagattcattggcatgttttaaatatcttgagtgtaatatgtgttttaaatgattaccatgacttctccaaattttggatttatgtattagcttacgtgaccataatgtgatgctaatttgccaaccacattatctcacaattgctatatttgtgttctcaaacttgaatatttgctcagttaactgtattttattttcgaagatagactctgaattggcatatggggaatacgctctaaaacttgattggctagatagatgtttgctctcttttaacatagaattctgaatcttcaactttttttttaagaaagggagaatcatatcactaatactaatgccttgacctcttaataactctggctattagttttttgtgtctttgtcttgcctccttaattagatgaaaaactgtagtacttaaggccaagaactgtacttgggacatctttttatttccagctggccctagcatagaatattaaaaacagtagatgttcagccaacattatttttaaaatttacttataaagtaaaagttaaaaaaaactatagattattactggtcataagtgtaaaaacattcaaaatgtttggtcattatggaatttcatttgaagtccaatgtactatctattgtgccagagagccaagttcattgtggtattttgtaataggtaaattgccatcactttttactgttgcgtgaaaatgtaaaagaaggtaggtaatgcttttgtgtttattgaactttatatttggactggctctgtatacaacagagccattttcattgaaataattactttttttcatttattttgtctgttttattgctatatgatttgtagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaagtgagtaagaactagcgatgcagtcatattcctcagacattactttgcctgctacttataggtcactgtcctaggcacacaacaatgaataagagtcccttccacctccccagttaaataaattcaaaggccaaaaaagcaaaacaaaacaaaaacccacccacagacaaaacccggattttaagatgcttattaactactttggtggtaagtagtgtagaagtgattataatcaaggttaattctgataaatcatgagaaaaataccaaaaaagaaccatggagagtcaagagaacattttcaacaagaagcattttgaaagaattcattagagagctgacatttgagatatgctttgaagaaattgtgggcttcaacaagtaaagtgagtttccagctgggggcaggaagttcagttacaaggccattataatactttaaattaaaaagagtgagaatctaaattagtcagggtaatgaccgtggacaaagagatgaaaggaataaacaggtggaagagttatggttagtagaattctttgagtaggcaaaagggaaaggaaaagagttgagcctagtaatagggagattgagaatgccatcaccagaaacagagaaagtcagaagagcaagtttggaaaagaaagtagttttatgatgttgaattacagttcctgtcaagttgtccagttggaggtatgtgagagacagctggaaacaccagtcagcattttggaagagagctcaggtgtttcttaggttatttacagagaaatggtggtttaaactctactggaggagataacattcattcatttatttgactaatagtaatctagtgcttcttatgtgccgggcactgtactaactaattattgaggctatctcaattaaccagagagacaaagcccttaaatattagtggaaagaaagagacagataaaggagcagataacaaaatgatattatatagtgataaataatttgaaaaaatataaacaggataataagataaatgttgattgctatgacaaggcaatgctccttagattgggcagctagatctttctaaagctttggcagttgagctgggatctaaatgacatacaaaaggcagccatgttaatatcggggataggagtgttttatgcagagatgtggcaggcttataggccttaatttacagtggtaatattacaagaaagcagaaaggaactaagggtagatctttgggagatactggcttatatagctggcagagaaaggaaaatgaacatatgcagaaagaatcagatatggaagtggggccaggagtgcaatgtcataggaaacaaaacggagattttaagaggtcttggggaacagtgttaaatgctatagaaaagtaatcgttctaatatcaaattgaaactactagatttttcatttagattctcattgttggccttgaagagtaaggcttctatggtgttttagtagccgaaatcagacaataaaaactggaatatacatagtaggaaaatggaggcaatgcctatgaactattagttaaaaaaaattggtagtaaatacaacgtaagatagaggggaggtgatatagtttcagcttacagataagtatggccctctttttcatggctaagtccttttcctcttccatgttctgggcatagtccattcaccatcccaggtggaggatggccactatttaatattcgtgtgtctacacatccctgtaaaaccttctaaacatctttcaaagtgtaagctagcagggttgaatggcatgaagaaatactcagtttatgtttgaggagctccttttttccacccccttatttccattgtactcttctctacttggtggttgatgtctgcttaaaagatgttcgttttatttttaatgaaatgcctaatcactttcattaaagatatatttggcttttttttgggtatggcccatatgcctcttgctttatccccatgataaaagagttcagaatgcttgcctgtaacagtataaaacaacaccactcttttcttgtccttaactctcaatctttcagtcaactgaattctggagaatcctaggagcttcagaaaatgtagcttggctggggatattttttgtagataacccctatttgctttggtgggtctgagggcacacatgtcctgaaagatctaagcaatgactgatggagaggaagcttctttcttatctctttcacattctagcccatccctgaatattataaaaggattctagaatcctttgattctaatactttcccaagacctctgacattctccttggaactttacaaacccctaagttcttcaagaatttctctcctgtattggagagatgtcctgcagtgctgcctccacagcctgagagaagatccctggtgatagctacaggtcatgtttctagagcccattcagctctcccagcgcttctctaccatacatggcaggcatgcacagttaccactctgtggtggcagatcttttcatgaaagacatttaatacttattatttaagggtcagggcaggttcgtcttctcctgtagtctttttctgacactcctcccagcactccctactgagtgtagaatgtccccattctatgtattctaatacttctggtatagctgttacaaaagctaaaggacctgtttactgatgagcctttcccccagattctgagctccattccacattcatctattagataaatattcattgaccaccaatttgatgccaggttttgttctagttagtgggagcagagtggggaaataaaacagacaaaaatcccttgtgtactgaaatctagttgggaaggatagacaataagtaaaccagtaaactgtacgttgctaagtattatgttgaaaacttatgcagggcattggagatgagggtattatctatgggaatatgttcttttaaaatgggtgctcagggaagacatttttgactgagaacatttgagcagaaacctgtaggaagtgtaggagtgagccatggggctgtctaggcagagtattccagaaagagggaaaagtaagtgcaaaggcccagaagcaggaatatccttgggaggcaggagcatccttggtgtgtacaagaggcagttaggaatgcagtgtggcaggcatgaggtgataggggatgagatgaaatcagagaggtagcaggagaccaaatcatatagggccttgcaggcattatatgtacaccggctttttgctgagtgagagagaagtgttttgaaaagatgactagcatgactatacatatatatatgtatatgtttgagatggagtctcgcattgtcacctgggctggagtgcaatggcgtgatcttggctcactgcaacctccacctcccagattcaagagattctcctgcctcagcctcccaagtagctgggattacaggtgcccaccaccatgcctggctaattttttgtatttttagtagagacggggtttcactatgttggccaggctggtctcgaactcctgaccttgcgatctgcccacctcagtctctgaaagtggactcatattttaaaaagtactctcagggtgctggtctgtgatcaactatagggagcaggagcaaaatggagcaaatggaggccattacaacaatccagatgagagacacggtgaacgggagaaagtacgtgggaggttgaagtggtcaggttctgaagtattcttaaagttctgttaaaaggatttaaatagcatttgaaatattgctatgtgggaggaaggaactagacttaatgaaaaaggtaatcttccttctactctctcttttaccactttcttcagaaaaaaaaaaaatcgtaggtcgggcactgtggctcacgcctgtaatcccagcactttaggaggctgaggcaagtggatcacccgaggtcaggagttcaagaccagcctagccaacatggtgaaaccgtgtctctagtaaaaatataaaaaaattaatcaggcatggtggtgcatgcctgtaatctcagctactcgggaggctgaggcagatgaatcatttgaactcaggaggcggtggttgcagtaagctgagatcgcgccattgcactgcagcctgggcaacaaagagcaaaactctgtctcaaaaaaaaaaaaaaaaagagaaagaacaaaatgtgttttttttttaccatattccaaagataaaattaaagcattaaaataattataattaaaccatcatccatagggaaataaatttttttgcgcagccaggtacatccatcctcatcacatgggttcttttgtttatggtgatgtgtgaattttttcctgaatttttgactttcaggtatagaggttaagagatttttttttttattatttctgagacggagtctcgctctgtcacccaggctggagtgcagtggagcgatcttggctcactgcaagctccacttcccaggttcacgacattctcctgcctcagcctcccaagtagctgggactacaggcgcccgccaccacgcctggctaatttttttgtatttttagtagagatggggtttcaccctgttagccaggatggtcttgatctcctgacctcgtgatccacccacctcagcctcccgaaatgctgagattacaggcgtgagccaccacacccggccaagagatttttttttttttttaataaaaatgttagtgactattacttgatgagaatgagatctagaacttatttataagagagtgataagtttcaggatgttagaagttatatcctatcccatgtgatgaaatgtttacagttttcatctcatctattcatgcactcttattagatatccattcagcattgcttttgtaacggacttcctgagaacagtgagtaaaatatacatggcctccaccctcactgaatttatggacttctccctaggagacagaaagatgttactagcaaataaataaacaaatataaagtcacagcatgggcataatattaagtaaatgtagaaggtaaatgtagaagtaaatgtagaagtaaacacaaataacagtgagagtggtaagtgattgtgctgtttcctaagttaggaaatacttaagatgactatatgggaggctaaatctcaaatttagtttgggacttgttgaacttgaggttcctttgaataagtttctcaataaatggacctgatgcttaaaacaaagttctaggctagagaagcacatttagaagcacttggcttacatatggaagtaagtatgaaggaaaagaacaaagtctaaaattgagcctcagagaattacaacatttaatggctggaaagagccattaaaggtgactaagaaggagaagaacatgagaggcagaaatgaaaccagggaagtatgatgatgtcacagaagccaacagagaaagttcatgatcggggaaaacatttgagtgttgaattctgatgagaggtcaaaagacgacaactgaaaaacacttcagaattttaaaataatgcatgtgattggcaaccttcttaagaatcattttggtaaaaaaaaatggaaacagaaaccacaatagcatgcactgagttggtggtaaggggcttgtgagaggcagtaatgagaaaattacttacctaaaaacaaaaaaaataccaaaaactttactaataaatacagtgtcttgcaatactttgtgctactctgaactcctcagtcttaaacctccccttctccatttgtgaaacactctgttatagaaaagggctgaaaatgtcagaagcagcgccttcttaatatatcactaggaagagggatgttcgaaaaacagacatttctttctgggattgatcactgccgtggtatcttaggcttcatttgttttaggccaaaagaaacataactgttcctaaagactaaatatcttccttgatcttatttaggatgaattgctgataatttaggagcacagacacgtctattttcatcatcttaatcagtgtcaaatcaaactttgagaaacagaacattagtaacttccctccgggactacaatatacttgtaaatttctcatgtgcaatttcttcacagattgcaagacagcagcagcagcttctacagcaacaacacaaaatcaatttgctccagcaacagatccaggtcagaaatcataatttcaatatacttacaatttaaaaaatatatattctgtttcttatccttaaatacctaactgaaatgacctccaaaataaaaatgactttcaagctaattcatgacatagcacctcctctgccatggaaatcttgcaaatggtgtctggtcagtctacaggccctactgtgtcagggagcttcaatctaagcaagctaacagttattttcatcttatgctgagaagaaattattgtagacaaaggtttcattttatctacattttaatgttaaaacgtgtctataagtgttcttaactggataggtgcagggaaccaaagcagaaaggtacctgggttttcagttagagaagtagtaccagatagaacttttttattgcatgcccgagagccatgtgtgataaagatggaacatagggatggtaataatttggtgttcaagtcgatttacctgtggttttgcctggagaaaacaagcctgaaggctgtgggacctccatatttttgttatttggaaatttgcaataataaggagcatcaatacaggaggaagcagctgtattggtaacaaaaagaaaaaaagtttccagtgatgtcttgtttccacaacttgctagtgtcataaactttgacaaaagttcagctttgtttcccttctgacaatttactttctgaacagcacttacttcatagagagatttttgagggttaaaagaaatcatggataaagagccttagcatagtgtcagggctcaatactcacttgctatgactatcaaggaacctaattcatggagctatgaatccaaccccatgtgacatcatccatctggaggccactgttagctttgcagtatgctaatctggagagaaattcatgattctcttgaagttatatcttgagatccaacatattttattaagtgtaaatatcataaatgacaggaagcaaatgtgtcaaaattatttcactcttgtattaatcatgttttaacttctttgccatccagatttctcctattgtatctaattgagtcaggcgcacctaattttgatggatttagcagacctatcactgttccttctttcttattctacctgggattttaatgacccgtagatagcttcagtgagacagtggaagttcagtgagatgttccagccgaggacatttcccctccttaactgcaattaggatcagcacatttccaacatgttataatccactcatatctgaagtgtggttattcatttcagtggtttaaaactgttcattgaacttcatattgttcaaagtacactgactttttagtcgatggtacctggttatctgcatttaaaatgttattaattatcaaagcataggtattaatattgttatggcactttcttattctaagtaaggtaattccataatcagcaatgtggtagtcacttgattttactgcaatttgacaagtgtgccaatagttttagatttttataatttttgtaatactgaaataagtcctttgttaaacagaatggcaaaaatagatttcaactcatattgtaaatgggtgtaaggctcaataaactgttccgaccaattagattagccaacaccttcagtgctttcttaggaattattccacaattatgaccactacattcacaatgtggattttaagccctgtcataatgacaaaaagttgaaatggatggattcttgcttcagagcatgaagcactgtaatttataagtcagaacattttttaatgaaaagcacttaaaaattatatgttctagaaattctaagactataggaactgtatttcagagagcaaaggccaagtttaacaacatgcccaagaccacacaattagaaactggtagagctaggataagaagcaaagttttctgactataatagaacttttgtggagtatgagaattttaaaagcttagaatttttatttgatcaaagtgttaggtggccagcctaactatttcagagtgggaaaagaaaaagtccctaaaggaaataaagtcacactgaaagtaatttgagggaaacattgagatattgagttatatatgtgtgtttgtcttctttctagagttagtgcagataaatgaaactgacagagtcaaaaccctttcaggcaacaaataagtactgagcaagactgataacctgaaagaaattcattttcacagcttccagtatattcattaacgaaaagcatagttctgaaatatattttgtcaattgttaatttggagaagtcttataaacacttaatagttatgaaagtaacaatatatttgaattgtttagtctactgcgagattgttcaaacaattatgggaagctctgatgtggtgacatatgtagaaataggacattaaaaatgtagaacagactaattttcccgccacataaatctttgccatatttcattttagaatgttttttcttcccttttctccttcttcctactgcctcctttttcttggaagcatagggcaaggatgaagactagtaaatatacaatctgctatcatgaaaggcaattggaatgtatagcaaatattataagatttattttaattaaaaatggatatataattgaatgctcacaaaataatttaccatagattatcttatttgatatttgaaaatactcatctagaatttccatctacttttttcttttttaaatacagtgccttgataccttgtagaaataaacatactaacttaaattattcatcctgattgtactttcttagatgttttataccattgttgttgttccagaccttagaaaacaacgcgtatattgatggagtagtagactgtagcgttttatagtccacaattaagaatgcctttaaaatgtttgtttcatatatgaatacaaaagacattatcttggtccagttttagcaaaggaatccaatacatcaagtggggtagacagatctgctgtgtgaattcgattgataagagttagagctgggcaatttttttcatttgatggatatgttacatgacaggaaagataatattttcctacattttgctcattgttgttgtgagatcttgctaaaggagaagtcaatttagatgtctttattccatttgaaatatatatcatttgattaaaaaagcatgaacaagtttgtatgtttatgtgtatgcacaaacatttacatactctaataccccagtatattactcagggctccccaaaatgacagaatcaatagaagatatagatatggatgatatagatagatataaatatagatgtaggtatagataaatatatgagaggggacttactgggtgattggctcacacaattatggaggctaagttctgcaacaggccttctgcaagctggagaccctgggaggctggcggcatggttctcagtccaagtgcaaaggcctcagaaccagggaagctgttgatacaactttcactccaaggccaatggcctcagaagccgggaagctgcaagtgtgagtcctggagtacaaagatgaggggcctgaagttgatgtctaaggacagaagaagagtgtatcccagtcccaccagatagatccacgcattcacctttcctctgtttttgttctttctggatcctcagcagattagaaggtgcctgcccacattgagagggtgaatgttccccacctaggccacttagactcacgtgctaatctcctcagaaagcaacctcacaacacaccccggcataatgttttaccaggtatctaggtaatcctcaatccagacaactggacacgtataattaatcatcacatccaggttatttcaagtttctcttggcctttttaattctttctcaacctctgatgaaaagagtggtggtaggtttagctgtatggtaaacctactctagagaaaatgccataagaatctgcaagtgaacgggttttatttaattgcttaggatcagttctttatgaactatttttatttctttaaaaagcaaccttagctctaaaactgcataattctaactggattaaaaactcaatctacatttcttccttataaagactttgtagggttacagtcttctgccaggttgacccacctaattcattaaggattaagaatgttttctattattgtttgcaatatcataaatcagtttactctacaaataccagaaatatccatcttccctcaagaacatgtccacttttctatgagactcttaattttagaagcactaagaagtttgtcttatttttctactgttcaggaatatttccctctaatatttgtgtttattgacttaaaagatacttttttaaatttcaatttactgtatcaagctaactttaatgcatattaatagatgaaatttgtaaatattttagaataagatatctttctagaatttttggaagggaagctcttttttttccctcttactctgttgcctattctacagtccccatcttttagcaattttatttcctattttcttttttacattaaatcaacctgtttctaatattgatagttagttgctttatgtttccagtaaagatcctggaccagtggttcatcttgacctgattcactgtttcacaggaagtgactgagtgacttctactcagctttcattatgacaacaaattgagtgttcctggagacctaagtttcctgtcatcttgaagcttctggtgggacagggtttctatagttttgggcatgtgtgtgagaagcgtgtcctagttataagtttcttactccttttcaataatacttagtggaatttaaggttctttacagcaactaatagggctaatccgacaatgcgttctagcatgaaatctacttaagatactttttaattgcaagtttaaagatactgtacttcttttcaactgcatattttatgattcccataccagggcatcagtgtttgaacttttataaaagattccaaaaatttaccccatttccccatctgattaacttttccaactattgttcattgtgttctcttgcaagcaaagaattagtatttaataatctcctgtcattgtttctgattcataagttaagcatgtgcaggactagtcatacctttgggtcactgattctgtcaggacctaagggtagagcaaagaaaatatttccattctcttgtattcttagtttggcagtgtgcattgcatagtatgtaggaaggaacttggttgcttcaggtggtgtaggattatatttacctgtatgaaatgcaattttaattatgttgaatagttttttaaaagatgattgagaacagtgatctggaataagatgaacctgaactcagtctgtgcatcttcacatctgatatctgccgtgtgatcttgagaagatggtttactccctttgagttttattattgcaatctataaaaaaggaaatataatacctaactaacacctggttctctgaagattaaatgggactgtgactggtatttagcaagtacatgggctaaacatttttgccaaagtcattagagagaaaaatgtgtgctttctgtatttccaatgatgggcaattcatgaatgtttccagcaagaggagaacttctaggaaaaaaaaaaaaagaatatactttacatggcagtagtcactaaaaactgtgagttcagtgttccatattcatatgattttagaactacaagaggtttttagaaaggctttatttagacctatctctcattttgacatttgtaaactaaaactaagtaaggttagaaatttttcccagtgtcacataagttgtttcttgtggaacaatggctcaattccaagttacccgagttttggctcagttcatttttattttaccaatattctaccatttaaggcttaatggccctaagttttaaaatgagttttctttccctgggaacttattcctacacggtaaaaatacaacttgacttatatacaattgaatgattaagttgcagtcatgggctcaaccaatttgtgataaaggtttcattttattggcaccaaagttctctgagctcattaaagttttggtaattcttgaaaaattattacgcagaaggaaatccattgaaatattgtattgaaacataataatgttacaggtgaaataatagtatgtacctaactgacctgctgatgtatgatttctttccctgagtgtggtaagcattttacccccctcaacaagaccctgcacacatacaagagcacaaagagattacaaagtaaccttgtctcttttggagactgcaaatgccaagaataaacactgtgtagttaaggtagcatttcaacctgagaaagacacgcattaactccttcagctccaactaatgttttgctatgtgaaataaaatacatcataactggacaggatacaatttcctggcattcagatagattattagaggaggaaatatggagatataaagaagtagctttaaggatgactttcttctttgtattttctggatgcataacttccatttgagaagacaagtggcctgccctgaagggttcgtaaggataactgcctgcagccctgtcctttcactcagagggagccactttaaaattccttaagtattctttttttaatatgtctcctggcaattacctaatggtagaaatccactcattcttcttatttctctgtctaggcaaacctgtctctgtagacagacatacggattgacaggtgtatatattttcatcttcattgatacaacacgtgctacatggctaagaaagtaccaaaaagaaatgaaagcaaccatctcaagctcagttctctatactttactcttcttttactcagaaggagccactttaaaatcttcctcctagtatttacttctctatcaaaaaatttaattatagtgctatttctgacttatcaactttaaataccatgatcctggaaacatgaagatttactagctccctattgccactctcctttccccttcctcaagatgcagttatatattatttaaatttattgagtaggtgctattaaacttcattttacttacaaccccttttcttgttcaatcaagtataaagtgttccttgacacttgccttgtcaaatgaggatggtgtatctcctcttctgttactcccaactgccaatttctgttattttttctccttatgttattggtcttattatttccataaattgctccaaactcttatgattaaataaaacctccagaatcctcttttcctggatatgtgctttctagccctctgacctctgttttggatgaatttatcaaacatgagaggttatatttatataggatttttaactactctatgtccttgatattttgaactttttaatatttttattgagacgctatttgaaataacaaagtctgtgttgctctaagctgattactatattgacgtgatgttgataacaatgtttagaagttgtaatcctggttttataactcatcctgacttgagctgctcagaaaaatcactaaaaaatgcatttaatggaaggacattttttcttttgctttttatctggaatctcaaatttctttattatttttattttcctgttttcccatttctgtgtttctttcttctacaatctttgcagtatgatttctgaagtgaatcctgggttcatttaatctatttagataattgtttaaactttggttagcgttgctgtggtctaaagaagagagatctgcatgtaaactgaaatatcagaggcacagaaccagcgggcttcagcattgggaacattttatccaaatctgccatgtgtctggagcagctgctttttcacaagttgtaaatatggccattctggaatcactgagattggcccagaaagcagactgacagtcatttttcccatgacttttcaacctcttcccaaacaaaattacctgtggacaaacttgaactgtttctcactgaggctctgtagtccatatcctcttaacaaaatagggactatcattgcttatatacgcccctgggaatgtaattttcaagtagtagaaacaaaacaaagcaagtcaacaacaacagaaagatttgggaatgttggccgaagtcagtatgttggtccaaaatgaaccactttttattttactttaatttacacaatagtgtggtaaaataaatgctatagctgggggtactcacaaagtctttagaatgaatttctacctcctgtctttgaaaagagttaacaaatagaaaaataaatgccattgaaattaacagaatgttaacaaaatgaattactctatgaagagcacagttacgtcatgattcaagacatacattccagacatctctaacatatggcaaatttgcttcagctccctagacagagtactaacttctactcttttgagcttttgctagtaaattttcatgtaacttacaaacagtgagaaactgacctctctctctctctctctctctctctctctctctctctctctctctctctctctctcggggatgtatgtatttaacaccattattcttcagaaaagagagccaaacaggtgaataaattgggaaagaaaagatgagtagggaattaaggacacctgtgtgccactaggcttatccctagttttcccttgaaggaaaagcaaaagggaaaactgggatagcttcttctacaaagagagtattctagaagtggaaaattctcagtctttatcatacttgagcttacagcagcatttgaaaattttgatcactcccatatttttgtaatacttttcagtccagcacagtttgcttttctctttaagtttctatttcttattcccagtcttatttggtagattgtctgcccatctttaaaaggctgaattgtgataatgctccatcatctgacttccgtatctacacttactgtctaaatggtctcagttggtcagtggttttatgtcaccctgaaaataatattccaaaatttgtctctccagcctaaatttctctcctgatcttcagagtcagaaaccccagttccatttaaatggtgatatggtttgtctgtgtccccacccaaatctcattttgaattgtagctcccataattcccacatgtcataggagggacccagtgggaggtcattgaatcatgggggtggatctttcccatgctgttctcatgatagtgaataagtctcatgagatctgatggttttataaaggggagttcccctgcacaagctctctgttgcctgctgccatgtaagacgtcccattgctcttccttcatctccgccatgattgtgtgacctccccagccatgtggaactgtgagtttattaaacttctttcctttataaattactcagtcttggatatgtctttattagcagtgtgagaacagactaatacaaatggatacctaacaggcacttcaaagttcacattttaaaaacatatcctttaattatcttccccaaactcattctttcccagtttctcctcctctgaatatgataccatttgcctgttttctgtggcgaatacctaggagacatcctggaatcctcattctttcacatctcacaactaatccatctacattggttttctgtccaacatctgtcaaattgaccaacaccattctggtctaattcaccatcatttctcagactactgcagtaagctcctaaccatgttggtcaccctacttcctttgtttaccccaccaagtagatttttcacatagctgctagagtgatcttttaaatgtgattgaactgtccttcttggttgctgggaacgtgctgagtgttctaccatcagggcatttgcactggttattctcatggcctggaatactcttttaatcatataatttagacctttacttcattcaaatctcttcaaatgccatgcttgtcagggaggccacctctgacagcccaatccaaaataatcccaaaactttctagggatatctaggatttgtaaccctatcaaacagtttaaggtacataaatctcctgtcttaaagattagtagttacagtagcaaataaggttaaattagtaatcttaggatttgtaaaccatgaactatttagtatactacctttgaaatgtcattctatttcaataaatttttgacttgatattataaacagggaaaaaatatgatctctttgtactgtactggtaagaagaaggagcagcctattgcttattaagtatttggcattttacagaggtcatcttacattattagcacaagaattcagacagtttgtgttattatatccattttatagatgatagaactgaggcctgtgtgtatgtgtgtgtgtatgcgtgtgtgttattctgaaaccctgacagttgagtactttgtaaactgaaggggtgtcttcctccctcttcttactagaagagtaatgagtgatttaattcagatgatctctagaaaataagactaattggtcttttcaaactgagttaaatctatcaggttggcaaatgtggcaggatatttttttaaaagtaatttatttccgctttctgcagtaaaacaagataagagattgtccttttataaatggtgaaaataaatatttataaatcaggaaaagacattttccacatatgcaaatattgcatacaactaaactttcactgataaatgctaagaaaataggatgctatgcttataatagataaatatcatctctttaaaaagaattatcttatgttgagacttatatctacatagtagattagaaaaggtgaactaactttataatgtacataaatgtttaactaaaataactaatgagaaggttttaatgtcatatacatatatttaattacagattatattaatttctgtgtatacattgtatatgaattgtatgtgtattcatacatacatacctaggtttctatatatctttttttgatcatttacttttcttttatcttctctgtttattgcatatatgtgtgtgtatgtgtgtttgtgtgtgtgtgagtgcgtgtgtgtgtgtgtgtgtatatatatatatataatttttctcctctaattaccaccgtttagttctgaatacctttttaattctctttctacttctgtattcctttccatggcttggcgaatacctacatccatacctgctgctggattgtctgacatagccactcgtgatttcttttactctttttatttttccctcccatacatagttcctttctctggctaactttttttctttttcttttcattatccaattggattttatgttttcgttgaataaaaacttgatcagtaataaacagagtaagttggaaagattgagtttgttttcattttaaaagtcaattatttgattttctgtggggcaatttgagagagagagagagggagaaagagagagagagagcaagaaaacataaacaagcccaaagaaaggtttcccagattgttagtataatatattatggcaatcttttcatgatagagggtacgttgtcatgagcacccgtgtcatgcagccagaaaaagaggagggatagggctgccgtaaggtaaatcaagagataacaataaaatttttctgttgcctgctggaggtatttaggatgtgttttctttatatcttcatccgcccctaattgaggatgctttaaaattgaatgactagcagtcaaaacgtgtttgcttcaagctgagaagaaaaatgctggtgtctccgcttccaaactgattgcgctttgtacacaactgacagctacagtcactttgagtgactgataagtgggaagctttgccacttatcaaggaatgcaggctgaaaagaaaagaccagagccgtttagatgctttggcatgttcaaaataacatcttacatcagtcagactcaggagcactaaaagacgtttaaaatgaagtgatgtatatagaattgtggtatatgtgtatgtatatataggagagacaaaaatcatttcgcaagcaaacagcttcaaagggtgaaagaaagagcattgttgttaaggtcacaatttgtgaaatgaatccaaggttaatcatttatatacatttgtgatgaaatttccaaattaaaaaatatgtaactatagacttccaacattatttatatgaacagctagctttgaccaaatggatgcctcagaacacctgaataataagaatgtcatccactaacatagatagtaatttttaccctgagggagaatctcaattcacctccccctcttcccttcttgtgtaaatatttaatatttagcatgtatgtttaaaatattccatcatctctaactgaaatatcatagttatataataaaatcaggtaagggtatatttcttctttctattttaaacatagttttgagactgttctaatgaaagtatattcagctttactgagctgtaagttccacaaatagaaacttctgaaaataacaattttttatgctcagtgattaggcttatgtgtatagaacgtgcatcatcctttacattttctaggacatttatgtttcaaaatattttgtctgtgtattcacacaattttgtattttttggacccctaacaaggtagatgcagtatttctcaatgatatttaccctcctgtgaacaccatgctctctatttaaataactggtttcagttcgataacccatacataaacctgtttctgtccattcatatatcctcgtttttaaatttggagatatggtaataataaccatattcatggataatttttcaagcttccttggcttgtgcctgtgcacgtaggctaaacttcatgtataatctcttaactatttaatgaacagccaactccatgctttgtgggtgcaattcttgatcctgcaaattatttcactcctctcatgccatagaattgactactaatgtttatattgctgtaaaaactggggtatactcaaagatagtcatttgagtgagcaggaagaatgtgttaggacagtgtggaactcaggccattctgcgaactgttacaggtcctcagttaagataaggagcttgccggatgcactttaatttagctgacattcttttttactgtaagtttttttttttgatgagggtaacagtttggtagtttacgctctcggataagctactgacctcatcacagaccaacactgtgagtactactgaattagaactttttgatcaataaaataattaatataggccaggcacggtggctcatgcctgtaatcccagcgctttgggaggctgaggctggtggatcacctaaggtcgggagttcgagaccagcctgaccaatatggagaaaccccatctctactaaaaatacaaaattagctgggcatggtggcgcatgcctgtaatcccagctactctggaggctgaggcaggagaatcgcttgaacctgggaggtggaggttgcagtcagccaagatcgtgccattgcactccagcctgggcaacaagagtgaaactccgtctcaaaaataaataaataaataaataaataaaataattaatatagaaaaacagactttagagataattcggtccagctttttcttcttttgtagatgaagatatggtccagaaatgaaaagggccatccccaagtcctataactaattaggcatagaccctgttcttctgggtcttaccttagttctggttaatcatattaaatagatcaagatcgtaggtacggatgaacacaaaataagagcaattgtgccgagcccatcatgttgactttatctggaatttgaaacaaatattaagtctaatgctgaagacatttggaacaatatttgaatgtttttataaaaattgtaaatgacacgtttttaagagaacaattaggaaatcttaaattttgattcactgaaattagtaatttattttggaaggtacatataaaaaactttaacaacatatatttcattggttcataatagtctctgtatttttttttaaagatcatttttacagtgagttagtatctctctttgacccattttggatcaaaatgtttaacaacatatcattgggatttgtgaactaaccaaataaatgaaaaaataatgttctagtataaaagtacagatgaatgtatttctccaagaaaagtgctcttttgacaaaaggtagttgagactcttttaaagtaaaactcaaatattttagagggcctctttgataccttgttatgttttaaaaacctaaatgaggaaattaatattctggctaagaaaaatattttcccattatacaattgattttactttttctcccaccgtaaaatactgctcattcacagttctccacatgtagggtatttattaggcttctttctattctaccatttattgaaggcttttttcttagtttcctattgttttaaaaaattctttctgttttgtgctgtaacaggtgcttcattcacataagagaacaggaaagcaagactttctctgtatcttgatcccttgaaacatggaatgagtcttttttgtgattaacaaaggctactgctcttaaatgcattacaagcatgatcttgaggtgtataaatacttccatcaacacatcgttacttaaacctgtcttctactggctcatatcatttttgttcctctcttttacactgtctcttacctgattgctttgtacccagtcattcccatgcttgtgatacaaaatcactcttgaacagcagatcatctctctgagaatttaggagaaatgaacataatgcagaaataactatccatcagtttttttttttttttttttttttggtaaatagctggggttttttttgaaagcagggtctcactctgttgcccaggctcatgcagtggcacaatcgtaactcattgcagcctcaaactgggcaggggctcagggctcaagcaattgtcccacctcagcctcctgagtggctaggaccacaggtgcatgccaccatccatgcccagctaattaaaaatatatgttttgtagagatggggggaccctccctatgttgcccaggctggtctcaaacttctggccttaagggttcctcatgcctcggcttcccaaagtgctgggattacaggtgtgagtcaccatgcttggcaaatagctcctttttataaagaaacattagtaccctggtagcatggaaatgctaataatctttatagttatgaggagagcttagaaaccttgtgaatctcacttctcacaatactatcattattaaatggtatttatttatctctcatgtagccaacataagataaaatgttaatacatgtaaacaaaacctgctttgagtaataagtaattagattctgattcatccaataaatctgtgctcatccatgtcatgacgcatggtatccgataattttatttttgcatataatcataatcacagaaataacatgagaagtcaatagcagaaaaaattaaaaaatattgaagccaatccatggacattcttgagttactttcatactaaagagtatcaaataacaatattcatgcaactaacaaaaactctcaaaaccatgtatgctataactttacccactctgagatttttaatggcttctgatgcttaggtataatgtcttcccccatttctccttctctctctgatcaaatccctagaattttatattttatctaaaattgcaaagaggtacctttttgctaagctttttactgccctattgagaaccgtttggaattgatgttctcctattgcccgtctcctccatgtagctgcattagcagccatttgttttcagtcttttccttttcctttctctcactttggttgctttcattttgaaacttgatcagagaaaatggaaaggaaatatgaaataacaaaacttttcaaattaaaactcaatttgttgttttataaggtttttgatgcaggataataaacagtgaaataataataggaaaacagacacaaaggggctttagaaaaatcaaaatcatctgcatttttagaggtaaagatgagagattaaacatggtttataaaaacattgtattttgcaatcatcctagttcaacttaggttaacctactgtggtctaattctgccaagtccctgaaattatgaaccttaagatgttgattccatttttccaatctctctttctgtatgcaaagattaagataggaagtgtggtccttatctttaagagttttgcagcctcaaaatgaaatggaaatgtcttcatgaaggaataattcttggatatttaaatttattttcactgagaatattttagaaagcacaagcaatgtgtgtataccagaataattacaccattttatttatttttttcatttcatctaactggtgtcttccagtagcattaagaagtgctaatatactaaactttgatgttcttttctatttgaaatatctaccacatacacacatatttatggcttgattttttaaaaaatatactcctttgcagaaaggtttttaaaaattatcatgaacttggagtatgtctttaattttaaaatattttaaggatgctaataacctgtttaagaatttttttactttaataactatcatctaggcaataaggcaaacattatagtttttctctattaaaatcaaaaaggaaaaatctcatcaagaaaatacatgaaaagtttggtagacattttcccccagtgccaataactgttcagatagctggaatatagttataaaacttttctctttgcagtacagtgttaacttaaaggagaagcagaaaataacctcaggatgtgctgtatttactttattagtactcatcccttctctccaccttgaccacagttaagttttattccgttctggctgtgttaagccgtactaaatatcagtgggatgtctgcccacatcatctgttataatgatctgctcctactcatagggactctttcactgaggctctctttttacaatcttacatacccacctgcttacataggaaatataattctccccttatgtgatcctgagctgctcttaataaacatgatggtgagaaatgctccaggcctgttttctgctcactatttaatagcttcccaaaagtgaaagagcagtaattaggtaagaatacatttttttgtcattgatgggtaaaagaaaaaaaattatggttgagggctgacagaaagttgtgaaatacagactatatttgctacatctcttaatgaataaagtcacaattcattgcaatgtgtgtaaccaacacaactggaatatttttggccttttaaagttcagtaatggtgttaatatttatgcaagatatatgaaggacccccaagttgatatcaataaggtagagatcaaacatccaaatattttttctactgtcaggaaaatattttttgaaacagtgcttacacatgactccaattgtcggaatcctgtgggagaaagtcaatgatataactttattaaaaagtaaactgagtctgtaatggtagctacctcaaatcttgaagggccaaagtaagcaagggataaggagcatcagctaaaaggccacaaaaagggcataggacttggaagagccaagcacaggagcacagaggcattcctttgtgtgtggatggtggctgtatctttaagggtaccttgagagagggcacatgggaagaatgatggtattttcctttaaaagctttttgggttgtacacagattgtgggatttagaaacagcagactttactattttttaattatataactttgtacaagtcacttaatgtcattgattctcagcctcttcagaaatagactagacattttagtatctctcacgtagctgttaagataaaaaattaaatacagtgatataagagggccttataagagaaccagaacatacgaatgatgtttttgcaaatctattttttcctcttgtgcttcctcttagcactctgaacttgaaattttagtgatcaacatcccagaaaggcttttttaaaaatttcttgttggtgtttctttttccccaagaagaaagagccagagagaaaatagctaaagaattatgaatttacttcatagctttaattagtggcatacatattagtgtagtgtctaaaagagtttgcttgatcataatcgactgtcccagtattatgccttacaacacatttcattatcatacatatgaaataagacatgtgtttataagaacaatggataagcctgttttctgacaaaatcattaactatgccaaagttctctttttttcttttcctctgttaataatgaatgctagctttcagtatctttaccgacttcatctctgaattaattttgaccttagtcaaattgaattttggtattagcctactttataaacctttacattaattaagttgcatataagcacactaagttacacgatttaccaaaaatttcttttcatcatgcatcacaacacttcccgtgtgttgcataacttaaggtgcctccatatctttggaatcaaatttttggtaagcttcaagaaaaccctagaatcatccacacaacaaacttaaatcagtttttacttatggaaattttagctagagaccaggaaatatttaatctgagcccaaatttaataagatttattactaatgatagtcatgtttggataatagatagtgagattaaggttgtttaattgttaactgatttgttagctatcctttgaggccaagttttttttttttttttttttttttgggaaattactactctttccttagaacatcatttattgacctctctgctaagttgctgcatgtgttaccactcatatttctgtatggaattcatgctttaaaggagcatatgggagccgttgattgcttcgccacaactggcgtcttgcctccagctgcttccaataatctggcatagctgtatttagtggataactactaatgttgttattggtcataaaagttgttaaggtacttagagtaataatgggctctctgaggagtagaagtaagtatataatttctgtatgaacttttaaatgttactgatctatcatacaaattaaaatctgtgcaagttttaactattttcattttaaacattaagtttctctatttgttagcatttactgcatactgagtcattaataaggtggtgtgaaatgatgaaactcatacttaggtataataacaaagaaagtgagtctaccagtaccatcatagaatgcatttattttattttattttattttattttgagatggagtctttcccccaggctggactgcagtggcactatctcggctcactgcaagcttcgcctcctgggttcacgccattctcctacctcagcctccctagtagctgggactacaggcgcccgccatcgcacccggctaattttttgcatttttagtagagacggggtttcacagtgttagccaggatggtcttgatctcctgacctcgtgatccgcccgcctcggcctcccaaaaggatgcatttttttaaaacataggaaactctatgcttctcaaagatagttattaactgtaaccaataccatgcaatttcactatctattaattacttatgtaaaattaatatagatttcttcttactggtgtaccttactatatgcataggtgtaccttactatatgcatagaaatttgatcaaactttataaataaattttacaaagtatgactaaaattcaagcagcacatttctaagaatcttgcattgatttattcatttgaaaagcaagtatttgttttcatctatagataatagcttacttttttttacattggctttttatgtatattaaatcaagttatctcaaagcatggcatacttaacatagaaaatgattacaagtgtagacatactgttgtgggttttttttgttgtttgcttgttttttgagacacactttcactctgtcacccgcactggagtacagtggcgcgatctcggctcaccgcaacctccgcctcccgggttcaagcgattctgttcctcagcttccctaatagctgggattacaggcgcacaccaccatgcctggagaagttttgtatttttaatagagacagggtttcgccatgttggccacgctggtcttaaactcctgacctcaagttatccacctgcctcggcctcccaaagtgctagaattataggcctagacactgcgcccagcctacaagtgtagacatactgttaaaaatgactttaaatatttataactgtagttctaaaattagtctattgccattgcctttatatcatttacattagtatttagaagataaattttagataactatttagaagaaaaattattctgtacattcataccatggaatatcatacagataccaaacagttaagaaagagcaaatgtaccaacaaggaaacatgaccaataatcttttctttttttttttttttgaggcggagtcttgctttgtcacctagtctgggtgcagtttcatgatctcggctcactgcaacctctgccccctaggttcaagcaattatcctgcctcagctttgcgagtagctgggattgcaggtgtgcaccgccacacccaactaatttttgaatttttagtaaagaaggggtttcgccatgttggccaggctggtcttgaactcctgacttcaagtgatccacccgctttggcctctcaaagtgctgggattacagtgtgagccaccatgcccagccaataataatctacatatattattaaataatgctagtcatagattatatatatacacacacgcatatatatgtatattatatatataaaagatatatatatatatttatatatattccagataatttcaatacacacattcacacatacacacacacacacacagagacactggagaatatatatttcccttatattaatagtggaacatgaaagaactaaataatgccacagtattaatgattcagataattctaacagaatcaacatcccacaaattccctagggctgaattaatgatgtagattatctgtatcatccagaactgcaggaaattctacacacttcactaccatatattgggagagtaaagttttcatgtgctagttttagaactgttatgttattagtgctgtaggcctgctgtaataaattacccacaaacttggtggcttacaacaagtgaaatttattccctcacaattatggaggtcagagtctgaaatcaagttgttgatagggtttattccttctggaggctctgaggaagcatctgtagcatgcctctccctagcttctggtggccagccagccgcctggccatccttgggatgcttggcttgtagatgcgtgactctagtctctgcctctgtccctacactgttttctcccctatgtctgtgtgtcttaaatatgcttctccattctcttataaggaaactactctttgatttagggcccaatccaaatccaagattatctcattctttcatacatccacaaagactctattttcaaataagatcatgttcacaagtaccaagagttgggacttggacatatcttttgggggaacacagttcaacctactacagctattaaaattatttataccttatatggcaattatttattgggtatcttgtgtctgtgagaaagtattgctactaaaaaagaatgagtagagagaaggatgagtgtatggctttcaggaacactgtgaatgtacaaagttgctttattattttagatataatttcattttaacttttagtcacatttcatagttgtttttcagtgtagctgtggtttataaagacacagtattattattgaatgatatagtctatagcactctgaacttagtgtcaaaggactttgtttaaatcttggcccatcacacttagttgcatacacttagatgttacttaatctttctgaggtctactttcttcatttgtaaattctagctaataatactaacatgtgaaaagttcattaagatggtgactataaccatatgttttctccagataaacctggctgctgggtttgtcctgaagttacaatcaatagaagtctcttaacagctctattgctgagtgtgtggacctagcctaagactcgtttgtacctaatccatatcagttcagtggaggaaatctgtacaaattgccttcatcactaagaaattttaatataccaggtttacatgttttccattactcttactaccaccatactctagactcctgaccatgtgaatgggaaattacgtatccctcttgggtagggtctaatatgataccaaaatatttgatgaattcagtcaaatttttaaacaagtgatcatgatcgactggtttttattgatttaagagttgtggctgatgtattggcattgttctcacatggttctcatgtgagaggtgcagtgaaaatagcacgattctcaccagtcagacaaaacaaagtttaaatggctgctcagctactcactacctgtatgacctgagcaatttactcattctcctcatttctaagatacagataatatatctttgtttcaagtttgttatagtcattagaaataaattagagcaccaagatggtgcccagctaaaagagggtacttggtaaatggtggttaaaaagaaaatattaatagcatctttgtggtgatgatcatgattcagaaatagaatttacaatgaaatgatttgtttcatttctttttgaggtaagtgccaggacttgttatattgtgttaggataattactttatcaatataatatttttaagctttctagttccattttccaattgtaattacttcagattctttctgttaacgttttctgtttagttttgcttacgtataacaaatatttcatcatgtgttttataagctatatcaagtttatcagcatatcttttcataagacacattgaaacagaaaaaaataatgtattagaagatactagaaacaggctattaatctcaaatgttattaataatacatttttgcttcaaagatatacagcatgtgtgtagcaacattgttgatttggcataaatatatatttaaatgcacaattatttcctatgcatatagacacatacactgctttgcctgtattttatagctttgacaaaaattatgccaaaaataaaaccacagggtatatttgataaatgttaattgacggtgctaagtttaaaaattaagaagtgaagactatccaaccctatggtgtaatgtgaattattttcttagttttatttcacatgggagataataaggcttcatcaagtaacagagctttcttaaagtgacaaactaatatgccacattgccgatgtaaacagaaaaaaaggcaacatagaaatagactctttttgaaaataaggtacctcttttgtttttattatgagatgagtatatttgtaattaagggtaaatggaacaatacatttttttcatttctaatttcaaggcactccttgaactgatggatctatattgaaggtgatgtttttaaagtcatatatagcactaaatcaaaaccacaattagataccatctcacaccagttagaatggtgatcattaaaaagtcaggaaacaacaggtgctggagaggatgttgagaaataggaacactttaaccctgttggtgggactgtaaactagttcaaccattgtggaagacagtgtggcgattcctcaaggatctagaactagaaataccatttgacccagccatcccattactgggtatatacccaaacgattataaatcatgctgctataaaggcacatgcacacgtttgtttattgtggcactattcacaatagcaaagacttggaaccaacccaaatgtccaacaatgatagactggattaagaaaatgtggcacatatacaccatggaatactatgcagccataaaaaaggatgagttcatgtcctttgtggggacatggatgaagctggaaaccatcattctcagccaactatcacaagaacaaaaaaccagacaccacatgttctcactcataggtgggaagtgaacaacaagaatacttggacacaggaaggggaacatcacacaccggggcctgttgtggggtaggggaagcggggagggaaagcattaggagatatacctaatgtaaatgacaagttaatgggtgcagcacaccaacatggcacatgtatacatatgtaacaaacctgcacgttgtgcacatgtaccctagaacttaaagtataataaaaaaaatatatatcatatattgcactgaaaatattccaggccaaattatgtaccacatataacaagctgtctgtttaatccaacaaagaactttctctttcttaccgtgtgtgtctttgagtgtgtgcgtgtggtgtgtgtctgtatgtaacctattatcccataataaagccatatgtttttctaatatgtgactttttccgttggaatagcatacaaataatacttttcagtaaaaataggtcttgatgtgataagaggaaaatgccaaaacagtccattccttttcacttcaagctgctgaaatattggactgggcagaagttccatttaaaattatttagtactaataacactagaattaatatgctgtaattaaatgttcaaaattcatccagtttcatatgtcaaccttaaagctaaaatattacttcaaagttacgttgatactagtatgatttaacatttcctatcctgatgtagtattttcagtatgtaagtcaaacagacatgaacagaaacacaaacacataccatacacaacctcctaaccagtaggagaactgtcattacattaaaaatactgtttaaattggtgacataacaattattactataataaaacccttattctttaatccctgtactttctatatttgctcctattggagtagaattaaagcggctctcgtaggattttggtttctctgagggtacttgttaatacatctgaattgtgagaatattgccctttgagtacattttttcatttccttttttataaaaccccaagggtctgggtatactagaggatgcttctgtatttaggctttctaaaggagcccttgtctgggcattgtagctcacgcctgtaatcccaacacactgggagggtgaggttggaggattgcttgagcccaggagtgtgagaccagtctgggcagcacagggagatccccatctccacaaaaaaattaaaaatattagctggggatgatggcactcacccataatcccaactactctggaggctgaggtgggaggttcccttgagctgaggagttagaggctgaagtgagctctgatcacgtcactgcactccagcctgggcaccagagcaagaccctatctcaaaataaataaataaaatttaaaaataaaagattccctgaacccattttgtttgtccctaaccttctactctgtggcaaatagttctgagcagtgaggaaatgattcttagtcaatacaacaattttccagctctatgaaatggttttcatgatgatcttgtatgtttaaatgtaatgtgaagtgtagtatagaggtaccttgtattaacattcagtcgctgaaataccagccacgtattctatgaggaagtcctaatcttgtgaatttgtgggctacaaatgactaatgatattatcaccagtctcccaatcatctaacttcaaaactttgagttcatttttgatgccttccaccgcacattttgttttctataacgttgtgcgtgtattgattttgcctttatgatattccttatgtctttttctgtttccactttcctgccacatgttcaaattctcattatcactcatctctgcaacagctacctaactgttctgatgccagtagcttcgctctcctgtcagctctgtgcattgctgtcagatcaatgttctgaaagaaaaactctcctaatgtttatcgttgactcaaaaatctttgacagctactgactctctacaaaattaaatgtttggtttttgcctgtcactgaagaccctcttcaatttggtgctagttgacttttctgaatttattttctattatttccttttacaaattgatgattcagccaaacttaatcgttcttctgttctccacacttttcagactttctagcctctgtgtttgtttttttttttatatggattccttttcctggaatagtattctctactacctctctccatgtcaaatgtagtcacattcagtaaggccaaactggcctgatttcttatctataaatagttcccaaattttccaagaaaaaaaaaaaatagttcccagattttcctagaacaaaaaaattcttctgaacctctatagtatttaccattctatgcttcttttatggtcctactactttgtaccttgtattacacttacttaagccattttctatcttctctcattgagaggagaatctagatagtatttatttttttgttttcgcaccatatatttgagtctcttacgagaagtgtgttaattgctccataaaggcatcagttgaaaagaattaaaaatcctcagctttccgacctagaaaaggttaatatagagaacaaatccaccctctgaaaataatgttttaatcaaatcaggagtctttacaatcagccacattttcagattgttttaatgaaaatgtgtggaagtgcaaattaacttcttagttctttatgaaagaggtgcctattttgaaaccctagtcacattatgttaaaaaataaaaagttcctgaaaggaaaatgtaaccttaaaatgaatgaataaacgctttattactttaattttaggtttataaaagaagtccaaaactaaaatcgagaccatgaaagtgaaatgatcctataaattatgatatttttaaatacatagttaaattgtagcacataatcgttgctctctgtatattctactcttatctctaatgtagtacgccctggcctatatcagaatgcagagtttcctgggactgtatcctttttgaagccaagtgaatgccatacacattcagtctgactcatgttccctgaaactcagactaattcactcaggatggccaagactaaggggctcgacagataggaatttctgtagtttgctttgatttagaagtactcttaaaaatccaatcctatgccaggcctctcttgatgttgctacctgctaacgattggatgacctaaagaaccagcctaaaaacaaaagaaatctcccaatcagccatgaatggcaatgcaatgaataggcttttcattaggatggagcagaaggcacatgcaaggtgactacagccataccttcaatagaataaaacttaaacctggtcctgtaactctatataagttaattatttaatactttatttcataactgcactaataggaaatctagtttattattattgatcatttggacatcatagagaattgtcttaagccatgagttaaagtgtcttaaaatatatgtattttgagaatgtatatatagtctgaagtgaggtttataaacatattagttgtagactgcctagatatagatagatataggtatatcctctatctcattctgcaacaattccaaatttgtttataataacgttggattagcactaaaatataacatccacagagaaataagtagtttatagtgacatgaaaatgccactataacactttatgtcaaagttctctatggttaatattttaaggttttaaaatagagaatttttaacaagcaggatacattaaaatactatttatttgaatctctttatattgacttatgtgttttaacttaaaattttagccctattttgaataaatgtacttttctgtactaaaaatattcaccatgatttttcattccatattttaatgtttttttacctagctggagttattataaaatgtggtatattttgtccctctatagttctagactttccaacttttaattacagctaggagttttgttgtaaacttcatgagaccatgtatttgacatgctttcatttaggttagtttatgctacccaatcctgtaagaatttatctgcataactagatagaatttatccagcaattgactgaatatcttatttgttggatttatgtgcattctaataacatttggttcttagttccaatagtgtgtataaatactaaatataatatttcataccaggaccagttattagagaatatcatcagataactataatttgtactcttttatctacttttatggctgactcatattgttttctcccccctctttgccatttgtttactatattccaaattgtttttaaacagttacacaagggattatgtcccttgggaatggtccgttacattttgaatatcagtgctattccaagttatttcaaccatgtcattaatctcacttaaagcaataaaaagcaaatagtggtgagaagcaagatgcataaagcattactttaaacagttaaaaaaaaaaaagatgttaaatgttccctctctaggagctcctgcagctctcaatacatttgtgtgcaactgagcaagagaaaagtagcagtgggattgttagtggagagagaagcttacaaggaacatcaaaaggggaccgcttcacattctggctcctttcttcctgcatgcagttaaaaagagagaatcatttaaacgagctcctgtagaacccccttttattggtttcttttcttacgtaaagttaccaacaggttcattcataaggtgatcttgaaggttgtttcactgtcactgagccacagttaaggtggtttgtaaagggtaccacccaagtataaagatgcctggtaggaaaataaggcctttatacaaaaagagcagcagcccatcagatctttccttttcaaaccaggcaggtccctcctcagaaagattaattacagtcaggttgagaagacagccttactgtgtatgtgtgtgtgtgtatgtgtgtgttttccccctcaacattagaaagataaagggtgtgattagtgtgcacaaagcctctgatcaaaccagctcagaggtttgtgacaggaggttcaaacactttatggatcactagtgctgacaggtagatcacacagaccttaaacagatgtttagtgagaagatgaatgtgtgagatctcaaacatgcagcgctcttttacttggccactttagtctgtgaagtattaaacgttgctaaagaaacctactcctttaaaaggggtgaaaaagttactaacaagcttccattaaatctcagcctttcttttattatcaagatttagcacagctgagatttgaaagttaccaaactttctgcaggaattggtgaacatgaccatactttatcttatagtgtatgaaatgcttgttaattagtttatgagtgtttctgcctcatatttgaaaagtttagttaacatagatagaacgtttaaggtaaattaaatgtagctaaaacccagaaatattcaagtaacatctgtcttttatatttgtaatatacaattttagaataatattggatgaaataattcatgattatgaaaatacaaaaaaaaatttaacagaatttccatagtgaattgtattatcactattaattctttacaagtgtgtataacgaataaatgttatgaatgtcttctattactttctttgacaagaaataaaatgtatacagtaggtatctgtctgcatgtatgtgtgtatgtgtgtgtgtgtgtgtatatatatatatatatatatatatatatgcatgcatatatatgcccagaactaaatacttggtgtcatcaattatgtttttatttcattatatcacaggggaatgcagacctgagatttctgtcagttggattaatatgtcttactggtggtaacaactttcctaggtgtcgttatacgtcaccctcaccttattgtttgtagagtcatacaaggtagtagaaagaaatattctacagggcttggcattttaatgccataaggctatggctttataataatttccttgtaaattcttagaaaaacatttatacataattgacaaaataagggagaagaattgattttgcatattttgcactttataatggtgatttttcaattcttttaattttaaattcgggttaaacaagatatggctgtcagtcttatcaccactaatagaaagatgattattaaagaacttgtgagcatagataataattatgaaataatgtaaatgaaagcatctttaagataataaaaactttacacacacacacaagcgttagaagatggggaggagtcattggaggaagtagaagaggaaaacaggaatcagaaaaggaagggtaatgataattaattatgttatggaaaaaaccatgtagttctgtctactgctgttatagtattatctaagactgacttttagaaatcgtattatattaatcatctcacccatgtgcccaatctatttctaactgcattgccaaagtcactgagaatgcaggagtatctatacattaaactaatacttactgaacatagtatgtgcagtttgctcttaacattcacagacaataaaaagatgagtaagatggagtcatcgttcctgagaagcttagatttatgggcaataggtgcttaagagtattggaactgaaacttttttgatgtatttctcaaactatatcatggtgtttgtgtgtgtgtgtgtgtgtgtgtgtcccctgagaaatgaagaggaagcttttgatatgtagcttgaaaatttcatacaagaaatattttgtctatccctaatttattctgtccaaatatgtactgaatttcagtcaccttgaaggatccattccactgcagttgacttcttagtgtctgggatgtcagatgggaaacaattttaccttatttcattctctgtccttcagctttttcactcgctgatttttttcctttaaaaaaagatgtaagagttgtttgtaagcaactttcacaattatttcttacccagagtgtgggcctgcctgtttgaatgtttccaagaaagtattgttcttatgtgacaacaggtcagaaagactctgcattaattacactaacatatggttattaacagattctagctcagggagcaatactttacaatgttatcttccacatagtcagatgttagccatattgtcagtgctggcagctattgtttcactcatttacttcacagagctaattactccctaataataactttaccttggagtttttcacttgcttgtgccagcaaacctgttcacactacatatgctaattattggcacttattcattatgttaagatagctttaagttcaagctgtgcagcctggctttcggtatggagccagctggctgcaaagttccacctttttttactaaagtcattaaaagttttaatatgggcccatcttgttctctttacaagattcagtctttcaggaattcaaatgaatgtgcagttacccatggacaattgcagattataataagaaggttttggtttctgtgagaaattctataagcttgcactcattgtggccttttctgttagataagaaaagatgagtgaatccttttccatctaaactatatggccactttatctatttgattattctatacacatatatacatgcatgtgtacgtgcacacacacacacacacacactctctgtttctctttttggttcatttctcttcagcataagattagctcactggtggtatttaatttattcataccaaagtgatacagaatctggaattttactgtttgtgtaacatcctttctaaagttttttctttttcttatcatttcaagaaacagaatcaatgccagggccagagactgtgcttgaactctattcaggattcccattgatatcagcaggagttaatatttaagtgttgttttcagtcaaagtaaaatatggtttctctagttttaatgaacaaatagcttcatttggttcacgtccaaatataattagtaactactaccactcagttaaatacccaactttgatgagtatgaatcaaaatggatttgaccttttagctgataattttgggggaaatttggagacctagaaatgaatatatacttaggcataaactgtttaaaattagtttttatcttaaacagatgacttctgcaagagtcaaccttctcatcttcaccttagttgtaattagtcctttaaattatttaatattgcagtgtagatattaaacatgggaatcttgagacatataggtatttaataaaaaatggttagagacatatattattacgcttaaaacagcgtataagagatatgaatctgtttcaaccacaggcaaaataagagacttgagttagactttcagctctgtattctatgaggtaaatctttcttcatattttagccctagcatcgacattttgctactagaatactcatgggtagtgttcattttagcctatggaatgccaaataacaacttctagtgtttttaaggattggcataatttggtatatctttggaggtaaagaaagggtatgtgataacaaagagaaatagaagagaaatggaggagaatgtaaaaatcttttggtttctacctaccaggagctccccttgatccgtgacaatgtttggtgggatctggcacaaactaccaggatgttgagggaggggtcttatgtcactacaaatctattcttgctgggggaccaaaaaatgttaccactgaaaaatcacctctagtaacgatcctgtttacattttaagtaactatacaataatatgactctctgatgagaaacagatagcaaatgttgagggaattcataattaattatagttctaaatacttactcaagttgggaaataaagactgtctttgaccttaatgatatgtttataaagattcatgtgttaaagtttttgatatgtgagttatccattattatgtttatggtgaagagagaaaaggattttgcagagagggataaacaatttctaaaaataacaaaatctagctgcaacttaagaaaaggatcctttttattaaaaaaaaaatttcaagaaacctcagaattccaatttctcttaagaaaagcttgtgtatgatttcttgataaactagttctgttggagataacaaaatgtggttgctgtgccatagatattggcacacactgagcactaccacagttttcttcagagtggttggaaagttaaaccaaaataaaataaaattaataattgcagtaattaagggttataactaagaagtcgaaataagccaactcaaatttcctgaggtaattcaaaaatctattggttcaggatgaaattacagattaaaacaagtgaaaacagtacaaagacaatagtaaattttaatttgtaagcttttaaatactccatatgaaattaagactgagatatatgtgtgtgtttgtatatatatacacacatatatatttatacatgtatatatgtatatgtgtatatatatacacatacatatatttctatttgaggcttttagaacttttattagctatcaatataataaaaatatttaatgacaccaaaatacagtacactaaggaagaactcatttgggctgttctctgtcttctgagtaatctagtttcatacttttttatttggcttgaataatttctgtcaccttaattcttctctacatatttatgaaaactattaacccattctctactttataaagggaaagttttcattattcctaccctctctgccatactttgacatttaaaattgtagtggccaccattcaagggaaagagtttttgagagtcacgaccaggagagtatggtcagcttttgcttcccataccccaaattgtgaggcctttacttgtggcattgtgaaggaacaagtgctcaaaggcactttgagcttgttgaatcaactagtttttggttaaaagtgctttataatatatttctgctcttacgagaattaaatgaaaagtctcaagagagaaaaatgagaagtttaagatgggtctagaacacagactacgacactgtaagctaacacaaaagctgggctaccctgcagtcaaattcttacagcaacattaggatcagagaataagctttggataatccaaaagatggtggagcttaacctgagactgtctcattaagcttagactaagttaaaaaacagaagaaaaaaaaaagttagagatataaattccactcgtattaaatttgttgtgtgtcagcagcagctttgctctacattcttttcaatccaagatcaaggcttacagagcagttctggtctgggacatgataatttgacagcagagagagaacaggtatagcggaaatatgcaatgactcttaaaattttttctcagaaattgcacccatcatttcttcccatgtttttttataaaacagagcaagtcacatggccaagtctggcatcagtagtgtgggaagaaaaatccttctagagggaccctgtaaagtagggcatcaactattttaaaagtaaactctcttaaccactaggctacactgcttccccttattttaaaagtaaactctatcacaataggtgttcaagttcagtagagctcctgaaaacctggtagcatccaaaccaaccctctctgaaagaaagtatctctaatttcatttcccaagacttccacttaaggaaacatatactcaaaattaaaaattgcaaaacacacaaaggagcagtgcataaaaaataagagtacacataaatactgaagtatttagcactaccactctaagatcttcaactattagaagtatcatatagacaatataaaataaatatgcatagaatgctaaggaaacaatgaaaccacacaaaaaataaacataaaaaactttcaaaaataaacaaatatttgaaagataactaaatggaaagaaaaactatagtagctgcaatcacaaattcagtcaatggatgttttctgtcttcttcttccaactaggttagagatataggaaccagattaaccatgcctcataaacaactagaaagccagagaaaatatatgagacaaaggtgttcaaacattggacaaatgaggagagcccacagtgactgtccacagctcactatctggtgagacaaagaactcaggcagaacttggcagtctctctgagttaaagaaacaaacatcaaggttcagggatgccaaggcaggtaaatatatttgcagcactggaaagaatagcttttcagagggagagacagacagacagagagaaaaactaactctttttcactagaaatctgcagattgtgttcatcaggtcttttctgaatactaatcagtgcatatgtatgtaaactaccaaagccaggtaaggaacctttggaaaagagctaacaggaacaataatcctcagttctcacctgtgctagaaatactttctgttttcacaaggcagaatggaggaactcgtaacatgtagagggtagggttgtatcttcaggaagagtattgcttcagttgtggaaccaagttaattttagtctaatagctattccagaccagaccttaaaaacaggtataaagtaagacttgaaaggatgaaattgtttccagataaattcagtgaaccccagaacaaccccccaaatagattacaaaaagtaagatgaaattcaaaatgttttatcactcgatcaaaaaatagcatgcatagaaagaagcaagaaatcacacaatcagaagaaaaaataatcaaaagtggcatagatgttagaataagtagacaaagatgttgaaacagctattaaaaatatattcactatgttcaagagcatgataaggagatgattggaagctataacagtgtcctagattgagctttcagaggtaaaatgtacaatatcagagatctgaaaatactggatgggatcagaaattgcaaaagataagatgtgcatttgaagatatagcaattaaaactattcagaaataaaaacagaaaaaagaccaatgaaaccagaatgtcagtgaagtggggtgaaggaagaaggagacagacaaaattcattaaggaaattgtgtcccagaattttcaaaatatttcattaactataaattcatatatctaagaacctcaaagaaccctaaacagaagaaacatggtcagattgtgaaaagaagcaatgaacagaaagcttaaaagctgccagagattaaaaaaaccatctatacagagaaagtaaattgttgtaaggttcttcttagactctacatgaaaagttataacatcatttgcagtagactgtgataagtttaacagttgtactgtaaatcatggagtatccaataaaataaaacaaaaataaatacctaagaagtcaataatggaaataaaatgttactataaaatacttaatacaaaaaaggagtgaagagattaaaagagaacaaataacaaaagagataaatagaaaacaaatagcaagattgtagattgattcctgattgtgtcattaattttattaaatgtaaattatcaggtggatacagtgactcacccctgtaatcccagcactttgggaggccaaggcaggcagatctcttgaggtcaggagttcaaggccagcctgggcaatgtgatgaaaccccctctctactaaaactataaaaattagccaaacatggtgccgaatgctggtaatcccagctgctcgtgaggctgaggcatgagaatctcttgaatctgggaggcagaggttgctgtgagctgccatagcaccacagcactccagcctgggtggcggagtgagaacctgcctttaaaaaaataaataatcatgataaataaatgtaaattatctaaacaaactaattaaaatcagagattgtcaagttaacaaaaaagaaggaagacacacctgtatgttgtctgcaggaaaccactttcagtataaagaaacaggttaatgcaaaaagatataccaagttaacactaatcaaaagaaaactggaatagctataaaagtgtcaaatagatttcagagctaggaatattatcaaggataccaagagtcattttacaattttaacttgggcagttcatcaagagaccttaaaaatgctgaatgcatatgtaactaatagtagagcttcaaattacagaaaataaaaattaataaaattaacatgagaagtctacaattacagttggatatttcaataatcctctttcaattattgattgaacaagaagttagaaaattactaagaattgaatgacactattcattactctgaccttatttacatttatagaacccaacaacagaagaataattcttttaaagtgcacacagaatatttagcaagcagattacactctgggccattaaaggtcttaatacattttaaaggactgaaataatttaaaccatgttttgtgatcaaaatggaattaaattaaaaattagtaagcaaacaatatctggaaaatttcagtttatttggaaactaaataaaatacctctaaaataactcatgggtcaaagaagaagccataaggaaaatgagaaaatattttgaactgaatgaaaattgacaacgtaacatattccaaatttgtgatacggaactaaagcagtatttagaagggaatgtatagcattaagtatatatattggaaaagtggaaaggtttaaaattaattacctaagctttccccttgaaaaactagaaagagagcagcatagaaggttaaacccaaaggtaaaaattaagagtagtaaaaatagaaatgtaaaataagagaaaaaagtgtattgaaaagtttattctctggtattaataaaatcgataaacctctagctagacaattcaggaaataaaacagagtagacacaaatttgaaattgtagaaatgagaaaaaggacatcactgaagattttacagaccataaaaccaggggctgttatgaaaaactttatacccataaatttggcaacttatatataacagataaccctctgaaaggcagactaccaaagctcgctcaaggagaaatgcatgccctgaatacctctacactactaaagaaatacaattttcagttaaaaatcatcccacaataagattccaggcccagatggtttcattggtgaattgtaaaaatatttaagaaaaaaaaatgccaattttatacaaactttcagaatgtagaagaagaatgaatactaatgaatacttcccaaaaccacatgaaggtatgtcaaggaaataaatttataggccagtattcttcacaaagataggtgcaaaattttttacaatgttagcaaactaagtccagcaatatataagaaggataatatattatgaatatgtcatattttttgtttttttgttttgttttttgttgtgttcttttttttttttttttttttttttttttgagacagagtctcgctctgtcacccaagctggagtgcagtggcgcaatctcggctcactgcaagctctgcctcccaggttcacgccattctcctgcctcagcctctcgagtagctggaactataggcgcccgccaccgggcccagctaattttttgtatttttagtagagacggggtttcaccgtgttagccaggatggtctcgatctcctgacctcgtgatccactcgccttggcctcccaaagtgctgggattacaggcgtgagccactgcgcccggcccatatttttattgtgtatgcatggttgctgtatcatccaaaagtaagtatagctaattgactagattaataaaataattttctactacaaattcattatcaatagaatcattatcctaatagaagcagaaaaagcatttgacaaaactcaatacttatttaagataaaatcatctcagcaaactaggattagaaacttttctcaataaagaatttctacacagaacttagaactatcctcctgtttaatgttgaattgaacatattcctcataaggttgctcatactcttaaaatttttattcatcattgtactttgtaattgacaagccaattccaaaatttttatggaatttcaaagcatttttgaaaatgatgagcaagttggagaatttacactttctgattttggcttatttcaagctatgctaatcagtacagtgtggttttggcataatgacaaatgtacagatcagtggaacagaacagagttcagaaatatacacacacaaatgtatgttcaattgatttttttttttttttgagacaaggtttcccttgtcacccaagctggagtagagtgacacagtcacggctcactgcagccccgacttcccaggctctggtgattctcccacctcagccttgcaagtagctaggactacaggtatgcaccaccatgcccagctaatttttaaaattttttgtagagatagggtttcaccatgttgcccagcctggtttgaaactcctgagctcaggtgatctttctgccttggcctcccaaagtgctgggattacaggcatgagccactgtgcctggtatgagtgcatctcaaaagcattatacaaagtgaaataagccagagaaaaaatatcatatacgatatttttccatttgcctttataaaatgcaaaactatagtgataaaaagcttattcattgttgttgtggaataagtagaagggaattacttcaaaatgagtacagggtgtttgtggtgatagaattattctatgttgtgattgtgttgttggtggttttctgcatttttcacataaattacattattgtatttattgtatgtaaattatacctctgtaaagctgactccaaaaaattttattttgattaatgggttaagcccctgattagacacaggtaaagagagaattcatcaactagatgagaaatgtgaagaaattcactaggttgcagagagacacagatgagaaatatgaaaatgaggttaaaagaggcagaagatagacaagttctaacatatatataattggagccctagaatgcaagaatagagacaataaatgagttaatatttaaagggaagtagctgagactgttccataattgataaaagacatgagtctagatatgtgaagcaaagtattatcaaggagtatacataaaaagaaattcattcatagacaggttgtttaaagatgcagaataccaaaggacatgatcttaaaaacagtcatgaaaaggcaaatcatttataaaatctcacaagtagactaaaaatagacgtctcaaacataatcatgggagcaaaagtctgtaaaataagaaaaagtaactattagcctaaaattgcatacctcagtgaatttatctttcagagcaaagcagtatgtttttgtaaaggctaaaataactagcttactgccaaaataacaactttacggatatctttacttaaataattgtctaaaagatatacttcagaagaaggaaagggaaagtagaggttgaagtttgaatggaaagcaaagaaattaaaaacgttttaataattctaagtctctgtgaaaaataagcatagtttataattttatgattgaaaataaaagagaataaaaactatatgaggcaagaataaatgattagaacagaagtaacatgtccttgtatttggttgagagtaatacaagctattcagattttttaagctaactttatgttaaatcatcaaggttaactgctaaaacaaaacctctaaagcactggcaggagagaaaacaaaacacagcaactccaaaacttcataataatgttaataaatatcaagacagagtaagaaaaaagcattttaaatatctgggaaaatgaataacacaaagtaagtgggtagaaacaagttcaaaatatgtaagtacttgatgtaactatttatagcttgaaacagttttatcaaatttaattaaaaataaaaccagggctgggtgcagtggctcacccctgtaatcccagcactttgggaggctgaggcaggtggatcacttgagggaaggagttcaagaccagcctgaccaacatggtgaaaacccacctctactacaaatccataaattagccaggtatggtaggacacacttgtaatcccagctacttgagaggctgaggcacgaaaattgcttgaactcaggaggtagagactgcagtgagccgagatcgtgccacttgcactccagcctgggcaacacagtgagactctgtctcaacaacaacaacaacaataataaaataattaaaaatacaactgtatgctattgttgagggaaatataaaatacaaggaagcacaaggaaatagaaagcttgaagatcaaagaatgacaaaaagacataatagtcaaataccaatctaaacaaagctaaggagttatattgatatttggaaaaaatagactttaagccaaaatgcattactagggataaatagggcttctacgtaatgctaaactatttaatttcccaggaagatattactgttctaaacaagaatacaataaaatatcctcagattatatgtcagcttgagagaacctcagagagatagtgacataaccacagcgagaaattgtgaaacagccactgttgtggaaaaatttaccgtgcccctctcaattgtaaggtcaagtaggtagaaggttattaaaaataccgaatatttgaaaagaattgtgaaaagctctacctaactctgcactgagtatttagaagataagtatttagaaacgaaatattcttttcacacacacatacagaatataattttaaaatactggttatattttaagtcataaaccatgtctcaggaactgttgtagaatgtggtactatacagtgcttactgcaaataatgtaattagtagttaatcaaaatatatttggaaaatataaatctttttttttttttttcctgaggcgtagtctcactctgtcgcccaggctgaagtgcagtggtgcaatctcagctcaatgcaacctccacctcctgggatcaagtgattctcctgcctcagcctcccgagtagctgggattacaggcgccggctgccatgcctgtctaattttttttttaatttttattagagatggagtctcactatgttggccgtgctggtctctaactcctgacctcaggtgatccgcctgtctcggcctcccaaggtgctgagattacaggcgtgagccaccgtgcccagccataaatcatttttaaataatcagtagacaaagcaagaattttaggaggcaggaaatttataaaaggaagtttaagagttcttagaacttcttattaagaactaatgtgaaaaattttggtatattgctgaaatagtactttctattaatatcaaattcttatatctcagtaaataaagaaaattaatgagtcactgtccactcaagaaattaaggaaataataatagatgaggtgaacgacaacaacaacaaaaaactaggaagaaggtataataagcactagaggaattaatgaactaagaggcaaatatatagtacacaagcttattggagccaaaggatattttttaatttgaaaagactcatttaaaatagacagatcttttgtgagatttgccactaataaagacacacataatacaaagaataaaaaagaagacataaattcagctatagcaaacatttaaaatatgatagaactgaaaataccttttgctactaatttaaaaaaataagtagacaaattattaggaaaaaattaaattcatagaaactgttcaattagaaaagtggaagacttaatagtcttataatcattaaataaattgacttagtggtttaaaatcttcccacaaagaaacactaggtccaggaaattttagtttctaaagatcagttgtactagatatttgaagaatagattgttctgatcacatactcttccagatagtaggaaaagagagaataacttctaatttattctgtgaattaacatagtcttaactaaagctagttgaggtttcaagaaaaatacatatattctgcatatcaatttaaaggctagaattgtgataatctaaagaagacagaaaataatagtgtgacgtaagaaataatttaggaatcttgtggtactcattgctgctgccttgtttcacacccatattctccctcacatagtcatttcagtacccttctatctggcctccttgcctttggcctggctgccactctaaatttcccttctcactgcttccaattttggtctttctagaaggaagagcctctaccatgcttaaaacctttcaccaactctctcttgtgagagctctgccctcaagatagtccagcttgaagactgagaaaatgagtaattatcattcagggtgaaggtgtgctcccttcccagtctggaaagtcagggaggaagacaagaatcaggattcaggagctaaggaaggcttactggaacaagtcaaccagagctgaatgttaaaagataagtggagtgagctaattaagtgggaaaaggtaaattgcaggtacagtgactaaaatgagaaagccattgagatcctgtcaagctggtgtgtgtaaggaaatgtgaatcttcagttgttagaaaggcacaaaagtggccaggccaggagataaggtcagagggagttaggtcaaggccattcgacaggttgagaaatcagtgctacatactctggataggatgttgctgagaagttttaagatagatttgcattttagatacacctggtggctgagtgaaaaaagttataaattttatgaatagtgagaggaaaagataaagaggatactcatttccatttacaacattggaaataagtaggcatgaagagtagaggatttattcaataaatatttatcaacttgttaattgattagaccatgtctttgtaatgtgtgtctaacaatgtctggcgtgtaagagtccacaaaataaatcattggttgtactattgtgtgaataaatgaatatgtctttctatgtgttacatggaaaggtgaaggaatagaatttcactgccacttatggccgtttctggcatatagccaaagatgagtttattctatattctgtgatatgacatgtcttgtaaccagatcttttaattataatttaatgtgatgaatgaaataatgccaatatacttccccctcccaattgggaagagacaaggggcatgaataaggactcagggaccgcttgctggagaaagtgaggcctgaactgaatgttgaataggaattagtgaaattactctattgatgaagtgactgacccaacttgaggtagtgattatatgcattagaagcagattccatatggaaaagggctcagttttattcatgttgaatgtaaagtcattgtgaaataaacaatatcaacaagaaattggatgtatatatgcgaatctgaaaaagcatttcctccaggtagcctcagtgccagcaatgcgtcttaaatgtattttttctgaattaaacatatctctcactgtgagaatttatttattcaccggactctaggacatacttccaaatccttcattccttattctcttctctcatgtttctttctccttgtatctttccttaacaatgtatttttatttttctacattttcctcatcttcgtatcatgacaaagctcaaacagcagatgaggtgatgtatatggcatgtatttttgggagataggaaaaagacttacaactggaatgacatgatagagaatgcactaattaagtttaatctgacaataaaagcataaaaatagatgagaagaggtgatcagaactccagagattaattagaattaacaatgacttaagtaaattgaagaagcatagtcaataataaaagtagtatatggcagtgcacatacaggggaaaaagtaaataaacagtatttgaatattgggctatgaatgaggacagaagcagcagccctgagtcacagaagattaaaagctcagcagcgggcagctatcacatttgccaagcttttaaaaagttggttttgacagcatatgcaacaacaacaacaaaaaaatctaattaagaatatacaatttggatatcagaaagtagctcctaagtaagaatttaactatacccgtaggataatgctgtagccaaatggttggggaggagaaaacaaagacgacttaagcattaagaagggctaaacagattagctctaaatggcctaaaaaaattgatattgacttagtagtgaccgttagatatgtgaaagagctatttcagtatacctggaaggtaaaacaaaaacaaatgagcttacactagcttggggatttctgtcagataataattttctgaaagagatgcttgtgaaatattggaattgatgggaaaagttgtacaaaaattcctgatctttttttagaaaggatatactctcatctatttggttgttcattcagcagacatttattgaacacgcctacactttcagatactttttgaaatggaaaagataatactgcacacaagaaagaattcctgacctcataaatctcaaggtctagtacatgtatgtgatatttacattattgtggacatattaagatccatttttctagttaatgatagaatgattcctacaaaaatggcaaaattgaggcccaattcgtagcaattacttgggcagtgtgtccttagcaaaggatctctgataatttgctaaactattggaaaataaataagggatagagagaggtatagaatgtaagtgaggcataggaaaccactagttgcagatactggttaggccactcatataactttacaaccattcctattttgccattaatttttattattgctatgcagtcaggtgaatctaatgaaattattttacactggaagaacaagttactattctcactgctcactgtaattgcttgagtaaaacgtaaaatttcagtgtttccaatactgagagtgtatcagaaccatttgattaagtgaagatgttacttcctgattatttaataatacagtgtagttggaaacttgtcattaatgttgtcacatgtctaaaaaataattttccaagtgcagctcggtattagaggtgactaaatatcacattataattgagatgagaactatatcattgtattgctgaattggtgatgtcaggccattctatttcacagccccaagggaccatataaaaggcatttgcaagcaagatgtaagtacagcatcagcataattgtagccaaatagatctacagaaagagtttgtgtttgggacccaaaggtccagctgtttcttaaaggattatcaggatttaatgggaagcacagatggaaccaatactattgtctagagtattctaggggagaggctaatatgtgaaaggtgatcagtggcaggctgattgaaacaccaaacaaaacctttttgttaaaatgaaaaaaaaaaagtgaactggcactacccaataacacactgattcagagaaaatagtccccagtgcttcgttgcagccattgtagagatggtcatatgtggtatgcagctgtaaatggttctttttcaattattatagattgagctcattattcagtgtgtttaggtagttttactggatatggaccattgcaatcatataagctctccattgtgtagctactaatttagagtgctaccatcagccaaccataggacccaggatttctgggaatgaatgactcatgttgaaaaccagattctgaaaatataggttcagatttattatttaagggtttagatatatttaaaattctgtgagtcccttgcttattgaaagtgctgtagggtttattaagtcattgaaaacattgttttcttttaggatcagcttatccgaaaagtgctttttaaaaaacgcaatgctgttgtttcttttctttatttagtataatatcgtgcgtgtgtatcatactatatgacaccgtatacacatatatttatatatatgctttcatgcctgtatatatacacaaacttccaaaggttggacatcagcgtgcatttcaggagctccagtaattttaatcataaattattttgctttatgttcacaaaattctgccttgaaaatacaagttttgctccttagtgacgacacatgtaggcccattcaatttttttgatgttaagtggtattactgtgactagtgcatatttataatacgtaggaagccatttagatggcatagtgctgtatcattgaatctcagtacaaaatatacagaatctcttaacataaaccctatgccaaatagtaaaataaatctttagtagcaaactgagtttacaataatccatgtataacttgacactacaccacaccagaggctgtttttcttaaataaagactgcctgtcaacagaaaccttttttaaattatccctggaatttgttctattggaaacgtacctggacgtagtgaaccatgttttatttactgttgttgtctcctccagttttcaatggaaaatatatctattttcacatattttacatcctatatcaataataactttcaagaggcatagtcttgatgattgctatcagaatttccaaaaaaggaaaaagaatttccttttttgctatggccctgttcataaacaactgaacaggtaattactgcaatgtaataggatatagaaaggatatgtcatatgcttttcttaaaagagaatttgtatttctgtgaaagcaattgatatttgaaccatttcctagttttcttttgaataattaaaatcagtttgagagcccagtatttgtgaagtttgaatggcattagagagtcgccaattggcattgcttggtagttctactatttgtttcagtttttagttggggaatatttttgtattctgggagaagctgttctaaaatatgtcatccatttcacatttcccttcttaagctgatatttttatgcaatacaaaaataaataaataaaacacttactggggctacaggatggtcataacattggaaaattggccctcagccaaattaaccaggaagtggcaaggatatagacaattttttttcattctgaatttaatatctggctcattctttagcataaattttgcagtaaattgagttatattcattcaaaagaacctgatactatttcagcattctctttttatagactgctctgttctacaaatgtttgctctctaattatagctcacttcattacctggattaaagaattagaaattataccagggacttatacaatatggtaaatgaatttcatgcttaaagggaaattaattctgtgcctgttgtatggaagattgttgtgttttattgaatttttatttaggagacatgaagactctaagttggaataggctcgtgcattactgcagctgatagtcaataagtgaatacttgattgtgttaattagacacaatatctcctactttatcaactatatcagatgttggtattgaataattacaatgaagtcacatggtaaatcagtagtttcaaattattttgataatacctcatggggtccatggagtccctccagggggctgctgggatgggatcatggtattgagaaggagaaccaggtcattgtggatgacctgagcttcccgtgctaagctttcataattagggttctgtattagatttttggggggggggacaaaaaggatttttagagctagaaaaaatatgagaaaccatgtaaggttcttactagactaacatactttaagaagtgaataatctgggcatttagaacctttggataatgtatttcactacattatttttacttgcttattcaaatgtatagagacacacaattaaaattttaagttgccagaattctcaggtcctattttgtcttcacctgttgatttaaggggttatctttatgtttgagctcttttctggttttcagagagtatctttatgtggaaaaaccagaactttgctgtttactatacttaggatttctctaaccgtgagattataatttctctacccttttctctgtcttctaaagttaaagcaggagaatagaaagaagaaacagaagaaaacaaagaaagggagtagaagaaaaaaacagcaggagagaaaagaaggccttcttttagggttgcctattttctgtcactacaacctttgactactcactgactcagttcactatagacaactttgagtagcttcaagacctatgaagtgtgacatgatgctaagttaatggttgtctttactatgagaaatagtcaaggaagatgataatttcaatacatattttacacaagtacataaattatttgatactgcatctctaagtatttttatagcaatatgctcagcccacacttttccattctgataaattaatattaaaataacaatgcaaaaagaacatttagcagccatgcttatggtaaatgctttcatttctattttcaaaattaaaaatatagaatgaaggttgacattaagccagttgcacagttaggaagtcatgtaatttaaatgacagatgagatcacccgcagttgggaagcctttaccatcactttaagcactacaggatagctgtaaggaagagttttgaacttacacttttgaatttgcagttctttgtatcaggatcatttattaaatgtttttaaagtacatttttctataggcctatatttccagacacaccaaaacctcatgttctttaaaaagtatggaaatgtgtaattaaaagaactgaacaaatagcaagtccttaaaggaaaacctgcagtttgtcatttttttgtaggacagatatgtgagagatcctaaagagaagtgagcaaagcaatactaggaagttccagcagatctagtagctgcctttatgtaagacaatagatcttgtgaatatttctctttctctccaggcagctagctagtctggttaaccaaaattgttgagaaattgttctgtggttgagaacaaaatgctgaattaaactgttcccagcacaataattgtgtgattatagcatttatgttgctggccaaaggaaccgtcattaggtttggaagacttaccaaaaccacaagtacaaaaaaatatgcaaatcacatgtaaattgctgtttaatacctatagtggcttagaaatggaactaagagtagagcacatttctagttaaaagagagaaacctggaaatctttattgtatatttaatgtgatactgaaatgaggaagatgctaaaatgcattatctttaggtttttcccttctctaccctactcatagtctcaatcatgtatgtgtctctcgacatctgtctttcccctttctcccatccccagtctcatcttttctaacttcctttgttaacttcaatatttttaactctatgggcttgtctgaaaactttttctttatttatttttttccattctactcaaaattatgtggtgaaaagattttatcaaccaatggggtgttagggttagtgcagaggatgattgattaagaaaactgtcagcagatgcatacaaaatgtcaagtaaacactatttgctaataaaattaaaatactattatttcctcacattttgaaatagctttctattgctgatcaatgtgtaaattgaaacgttgagttttttctcctgttaaatctttgcaggtgaaccatttacatactaaaggtttcctgtgatgaggatcaggtcttcctaaattcatgtgtggtattgagaaccacatgtgacctttaggagtagtagctatgtatgcaatattaatcatgttttagattaataaatgaaaaacagtagttttaaaagatgaatgatccagtaagaatgagtgatacactgacatttttccagatcagttatgaactatgagatagcattaattcaagaacatgaaccgaagttttcaccagttttctttttgaaattctgatgcattccatttcattttttaaaaaatataaaatggaatgtactgaagaataatcccactggcagtgtggacaatcagacacaagcagaataactaaaaagctaagaaatctctattatgtatttccttcttctggatttagaaatatgtttaacactcagatttacaccatcattagggcttagttacttgcttatcacattaattacttgcatatcacattggagatcttactccctttataaatttgtgtaaatgctatcacaataattgtaaaaaagctagtcattacaaactattttgtgttgatataaatgtggttttaatatacattaaaatatgcaataatttttgcctttatgatacatatttacattcctttcaaaagtgctcaagaagtcaggtgacaaatgggaactgaaaacgttagagatgttggttttatcaaaattatattcaactacttaagtagctttttctttattttacaagatggagtcagctttcatcttatttcctgctaatatcaatttcattgctgttttattttcaatttttgaaaaacatttttatacatgtatgtattttttcaaacatgtaatattttgaattcttttctttgttatttcaatgaagaagatattatacaaagagcttaagatttatgttgagaatttaaaagctttgtgtgtgatgttaatttttttaaaaaacatagtggcttcaaatttattcttgattgtttttcccaatagtgcaatcttcaaactgtacaggttttgaattgctaaccactacatgatattaaataacctctaattcctgccaaccacccacacattaatgagaacaaacacagcaattttaatgatcccacttgtcaatggtaaagcatatttagaaacaaaggatcatatttcaataatcaaattgtatttttaatggaaacttagactcaattcacaagtaaatgtttcagcctcttctaaaatatacctcataaacctaaagttaaaggcaaaaccacttattcagaaaatgaaattgttcattttggttcattttaaaatatgaagatttcccttttcatctaagactaaatactatcatcatatttttgtacagcactaaatctctgaaatctgttcgatcttgctttatggcttagtgtgtgaacaatttttataaatgttctgtgggttttgaaaagaatttgtattctgtaattattggatgcagaattctacatatatccattagagtaagcttgctaattatgttgtagaaattgcctatatcacctaaattttttttttttgagctatcagtaattaagaaagttgtgctaaaatgttccattataatgggggattgctaatttctccttgtagttctctaaatttttcatcataaattgtgaggctattttactggatggatataacaaaaattattatgtcttcctgttaattgaaactttagtgttagttcattataaactatttcatgttcatataaatgttttaaaatacattaaaatatacaattataatttttgcctttgttatgcatatttggattcttttgaaaagtgctgaagcagtaataactttatattatttctataacactaaagtttgaattaacagaaagacataataattcttaagttataacttataatagaagctccgtatccacaattatgctttgtgtgttaaagtctattttgtctaattctaatatacatactttagacttgtttacttttttggttaatatttgcctgatagatgttttttcatctttttcaaccttttttgttattatgatttaagtatatctcttgtaaactatagctggatttttaaaaatattcaatctcttggtctctgttttttaactgatgagcttactccacttatatttattgtaattaaacttaggtctgtcatttaattcatactttctgtgtgtatcaccttttgtgtctattttcttttatttttatgtattaatttttagcattctttatattttctatttatcagtttgggtattatctactatctttctattttttatgggttttctttgaaaatttaacatttctacttatgctcagagagtctaaaattaatgaatactgtattgctcctcctgagttttaaaataaccatagcactccctagctatggctactcctctcttgttttacatgctaatattgttgaattgagctcattttttcttcaaatattagacactagctaatacaaagtatatttgtatttagtcacatgttcaccagttttttcactcactattctatttgcatcttacctatttcttctaggttcccttttcttgtttctgaaacacatcctttagaaatttctttagtgaaagaatttgtgatagactattttttatggaaaatcactggcctttcttttggatttattcttgaaagtgtttactggaaacatatttttgtcagtttatttttttccattgacgtctaatactactgttgtgatatttattgttaaactaattatcacacctaggttgatgacttctagctgactgcttttaaggtttatctttgcctttcatagtctttagttttataacagagtattgactgaccttttcctctcatttgtcctgcttgtgtaaattttacccattacatttatgggcctatatctttcaaattcagaaaagttatcagtcattaatttttagaatattgccttcctccatttaaaaaaattttttttctcctaaaatttttgaccaagcatttgttaaaccatcttattttagactctatgacacttaacctctcttttatattttccatctttctgtctctgtggactgaaatctagttcatttctttggatttcttttatggttagtgacatttctcatcacgtctaacttgctgtctatttgatgagttttaaatttctgttattatatttttcttttttttttttttttttttttgagacaaggtctcactctgtcacccaggctgaagtgcagtggcatgatctcagcttactgcagcctccacctcctgggttcaaggtattctcatgcctcagcctcccaagtagctgggattacagacatatgccaccacacctggctaatttttgtatctttagtagagacaggttgtcgctgtgttgcccaggctgctctagaactcctgagctcaagcgatgtgcccacctcagcctcccaaagtgatgggattacaggcatgagccaccatgcccggcctgttattatatttttcatttctcaaagttcttttcaattatttttcaaatcttcctgaacttctttcaagtttttttttacttgttactaatttttattgcaacctttttgtaagcaaatattttaagcatattattttatttttttatctgattatccactaccttgatatctttgggtatctaaatctgctgttttccttattttgctttacacaagctgaatcattcctcatgtattaaatatttgttaaatttaaattgtgtattaatgtttggctgaacttcatctgtgggaatcagagtatctaaattgatgctccttaaatactgaactgggttattctacaagtttctagtaggcagtacaaactaggaaacacttatttctaattttggagattgagtttttactgaccatttaggaagttttggtttgaactccagacctaagttaggtaaagtctgtgtgattgagttatagtagtacattatttttattagcattttattgcaatggaaggtagccttcatgaaatcaaggcttttattgttttattcactatagtatttcaagtagttagaactatatctgatacatcataggcaattaataaatatttgtcaaagaatcatcatcatcagcagcagcagcagcgtcagtggtattccaccaaaagcattgtagaaatgtcctggtatcctcaccttaattgccagattttctttttaaactaatctttcaccaaaggaatatcccctttgattgtcctgggttagtgtgagagactgaggtttggagggacccaaggcatcatcttaggttctaagtgctgtctacatttaccccattcttccaaactactttcgatttactagatttctctttctcctacctccaactttcttggaggctctgcatagaaaaagtttattggttattatgcatccaggatctacttgtattatagcagaaaagattcctaggatatctaatgtttaatagttttgttgtaatcattatccatactttagaagaatttacatgctgaaataattattttcatgctgtgtcaaggtttttgtcatttaaaattttttatacaagttataatttattttgatacttaggattaatttataattataatttattttgatacgtaagatttatttataagtattttatcctttgcttgagtcaaagtatagtgattaaaagcctagtttgtaggtaggctggcctggatttgaattctagctcttttatttgctatctgtttgactttaggcttccctgtttctttatctgtaaaataggggtgatgaaaatatttatcttatagggtttttgtgagtttcaaagagtaaagatagaattgtgcaaaggtcaacatagaaaaaatgcattataaaagaagctgagggaaacagaataggtattaacattaacaactgcccatcaaagtgcctttggtagagggcaagtggatggaaagaattcatgttgtccgtctatgttctcttttcatcccataaaatgtctatataaaattagaattgccacaattttgatgacaaagaaaaattatttctaatcaagaaagcagtctatagatttagtaaggtacccatggtattacataattcatctttatttaaatattgtcattatgtgtaggcaggttacagtgctttgtgctggaaagtataaagtaaatttagcaaagtagtaaaattagccatactttgctcagatttttgcaagtaatgtgctattctttattattgggtatatttacaatggtagattgtataatatttcttcttgactagaagattaaaaaactcatgattacataaatgacactatgttcaatgggttgtccaattacaaaaatatttcacattttcagctcaagaaacatctaccatggcctttttggtaatttcacacatgttttattttcagtgacaagtgttctagtgagtggcaaactgctagtgtgtccttagctatggtatagttagacaagcatctcattgctgtgttccatcagatactgtgagacagcatccattattactcaaagagcatgatttttcacatcttaaggaatggaactagtcattaacttggccctaatatagttgaattgggggagctgtattgaaatattatctttgtttttgtttgcgggaacgcttcttaccactaatgtaacattttgcattactgactcagtatactctgcatgctacaaacaaataaatatccaatcactagccattcacaccaatctagcacctgctagctaaaaaatagaaattactcactgggaaatttgaacaaaagaaatataagcaggataatcacatttaccttctgtaacaaaataagaataatgcacagagtttaaggatgcagctattgatttgaatttttaataaaaaggttttgttttgctttagttttgtggggttgtttccacatatacggatcatgtctgcagctaaagcttcatatttcatgtattgctatatgttccagttatgttactttatattgtcctggtaactgaggtagcaaaaagttgaaatgtgtttaatggcacacagtgtctcaatttgaacttattttctaattatttctgatttgctaataagcttacattcatttcatatgagtaatcaacgtttgttttttatcttaaagaacacgtaaatgcagttcttgggttatttcattaaggacacataagtttttatttctctgcatctaatgaaacacacaaaacctaactgtgggcatcgtcaaggctgaaactaggatctgaggagcagaatggaaagggtggggggaaattgaatcaattattttccatagtttaaggcattgctctgaggaaaagtcatgaatcctgaatgaaaatggaataaagcctaagatccattgtataatatgaatgttgtaataagctagttgctactataagaagaaattaaagctaaaacataagacttttataatagtgaatatctttttaaataatcacttcagtgaagaaataatgagcatttattatgtttgaggcattaagctaggtattgtggataccaatatgagttagctatgcccttactcttcaggcagcttagccatggagacagacacaaataatgtcaacctaatggtatagttgtatggaggacacacaggagagggaaacattgttgaacacagtaagaacactgttaacttaggtttttccgcatctcctctcccaaataacggagagaaaagtgccataattcaaggcattactttacatagttcattacactacatagttcagaggtttattgtctgacttcctccatgtcttcaaatgtcactgtgtcgtggattccacattgaaacttgcagtctctgccccggtattccttttcttctgccctagcttcgctgtttcacagcacttgccttattcgttgcaacagccctagagactataacaatacctggcaccaagtgagcgctcaatgaatgagtgtattttgcttgaagagtttggatagtcttcataaagacagcgacacttaagccgggttttgaggaaaaacttgttcttgagtataaagtgtagcttttttaggggttcatggataaaaaatattcagttattcatttgcctgtttttatttgtgtatatttagggtatacaacatgatattttgatgtacgtatacgtagtgaaatgattattgcagtcaagtaaattaacatgtccatcacctcacataattacttttttttgtattaagagcacctagaatctactctttaagcaaattttcagtatataattttattaattatcgctctcatgctgtacattagatctctagatttgttcatcctatataactgcaatttagtcccctttgacctacatctccccattttcaccatccctgcattaatggctgtgctaatttacattcctgccaatagcatacagggttcccttttctctatacgcttgccaacatttatctcctgtctttttgataatagccatcctaatagatatgacgtggtatttcattgtagctttgatttgcatttcccagatgattgataggtattaccatacctattggccatttttatgttttctttgggaaaatgtctgttcaggtcctttgttgatttttgtagttgggttccttatatggtttggacattaaccccatagttcacaaatattttctcccaatacataggctatcttttcattttgttgattatttcctttgctgtgcagaactttttagtttgaagtagtccacttgtttatttttgcttttgctgcctgagcttttggtatgatattaaaaaaatcattgccaaggccagtctcaagaagctattttcctctaggatttttattgtttcaggtcttacatttaagtatttaatccattttcagttgactttctctgtgtgttttgtatggcttggggtcacattgtagtcttttgcatgtagttatccagttttcccagcaccatttattgaagagactatcctttccacattgtgtgatcttggtgcctttgttgaaaattagttgaccttgtaggcttggggttatttctgggctaagtcaggtgaagttttcagctacactgtgcagtctgcactctgaggacggatagaagaataaaaggtctcttggccagaaaaaaattgtaagtcttttggggaagagcaaaccaacataggcaagatattaaaaatgttaaagatataataatcaaaagctcattgcacagaatacatagtagtgatgtgggaaatatcagcaagaaacaagtcaacgtcaagatatttgggaatgatttcaagagactttgaagtaaatgtgaatatcacatactttttatgaaaattagcctgttggagtgaaacatttacattttatgataaatctttcttcagtcaaatatcaaaaaaatttttctgttttctaccaaaataggcaaagccgactaacaatttaagatcttcaggatagggtgtattaagaaattaacaccaaatggcaattactatgttaaatatccttttattttatgccaggtactatgtcgttctattgcatctctatttttctgctcaattttcagatggttaaagtaatatatagtagtatatatattacatagtagtatatatagtagtatatatagagaaattttgaaaaatattttgtgcagaaaacaaaaagcaaaataagacacaatataaagatgaaaattaaaatcagtaaaaatgcgacccttggtataaaaatctcttaagacataatagaattttagctttcaaaaattattcctttttggctgggtgcggtggctcatgcctgtaatcccagcactttgggaggccaaggagggtggatcatctgaggtaaagagttcgagatcagcttggccaacatggtgaaaccccgtctctactaaaaatacaaaacttagccggaagcggtggtgtgtgcctgtgatcccagctactctggaggctgaggaaggagaattgcttgaacccgggaggcggaggttgcagagagccgagatcgtgctgatgcactccagcctgggtgacaacagcgaaactccgtctcaaaaaaaaaaaaaaaaaattcctttttatggtaagaaaatatttaggaattaatttcgttagtgtttctgtgctctttatctgaatcagcatttttatatcaggaaattactgtattttgatttatactttgctcagaataatcaaagaatttgtggctatgtgatcatgtgtaagttcccaaaactatttgttttcttatcagttttcctcattcataaaattggaaataacacctgacctactgatttctaggaggctggataaagtatacataaactagtgtatgtgacagccctttataaaaatgcaaaacattattccaaaacatgcctatttcaaagtacactcaatcctgcttcaggtattagtgaagttatatatttttgtaagttgttttttacttgctatggtttttttttaaattgagatgtaattcagatgccataaaacttacccttttaaagtatataattcagtgctttttggtatattcacaatggtttgcaaccatcactactaattccagaacattttcatcactcccaaaagaaaccttatacccattacctgtgtccccagttcatccctcccgacatttggtaatttttgagatttttttcaaagaacttatgttgaactgaaattcaacataagaatactgccatttttattaattttatattacatggggaaaaataactgataatctaatagaaaccattgggcaaagcatcacaaattagaaagtaatagggaattttattgttttctaatcatggatacctaagaaatataattgaaaactatattatatttcatgttggtcactatattttatgttctcattcattttcttgtaaatgaccattaatgtagtaatgcatgatataaagtaagattgtactagcagtatttgcaaatcttgattctgttcacattaacagacaagcacattcaaatgaccatgctgtattgtggtcaagaactacaataagtaatacaaatagtcacacacgctttaggaaacaagtagaattgtataataaagattttgatttgatcaagcaccagctgtgtaaaataatactttaagaaatagctatatattagaataataacccaattttaaataatgaattatctaagatattttaataattaccatttgaattcatttattcagctcaaaacaatttttagcaaatgaaatagctgtgtttctcccatatcttttcaccattttcttattttacaccatgtttttgcaacccttaagtttctatgattagcaacttttaatatggagattatacctgaagtcaacaaatatattttgtttaagcatgtattgtatttataatacatgtcatcattttttgaaatttgatatgaatttaatgtatattaataagaactaatgctttgtaagaacatgatgcttcagatttgaaaataaagtttactataaaacaacaagaatttttaagataaacctgcatagcattaagaatgaaattttattgtgttaaagtaacagaggtcttaattctatatcctttgaaagtggttgtatcctagtaatattgccaacaataaacacatcatgcaaaagtaaaaatgcagtagtgaaatgagccattgaaagaaagagtcagtgaccatataatatttcagtttctattatatctagtagcaatctggttaaaaagaaatgacagttgccctgaaggaaataaagtggaggtattattgtagtagtagtttggagagaaaattgcactgtgtcttgactggattatttctctatccttgcaaactatcttcacctctctgtggtgctgcttcttgccttctttatacaaattgagtttgtatcatataaactcatagggcccaggggccctttggtgacagggaggaggaggaagaggggaattagaaaaagaaaatgtgacaggcagttttgaaaagaaaagcaattttccttgtaggtctgttcctaaataggagttcttcaatgcaatattttgcttctgcagagcagtcagtcagaatcaagtgcatgcttgtgctgttttctggggcttggcactgacaggtttcatttaggaggggtaggaatacagggggattggatgtggggaagttagtattttggctatatcagccctggaggcagagttagcacttgcaatgggacaaaagtatttgtagtcatcggataactttgcagtcagcttcaatagcatcactccttttttttttgttttgttttttactttttttttccactttggcagccaagctcttagtagaaccatctgtctttctattagtatttttgaggcctgttttgaagccactttgcttggcaaagtcactttcatccttggaaacgatttttaaaaaaagttctgtggctttttgccgaagaagagtactatgtaaaaaatccacatggctgttcatttttgttctaaaagaatatggctactttgtctttgtcttgaatcaaatgaaattagaggtgatacaactccaatgtgactgttgggaagttagaggcagggattgcaattttagcaatgtttttatgtgcctatattcctcaatgagatgttctttagtcttcctagtagattaattggaagataaattgactcctttatttttaatttttcctaaagaccattgcattgagtaggataaactgacaaattgactttcttttatatgaaatgaaaaatcagactattagcggtcattgaagatcccatgtctctttttgctaatggtggaaagttactttgttatcctggttactccagtttgggtaattatattctgcctacctaaacccctcttgtaatctcatttggatattttattcttcatttgctcagaaactgctgtgtattgttgctgtgtgcttctaaacagctgctatgctccccactgaaggtgactgaatttcagctgtaggtgaactgatccctaaggatgatgtgtatttgaacactgtagcactcatcagactaaactcttgaggaacatttgaaaaagttttagatgttacagtttatttgtaattgtgctgatataaaccatagagctgcctttcattttaacatttgtgtatgtaatttaaacaaatatcctaccataagtttgtgctgtttgagatttcatacaaactcactctcataagacctgttcctttagatcatggagttcttccagttctttgattcctgtgtttttcccagtctggtgatgccatccaggcctctcaccctgtttttaagcccaaagcctattgttcatcaaaagcaatttttatttcctcataacttgtctttgctgaagtcctccagtctgcttctcttcccctgaatgctggagttcatcttctctgatgctcagtcacagtgattaggcacgttttgagaaaaatcacagaaaagggagatctgataatattacaattcatgtggtctcacctaaggtcttggcatcttctatcactctttttaatgtctgtggttttgcttgctctttcatttctcacaataaccatcgagaacttcctggaaccttgttccagttttcttcctcaattccaatctctctaattttctggatatgagcttgccttatcattgagaaaatttcttctgtcaggcctgattttccttaccttcccctttccctacccataaagcacatctgccttcatccatttatatagctccattcctcagggcccagaggatgagatgccactctcattctaaactgattgctccacctctgccttgtcttctagcctcctccggaattttggttagtttctctctttcctacatttgaaactctccatttctatttgcccctttcagccaataaatgtgctcagaaccctgctacctgaaaaaaagcctttgcttcactttacatctttctacagctgctattaatgtctctcctcacctctcatcaacttcctctgaagaatagtctacatttgctttctccttttcgttgcctgtcattcagtcctcacccttttgcaatatgatttctaccctctgttctaatggaagtggtgttattataaattcagcttctaatcattcccagagatgttatttttgtctctagaatactttctgctttttgttttgtttgtttttcacaattagtttactccctcaatcttgaaattcccttggcttttgttataccatactcttcatgattttattaatttttgtctaactttaattttatctgccgataggcacctttcctccacgttttgttgaactgttgttggaacccagatggtgttaagctgttcccctttttccttcagatcttttctagattgtctaggccattctcattaacttctggcttcccatagcgtggcctctgaagatctcctccctcagcttcggactggagtgtccatctgctggaaaaataactgcaatgcaacatcattcagccacctcagccacgtcatatccaaaaccgtagccatcacttttgcatgaaaattatcacttctactctgaatttttagttgtttgatgccactataagtagagtgacatcaagtaaacattatctttgattttatcattttttcatctatgagtactgcaattttttttcttaaatatttcttttcttttttttttctcctcatccattactcttctgctgatctagccctcataatctgttcccttatattaacttcccacttggtctctacgctgggtctctccagtctttttccatatccaccagagtattccactgaccctaatttaatccctccgtgattccccagagcctacaggggaaatctctagtttcttaccctgatgcatagactgattcaggcagacctctcaccactgctttcttcatattttttgccattcctagctgctggtagtgtctccctcacatgatgtttttttcttgcccctgttccttttcttatgtctctgtctctgctccttacctattcaggccctatacctgccactcctgctttcacagggcctttagtgacttctcctggctgtgttaggagcctctcttctgtacttccatagtatcctatacaagtctgtattattgaattaacagtagtacattataattatctgtctgtttgccccaccagattcagagctcctagagagcatccatgtatgtgaattcatcttttaatccctagttaccacagactgcatattctacttagcagatgttgattgaataaatagggacatgtaatgaaattccgattaaataatcttaagaatctacttaatacattaatttcttgaagccattgaatgtttcaacaatagaacatttacataaaatataaaatatttaactatgagtaattgataggtatttacttgttcttcataaatgggataatataagtgatttgtgttggattcataacatcttagagactatgtagtatcttgaggtagacacataaaaagcattaagacggggcttcttaaaagtttttaaaatataggaagtagcctcttatgtgtattatgaattatttaacctgcgaataacatgccccctagcttttaaaaatttatgacagaagtattttgttgaaacttaataaatgtcacacattttcaactttaatgagtggtttaaagggaatttcatacattcagtgaaaaagaaagaaattaatagtgatcaggatttggaaatattcaaaactagaaaatatatagaatgaattactaaccctataccaagttagttttagaatctacccagaaaacatatcgttttgatattgtgtgtccttttctcccaaatgttggctaaatttcagcatcagtgcagtgaaaatccatcaagatataggaataatacagtcactgctcattgtttatatgtgttatggtctataaagttgctatgaacactgaattagtgaatgctgaacaattgctcttaaaggaagtatggttagattcttgcgagcttccggtcacaactttttcttcagctaatcaatatataactttgttttgtgtgtgtttttgtttaaaaataccttgtttaatatttattactgattcattaacattgaattcgcagccaacagcaggatatctcatgcctgagcaaagcttatctaatacatagtcttctgcgtaagtcacaccacagccctcttgcctcataaacactagacagcacttaagcattatgcttgggagctttttaaacaaaaaattaccaacaaaattgttacctgctttgtgcacgtctgcaaatgaccaggaaagtggcattattaaaattgggtacgagtaaatttcagccaataggcaaatttgcaaatacagaatccacgaataatcaggatcaacgatattttgagatgtgtttttagtcgctcacatagattaaccacacattttggattacatttattttactgtttactgtattctttttattaatagtacagtactctacagtctgttctatgatggtctaataaaaaccaatcactgggactgtgaaattaggtttatttttcatttagctcccttttttccaccttgtagttcctctttcagttcctttatctcctacttcccctcactagattgagacaggagatgcagttccagcgtaagtttggttttagctaaatatgggatcttgaacaatttattgggccaagctaggtcttatttcctcattagcatgttggctatgttgttgctgataatctctagggtctttctcagctttaaatttcgatgtcactctttacaagtggatcttgaaaaatttagacactaaaacaaattataatactaaaacaaaatgcattttcataatctgatctataaaagaccgaagtttagaatgcacagatttaataaaagctccagaattcattgcaatttattccttaaaatactaaaacttttatctgaaagaatattataaacgattaaagtataaattatctagataaaaaccaccataacaagaatgctttatatacaaataataaccaattaacaatatagccaataaaactttccctatataatgctttgtaatttggtgtcattgctgaaaacagatctaccattcacatattgcttttctctctccctctctctgccgcccccaccaccacacacacattgccttctctttcaccctccctctcctccccttctccctctctcagtcctcgctgccccccacactcaccaaccaaaatctcagaaacagctcagaggtttactgtggaagattaaataaaggagaaattgaaggtggtgggcttttaaagtgagaaatgatgagaactgtaagaatcgtaagaacgctaggaatgtgtaatgcgactgggaaaacaagaaaacagatctgaaagacaattcagaggtgctgttaggattagtgactgaataaatatgtaattatctttgtgtatttgtttcttttacttttttcaccgccatcatccctactataatcaaggcttcatagatgtgggattttagttttcttgttcactattgcatctctactgcctagctcagtttcttgcacatagtagatatttattaaatattttacaaataactgttcaatgtgtgggaagactagtggaggagaataaactgtcagaaaggtaattttaaacatgatcccaaattaccatccatatatccatccatcaataaacactaaccaataatcattttcaccagcgagatcttgcttaaatatttgttcaaaaaaagtattttagttagtgacaaatctctagttaataatgtgacaaggctgcagaaatggccacattaggttgtatttctaaaaattccttttcggctcaaacaagatagtgattctattgtgctggattatttattaactaatgtgaaccccatactctgagagtgggaccagcaaattagagtatattccaaagatgacaaccaaaatggagaccctgtggtctaaggagtccttcagttgcttcaaaagggatagatgcaggcaaaaatgttgtacagggaatctgtagcaggattcaagagactgaattctagacccagttctaactaattctgtggctagtcagttatcttttggcactacttacctcttctattaaaaaaaaaaaaagagtaaagttttagctattctgtaatctttcttccaggtcgattactgtattcaataatttaaaaattcaatattatgtgtgaacatgagaatttgtcctcaaataatgaagagctatttacatataaaatgatacaggtttagttagttttgttttagatggtagaattagtcccaacaagtaggatttgcagagggcgatttcagttccttctatgggataattttttagccatttcattagtgcaataagaaaaaggcttatcatgcaaagtagtgatattttcgtcactgccaaggatatcatttcgggaaactattcgtcgtgttagagagtcgacttaataatacctttcagctctaggattttctagttctgctgtttaaggtagtcccaaagcatatcctcaagcccagtatcccagcaagcttctatgccagtcttttgaattgaataaatgattttcttttatcatgaaataaggagggtgggaagaagcatggagcatcgaaacttcttctctttgattcgctctatcacgttcagcaggttcaaggtcagctgccgccattaatgattcccgtattccctcctgatcaacggacactggctgcagctgcccagcaaggattcctcctccctccaggcttcagctataaggctggatgtagtaagtactgttgatttttcatctgggagtgggtggagggcaaagctttaaattaggcaatttaatattcctgccacaccaagaaatgagatcacccatatagcatttttattttaaagaggaaacacacagaatgtgtggagaagtgtgttagtacttaaaggacttagattaaatctgtgcttctgaagccaatattctttataattcaatttcatgacttcgatttacagtgtattgttaatgtatgaatgtaatttgtgggttcattttattttttgcatagatgacataggagtatgctttttaccacctttttaacagtgagataaacccaaattccctaacatgaatgagttggccttctgttatttgtctcttccaaatatttacagcctaaattctcaccagtctttttagttcttagaccgaaccattctttttcttgactctggactcgcatcatcagtattcactctccttcatattgtgaagtgcttctagctcagattagggagcgcttgcctgacttgacttaagttaggtccctttctccggcttcctttggattctgtatattttctttttatttgtaaactttctgaaggcagttgctgattctgtcatactcattgttgtatctcaacttttaatacaccattcaacgtttttgaatgaatgaattaatgaatgaatacataagcaatatagaagacatttttggagctacgtgatatactaggataactgtttatattgcttattaactttagatgcctgtgatttcatgcctttttctctttcttacccaaatataaattgcacattgttagtcttaggaaaaaatacatcatttgaaaaaattatagtcaaaatgccaactgtattctgtaagataaaaataataacacattctaaagaggggctagattgctaagctagatatcttccagaacatctttaccatggccagaaggaaaatagtaaaagcaagttcattgaaatattttcattgataaaagtgaacaccactgaaaaaaaatagtgaaatattattttagataattacacagaatattgtttttaaattccagtgcattttggcttatatatatatatatgttaatgaattgtgccattaacatcttgttatgctttagtatttaatttatttgagaaactctagtattctaacattactacacatcagttctacattttcttttaggtgatgttttaaattctcacattggggatttcaacatttatttctcgtctttaaatctttctctatatcgtattgaagaaatgggttgtaatttcttaaatatgcaaagcaatttgagattagaagattgcaactctggagttaagataaaagtggtctgcattcaagactatacaaattcacatatgtgtggtgctttgctctttgagattttcatactgcttttgcaaatctttccctttactttggtgtcctgcgttttaaatggaattctcactctggactcttaatttattcatctaatattattttccgcatcgtcctacctttgtaggttatcaactcatccagacacaccaactttttttaataattaaatactatattcattctaaatattttacattctaagaataaattctatgaatagaattttaatttttattgctacactaaattctgatttttttaaattctgatttttaaatcatgaaggttttttgttttgtttctactttctcaagaattactgttcacattaaatacatgccacagatgtgtttttagtaaaaaacaaaaaaaagacactttctaaaatcattagttgcctttgactgcatctgtaatatatacatatagactagttatattttcaataaaacaaaaaagttttttaaagcaactgcagaagtaagtcccattagcaaatattgtgtgctgaagagaaaaccacatttagtatgaacaatagcataaccgtaggcctggaaaaggtcaagaacacctccacctcactctcatttgacagagttggcatactaaatttgttgagtgttaatgtaacgtggcgtggagaattttttccatttccaaaatagttagtatattaaccatttaatattcatacttttagtgcttaaagttataaatgataccccttcttttgtaaccttggaaataaaacagaaaaaaagcctttacagctgctggcaagcttgaaactggcatcacaccaaactctagaactaagcagaagccagtagcaaaaggaactgccaccctcattgacccctggcgttttgactcagtttgaatgaagaactgggtggaagtgaaaagtagtccagacgatgtcctccctagtcacatttcaggaaaggaatagaggtaggagaagaaattgtgccattaccgctcttcagtgggatttcctgatttattcccctcaaggttgtcaaccatttgtgacttttccggttgccaattatttcactttattacatagtcttcaataaaagagactgaccaacccatcttgacttcaattttaagcaaatatgaaagatatactatttgttgttataaaaaatacagatacttttcatcaatccatttattgaacatactgatgataaacgtttctgtttcgactagatgtcttcataaaatacataaaataaattttaaaatctctgggactaaactagagactttaaatgtactcaacaggaaaaaaaatagaaacacagtttaaggaacctaatcattgtaaattgagttaacatctcctgtttctgaaagagaagcttttagttggacataaagatcgttttttctttaagaaatatataacagctgaaatatggtgtggaatggaaacccacaaaatgtggttgctgagcctctcttgagtactagaatgtatatcatttaaacaatataagagtaaattagtagcagcacagccagacacagcagagaaaattgactagacagatagaaaagataatctgaagaatattgctgtccattcttttccatgagtatgtggatcagttcacagatgttgatgtagtatcagcagcctcccagattctgtttggcattcggtatgaatggaattacacatgaaaccactgcatggatccatatctagttattgctttccttacttattaaaatcctaaaaatacttgaggatttcacttctgaggaggtgaaaatgatgtgtgttcttgaatcaaatcctttctctctctctctctatatatatatatgtatatgtgtgtgtgtatatatataatgtgtgtgtataaaataaatatagaacttgaaaataattacatgaaaacactggtttaatcagtcagcttcattcagagacaagttcattcagggaaagaaaaaaattagttgaataatctgtattttgaacttctcagttctattaaaactgtcaacttagctgttatacgtaaacacacaccagactgtataagagataatttaaaatatcaattcttaattatatttgtggataatagctcattttgatcagaaaataattattgcagccctttaagtttgaacaactaagtaactaaagtttcaagtctaaattaataaaataactgggtatacaaatgaattggttcaagtacacagtggatggttgaagagtccaagaacacagtccatttgctcctgctggaaagtctgagtagtatcctaaactatttatcaaagactttaacatgtgagctgtgaagcttgtgtcagatacatatttttgaaataaaatataaatgcctttgacacctgtagaacagttttatgtttttggaaagatactgcttttgctcatcctagagcaaatcctactttacacaaaattgactttaaaggaagataattttgaatgttcatgttggtgtcagcctaaaattttatacttgagagcgacatttgagaaaaggtggttgatggatataaggttagtcaaaaacactttgtctcactcacactccaggcctcttcctgcagcacatggcttctttgcaccccatgttcaggatcattgctatttctttagagtacatattttagaggtagaaattagagatgattgttttattactagagactgcagtcctctgcccctgtcttttctgtatgggtataaagttcccagtaatataattgtaaccattagatggtttacaaattgtaacaggaagatattttatgtggaaattttaaaaatccgcatgattggcaaaatccgataaaataatccatttactatatgcagtataaaacaaacaattataaaagagctggcttgatcataaaagagtggctcaaagtatcaaactgaatatgaaatatagctacagatagagaatatttaccaagaacattttgacatgtgcctagtgccatggttctcaaactgtgtgccaaggttcccagggtggtgtagctaattcataggggcacaggatattttaaaattttagagaaaatacagaggcatctattggacactatgtgaactatcatagataagttctttggactttactaaataaaattgagcagttggatatttcctttgtttttaagagtcccatgaaacaattattgaaccatcaatggtgccttaatcaaagaaagtttggaaacttttgtcctagagttgttttaaaaattactgtgattttttttttttaacctggaagttattgtctttcacctattacactgccaaccacagaacagaatattataacaaaatttattttccacttaacagtgctatgtatagtatgatgaagataatcaattacttgtttataccaattgattcctttgtcaatatgatttcaagcattcaatatttggtttatttgttttgatttaattaatgcaatctcaaataggcaactgcaaatagagaggtactttgaaggagagagcctggacttgggatcagattttacctcattctgatgtttcgattgtcctaatgtaagttattaagcttcagtttccttatctacacaatggtgtaataagatccatgatccattttacggaattgttacaaagatcaaacgagattatctaagaattggtgcctaatattgtgcctgtcttattatgttatttacaagtgataaagactgagataatgtagtacgagcaaaatacagatcttgttttgaaaggaaaaaaggattttaaaatcacacctagcatttgatgacatttcatcactcactctctttgagttaggatcaaactcactctgccatacatgaatgaggcttcctctgactgaggaaaacaactgtttacagaaaagcagcaaagtgctgatgaaaacatttgcttggtttaatacaaccttagccttacctgtttttattataatcaccaagttttaaactttttcttttctttttttcattttttggaggcagtctcactctgtcacccagtgcagtggcatgatctcggctcactgcaacctccacctcccaggttcaagagattctcctgcctcagcctcccaagtagctgggactacaggcatgcaccaccacgcccagctaatttttgtatttttagtagggatggcattttgccacgttgcctaggctggtttcaaactcctgccctcacgtgatccacccacctcccaaagtgctgggattacaggtgtgagccaccgtgcctggccagttttaaactttttctgttgttgttttttacttgtccttttattagagctcatgttgagaaacatcatatgagttttagaaaatgtagttagtcactgttttggctgtataaaactagaaatatattcacatcctcattctgcattttaaaacattgattaacttttcagatatgtgctaaatagccatataaagttactgattgaaatatttaattgcctcatgagattagcttaaataaatagaagtcgatgagccaagcttaataaacttaaaatatgctgtatttactcttcatcggttttctgaacagtatttccgtttccaataaaaagggaaactctcagttaattagttcctcatacaccgcaataaaattaatgtttaggagttaaataccataaacttcctcaggcgtatttgctgatgtgttcctgtttttagttaatgtcacatgtttcattgtttaatgggagtatcatgtgggttccattatatctcttatgcaaagagttcacgtgtctggcattttaggagactgcatactaatttctgatttaacggtgtcagctatgtcagctgacatacaggttattggtgatgagtgctaaaacaatcaaaaatcacaagctaaaaaccatcaacatggtacgcttttatcaaactgacaaaataggaaatgtgttgtcaggatcccatactgtatgttctttgtaaataagcagagagaaaagaggatataatcatgtctttaggcttctgttttttgtttgtttgtttttattttttatttttttgagacggagtctcgctctgttgcccaggctggagtgcaatggcacgatctcggctcactgcaagctccgcctcctgagttcaagcgattctcctgccccagcctcctgagtagctgggattacaggcgtctgccaccatgccttgctaatttttttgtatttttagcagacatggggtttcaccatgttggccagcctggtttcgaactcctacctcaagtgatccacccatcttggcctcccaaagtgttaggattaaggcatgagccaccatgcccagctggtttctgtattttttgtgttagaattattgtgaccagctcttcccctctcctctgccttcccagaagtttataaaccgatgactttgggagatcctgatttagttgtaaagctttgtaaatgtttatatttgtaaagaattgaattattttggtacctgaatggccagtcatttaagttcccttttgaggtagttacattagtggtttaaaaatatgaaatgattgaaaaataaagagaactgggttcaaaaatgtatacaacattccataattatgtggtgacagtcatcttccacttctcatgagaaaagtgtttctaggtcattaaaatatatcttttgattgaaaatggagttgacattattgtcttaagattatattactgaaaaagggatatgtctttgttgtggcaatcacagtattataacttgacataaaaataatagcttatactgtactttattatttattaaatattgtcacataattgattttaatcattataactgtgagatgataactgatctatattagtaaccagcatttaatccaacttccaccccaacatatgcacactgccaccaccaaaatacgtacacacaagcaaacaaaaaagcaaagactctttctttgataaatttctcagattttattaggccataactagcttttcttttaatccatgtcatttactttttaacatttaagaacatcagaatgtcattcattttaaacctaaagctcattcagcttagtattctcttttcaacatgagtctcctccttcacaatgtataaacataagatggaaagagtgattaatggcactctgtgctgtcagccaaaagacttcaaaatatggaattaccatatgagtttgtcatagctgagcctaacccttagacttctaagtttttatttttgttgccacggcaagaatggaatttcatctcagtaacagactaagttcatcaacctgaagtgtaagcccagaagaacaatatattattttatctgaataaatgtaacagttcatgatacaatacaacggaaatctccagtaagcatgttctaagactccactagaaggcaaacttatgtcataagattgattggaaagtatggaagaagaaaaatatttagtaaaacaagctaagataaaacattttgcttcaaactctacaatagatatatattttccgtaaggacttaaaaagtcctgattttgaaatgtcatgtggaataggatgctgcattaatttggatacaggtttagctgctgtaaaaggccaaaatagtactagcttaaacatgatgaaagaatattttttacttccgtaataatctaagcatcgcttatatggtaactccatgacatccagtctcaggcttgctctcttattgattttacggctttccacaaattgtagcttacatcttatggtcttagataccttatccagcttccatttccacattccaacaatgaaaagagaaaagtcaggcgagaaagaactacagcaacttttcagacagtactatttccctaataattgattttggctctattttcaaagagtatactcaaacatttcttaaacctgtctctatagtcagctcataatacccttcatattttttttctaatatattaaaggtggcactttctgactgcaacaacctcaaacaatggagaattgtagaaaacaaactaaaagttatctgccttcactcacatactcctataatcccactacccaggtgtaactaccattaattttatacatgtttttccagagctaggtatacatgtaaatatgaatccattatatatatttatataaaaatatttagatatagatgtgtaatatgtagcaaaatagcctgtgtattgtaatatgcataatatgatacatatactatgtatatttacgatatgtactgtatatcatatacctgaggatatatgctacatagatgacaaactacttacatgtatgaaaaatacattatggatatcttcttcctccatactttcagatgtaaattattctatatttccttatgatggatacatcgtattttatttggtttccccactaatggacatttaggtatttctactgcatttacagtttcaaaccatgctacaatgaatatttttgtatgcgcatattgccccaaatgaatttttcatgtaaccagttccatttctagtatgtgatattttactttagtttctttctgaacattttgcacctgagagtttgcatctaaattctaatgctctctgagtttgttaatggagaatttaaaactttcaaaatggagtggcccaagttatctgtgaattagcattcataagacttgaaatcagaaactaattgtctggctttaatgaattctatcagaaaaaaaaaaatacaatgaaacaaggggtcagaagaccttagtagtcacagtcccgtttcatattaatctgtgcccttgggcaagtcatcttgctctccctgttttatctttttcatctttcaggcagccacagtaatgtctgctctacatactttataaggagattgtaaaatgtggatgggatgagtatatgcatttctaaagaagtcaaattattgtataaatataaaatatcattatgattcattaaatatatactcctgttgtgaaactattaaatatgtcataatgaaaaggatgtcaagagtttttctattctaggtcactatgcctctgaccattcaagacatttatattatgtattttttcatattcattcatgttaatgacaacatttattaacttctagaggtttaacatttattattttagtaggaatctctaggccagcaatcattctaaatgtgtatctcataggcttaccattgtagtgatttaggaagcttcctattctcacctgtgaacctcagaccctggatacactcaggaggtatacgatgtctgccaaaagcccagataagagagaaaggtgcaatggctagaaagggagtcagcaaattaaatggttgctaagccttaatattaaaagtgggaaataaaagaggaattgcatttaatttggtcttaagtggcttatgcgaatgcccctcttccaaattcctactctctaatacttgaaacattttggatgaattttctcgggaccattcatttcttcataagacacagaggcaaaatgtagacatagtattctaagatagagctggatatagaagcagttccataattcatgattcttgttaagcagcttaaaatgagttattgtgcaataccttaaatgatgccttagcagtcaggcgggaatacagaaggaaaaggagacatatttgattcattgtcaccttttcagggatactcagacttcttagataattaatccaagaagttttattgataatcacattctccaatttacgggcaaggagatgaagaacaatgtattttttatatgcagaaaggtcttcccattctgagaggtgtttcttaaagagttcataaattaatctctttctaaactagccaactaggtaactattaaattaaataggataaagttttcatttgctatgctacattaagacgtcataaaaatatattttattttaaaaaatctcttattgaaaatagttagctgtgacaaagcagttaagaactaacaattaccttatattgtcttattttaaaatatctatatagtcaaacaagagctaatttattttactctctcgaataaaatgtatatgaaatattcccattcattacttaccattctatgaaatttaatacaaaatattagcatttcttataaaaagtttcaaatgttaaagtcatattatactattctagcaaatctaaaaagactgtacagatcttccacatttcgaaattccttcacctttacttgtgtatagcaaatcacttgttcttggttgctcaagatgctgtaggagagttgttataaatgtaactacttataatgaggaaaaaagtatagctgaacttattgccataaggaaacaaatttcatcttggttggatttaagaaagtataaaatgatatgaaacaatcacagtgaagaatgattttgttttgattatatgtttatatgtaacatcttattttctagtggatacaatgaccaagtgcaggtgctttaatgaaatcataataaaagattcttgttgatgaacagaaatcattttaagactttggaagtgcatattacttaattttcatacctaagaggataagaattgtttataaaatcaaaatttacaagagataaattatggaatattataaaagaattattgttatatgaaaatatgttaaaagagattattttattctttaactaccttctctgggtcctgatttcctcctacccctaaattctaggcctctctgtcccgtttcattatctgttcttcctttcaacatttgcaactcaacaaagtatttgtttgaattaaaccgtgcacaaaaaactaatacttatttgtataattattgtcttataatatggtttttctactaaaccttaggcttttgatatgccaagagttgtctcttgtatttgatatttgttaacttcttaaatgaattcttccttcatttattcagtcaataaacattttaataggcttaagtgtgtcaggcattgtgctagggactagggatttaaagatgagcaagacataattcctccctttaggatgctcttagtctagttggggagaatgggattgctatggtctgaatgtttattttcccccaaaattcatatgctgaaatcctcaccttcaagttaataggaggtgattaggtcatgagggcaaagtccttataagagtggccccagagagctgccttgctccttctacagtgtgaggacacagaaagaatgcaccatttattcatcaaaaaatgggccttcatcaggcccagaatttgctggtgcccttattttgggcttcccggcctccagaactgtgagaaacaaatgtttgttctttataagccacccagttcatggtattttgttgtatcagcccgaacagacagaataaggatataagcagtggtaatatacagatatgcatcatattttaagagaagtctttggaaaaggaattactttaaatccaagagtgttgaagtatcaggaaaggattcttagtgtgaggggtctcaagtcaacctaaaggataaaggcagctatacaatcgaagaagtgattgggctgaagggatacagacagactattccaagcagaaaaaaaaagcctaaagaccagaaagcaagagataaaatagggtggacatggacctataaacagctaagtgttaagaataatgtatatggtaggaagtgacaagtgagtagtactttgaggacatgagaccaattcagggaaatatgtttagacatatgctgcaggagccagaaaaccacgaaaggtctgaagcctaggattgagatcatactggcatccatccacccatccatccatccatccatccatccatccatccatccatccatctatctgtacattcatccatccatccatccatattcattcatccatccatatatccacatcaaagcatgcttctcttgttccctgttacattttcagcccctaaaacatagtatataattaataaatacttactatacttcaaatacaaggaatgaatactacagattgcctgtattgaatgctactggaaactagagagagaacgaatttcgttagcagaggactagagcctgggagactgattgagaagctcttataatagaaagacatgtagacctaggagtttaaaggaaaagatcttcatgatttattggccgtggagggtgaaagggatggagaaatcaaggttactttcatatttgtagtctgggtgactgagtgtcactaagtgttataagaacaccaggagtagaagcagcttttggaagaaagaagataaattacattttgtacatgtgaaggtggagcttattgtgggacagctagggagaattgctcaaaaaaaaaaaaaaacagtagaagaggtctaggctacagtcactgatttggaaaatattagtttgtatatggttgctgaaccatgagattggataagatcattcagataaagtgaatagaaggagaagaaccaagtgccaaggattagacgccaaggaataccaatatttaaggaagggatggatgaaggaaggtggaacagcctattgcagaaacagataataaagttggcatgaacaagatataaggagaaccaggacagctgttttaagaaaagccaagagaatgtatagatataattagagaagaagaaaatcattaacagaggcagctgttgcagatatatgttcattaaaatttggcaattcagaggtcattagtaaatttataaagcatttccccaaaaatatatggattgagaactaaagagtaggagaaggatttaagattatcactagtttttaacaatttagatgagagaaaatagatgatggtttcagaaggggttttatattctagatagttcattttttttaggataggaggtaattgtgcatatatttaaagacataattatgtacaaattgcttatgttggtatttgaggtcatcgatagaccataatcagccttctaaataatttttgctactagatgaaatgggttcaactacaggctagatcttgaattttgcttgctcatttctttgatcctgttgtacctcctactttggggctcatttttttaattgagcatctactctatgccaggcatttcagctcataggcttctcgcatcttttctacttcgtattttatattcaaggcctaactcaatctcagcccctcctctgattctttccccagtgatccaacttgtataaatccttttctctggtaattactgcctatattcatttgactccaattgtatagttttgattcatttcactttccatatttatatgtcttattttcataactgaaagtgttttgaaggcaaggattgtaccttttagtgctttgtgttctccacatagtaagagtttgatacatgttaattgaatggaaattagttgaatatgttatgaaaattgaagtatacatttgcataatgctttaaaagtagtctgtgtgttctgcaataatgttttccttattaaaatagtaagaactctagtaatgattaaccgtgggataatcctggccagtttaaaaaattgtgtagaatgggaataataatttctaccctaaagagttgttgtgaagattaaaagcaattttatacatttacatatatgtatatatgtatatatgtgtatatgtatatgtaagatatttcaacacagtgccaaaagtcaacaaataatagcttcccacatttcaaatcagtgggagaacaagtaattattcaaaaacgatgagggaataattaaatatttggggaaacaatatttcttaaatcatataccaaaataaaacttcaaacactgaaaaaaaattctcacatattttcttttttcttttacttcatcaaatcagttatcaagtctgtctcccaaagctattctctgctctccttcattgatttatttgcaatagtttttaacatatctatctgcagtctctccttcttccaatcgttctatgccttgccacaaaactgatatatctggaacacaaatactaacaaaaaatattattttcctgcttaaaacctttcagtgacttaacgttgtcttcaaaggaaaacataaggctcttcaagatatgagctctacttgcttctttagctgaatagttccccattcattccgtttctgcatcagaaacactgggggtaatgaaactatccctggatgtaggcataaatatagttgttcttattagccctataaatggcagggggctcccccaagcttgaaggcacccaccaatttctctatcagcccatgacatgaaagaaagcaacatgagatgaaagaaagcagttttcttccaaagttccatctacagtgtccttactaacttcattttgtcttagaattctacaaggcctcctctacctggaaatgagagtggtaagaacagggtgagaactcagtaccaatctgagaaggtttttaataggagcaatgctcgttgcactgaaaggtgcatgcttactgttgaccctgtaacatttataatacatgggaaggaggtggtaaaatggtcccgaagtataatttggtattgatagtggccatcttttaagagacacctcagtaaatacaattccttgactatcgagtctctttcaggttgagttctttctttcaggtttccagaataacttttacactcttctactttgcttattgtatatttggattagtttacatggtgaatcctcctcacttgattaagactgggacagggattgtatgtgtgtatgtcagagaggggttgattttcatatttcccagcacctacagaaggcaagctggtatttgtcaaggaggcaaaacaaaaacaaacaaaaaaacatgtaaggccaataaaggaatgagtctccacatttcagtgaagataatgccataaaactgtccaaaacttttgcattagttcagtagatgaaagagtgtgtattgttgagtcttgttaaaaccacatctgcatttcacattttccttcatcctaaataatcttgttggaaaaattgtttttcttaggctgtgttatacagtatagagatgaattcttcatagtatgactggagataattaatatctaaatatgcacaactataataatgatgcaattgaatgcttttaaagagttaatataagccgtatcatttgtgtcagtagacactgtaagctatgttgtattctgaaagcaatagaataacatgcctcagtatactttttagctttttgaaaaattttagttttgagctagaatttccatgcttggtcttgaaataagaagcaaattaatgttggaaaggcttagggaaaaatttttcaaatggttaaaacctagggaagagtagaagaaattacttttaactagttgaaagtcaacttgaataacttacacatggttgaactttaaaagtcaaagttttccattatctgatttttttactaagtatgaatctcatgaggtatttacaaaataaatctgttgtaatgttttttagtacagttaattgaggaatggcgcaaatagatgacagtatttacttcaataaaaactcttttttttttcttacagcagcttctgtatttttcctttgccattaaaaatgacccctgaccttgtttgtgaagctttgtagattctgtgtccactgtagaacactgacacatccatgtaatatattttgaattttttaaattgagagttaaatggctgcattggaaattttcacaggtattttatttgtattcactttgttgtaaccaggagcatacttcaaccaaagtaatcttggcttgaaaaaatggtaacaaggtagagacatgctttaagttaattgtgtttatgtgttgggtgaatatcattgaaatagcgtagcgctattagacacaatccttttgaaattaattagtcgacatattggatatatttgtatatttgaaactatatatgattaaagatatataataactgtagtagtcttttaaattcctgctgccagtcttttcttttccccaattcacttagacaccaaatatattgacatatggctgtatatggcaaacatattgcatgagtttgttatggctgctataacaaaatagcatagactgagtggcttgcacaacagaaacttattttttcacagctctgtatgctgtatagctgagatcagagtgtcagcaggttgtttcttctgataccactctttgcagcctgtagatgaccaccttctctctgtgttcacacctggtcataccagacagactctattttgtttgtgtcctaatctgttctgcttataagaacaccagacatatttggttaagtcaccatgcatatgacttaattttatcttaaattagctctttaaaggctctatttttaaatatagtcacattctggagtattagtagtaacaacttgaacatatcaatttgtagacagacataattcaatccatgacacatataaaaagtatttagcttatataaactttcacataaaggaatacctcattttactgtgttttgctttagtgtgtttcacgcagattgcattttttacaaattgaaggtttatagcaattctgcatagagcaagtctgtcagcaccatttttccaacagcatgtgctcacttcatgtctctttgtcatattttgataattttttcaatatttcaaacttgattattattatatgttatggtgatctgtgatcaatgatctttggtattatagttataattgttttgggatgccataaactgcacccacataagatgggaaacttaaaaaatgtgagctagaaatgattgagcttgatgaagaaggtgtgtcaaaagatggggcaggctaaaagctaggcctcttgcacgagacagacaagttgcgaatgcaaaggaaaagttctggaaggaaattaaaagtgctatgccagtgaacacacaaataataagaaagtgaaacagccttattgttgagttgcaggaagtttgagtagttgaaatagaagatcaaaccagccacaacattcccttaagccaaagcctaatccagaggaaggacctataactctcttcaattctacgaaggctgagagagatgagaaagctgcagaagaaaagtttggtgttggggaggttggttcaggaagccatctacctacataaaagtgcaagatgaaacagcaagtgctgatgtagaagctgcagcaagttatctagaagatttgtctaaggtcattgatgcaaaagtggctacactaaccaacagattttcagtgtagataaaacagccttttactggaagaagatgccatccagaactttcatagctagagaggacaagtcaagtcaatgtctggcttcaaaggacaagctgactcttaggagctactgcagctggtgaattaagttgaagccaaagctcatttactattttgaaaatcttagtttttttaagaattaagctaaatctaccttgcctgtgctctataaatggaacagcaaaagcctggatgacagcacatctattgacagcgtgatttactgaatattttaagcccactagtgagacccacagctcagaaaaaagatttctttcaaaacattactgctcattgacagttgcacccagtcacccaagaactctgatggtggtgtacaaggagatggatgttgttttcatgcctgctaacacaacatttgttctacagccaacgagtcaaggagtaattttgactttcaagccctattattttagaaatacatttcataacctgtcactgccacagtgattcctctgatggatctggaaagaaagtaattattgaaaaccttctagaaaagatttacaattataaatgctattaagaacattaatgattgatgggagggaggaggtcaaaataccaacattaacaggattttgaaagaatttgattttaccccccttggatgactttgaggggttcaagacatcagtagaggaaataattgcagatgtggtggaaatagcagtagaactagaattagaaatggagcttgaagatgtgactaaattgctgccatctcatgataaaacttgaatggatgaggagtttcttcttatgaatgagcaaagaaaatggtttcttgaaattaattctacttctgatgaagattatgtgagcattattgaaatgacaacaaaggattgagaacattaaataaacttagttgatgaagcagtggcagggtttgatggaacttcaaagctgaaagaagttctgctgtagataactgctatcaattagcatcacatgctacagagagatcttttgtgaaaggaagagtcaatcaatgctgcaaacttcattgttgtcttatttgaagaaattcccaccaggcgcggtggctcatgcccataatcccagcactttgggaggccaaggcaggtggattgcttgagcccaggagttcaagtccagcctggtcaatattaaaaaaccttgcctttacaaaaaattagctggttggagtggtgtgggcatgtggtcccagctacccaagagactgaggtgagaggattgcctgagaccaggaggtcaaggatgcagtgagtaatgtttgcgccactgcactccaccctgggcgacatagccagaccctgtctcaaaataaataagtaaataagagaaaagaaaaggaaggttagctaccctaaccttcaacagccaccatcctgatcagtcagcagccatcaacatcaaggcaagacctttaagcagcaaaaagattacaactcactgaaggctcagatgatagcattttttagcaataaagtatttttttattaaggtatgtatatgttttagacataattctattgcacacttaatagactatagttttgtctaaacacgacttatatgtactgtgaaacaaaaaagtgtgcataacttgctttattgtgctacttgctttattgtggtagttggattcaaacttacaatatctccaaggtattcctgtgtatatatacatttatacacatacaatatggcattagtaaaacatatcagctatttacatatatatgcatatccaaaggaaagatagttaatttcattaatacacattcattaatttaggaaataaaaagattataacatatgcatatttttaaattttatggaataatctgtattataagtaatgagctttaaatttacatgaaatttgatattaataattagatgcaagtaatgcaaaagtgtcccaaacatctgcaggtgttttgctaaatttaggagttaaacaaatttaggaatacgtctttgtctctaggatggagaaccaggtgatctttaatacttcctactacttaagctctttaatgaggcttcttaaaacttcatttcttgtccattgccttttcatatccagatctcaagattggagtattaaaagtttcccaactccttgtcttcaatctcttttccctctactttattctatcacctgttatttaaactgtttcttctctacattcctttagcatgtcatactcctgctttgatgcatttcaccctatccgaaaggtctctcctcccctccatctgcacattttcaagaccaagctcactcttattttcatctgtaactattcccttaagattgaagcctggattagttctcccttacctcctatactacctactgatgatggtcaacattattcaaataagcacttaattagaaaagatagaaatgcagtaaatacagaccaagttttgttttgtctcacagagcagctagcagaattctgttcatgataaatgttatagtgcttatgaattggttaatttacaatagggaaaataaataataaaaaatgaattttcactgtgaagagtaccacagcctctacaattttgcttttgttaattttaagattatgtatcctaagttaagaatacaaatgaattaagtagttttaagcatttaaattgtcaattctaatagtcatactataatagtatttacaattttaactagtttgcatgaatttagcttttaaatatctaaatgtcctattataaaattggatagtgtttggaagattaaatactaaaaatatgaaatgataaagcaccattatgtaatattggttgtcccttctctctcctgtatcataggtttttgctctatttactgaatctttctcattagcatacgagcatggtataatttttctacatatgtaccttcttataaagtttgcttgatcacacaactttcactagctactgtaaaacacctcagtgtagttgtctgttctagcacttctcaaactctaatacacatacaaataatctggggctcttgttaaaatttaaattctgattcagatgccacatgtttcctacttcaataaattagcctaaaactgttgtgccttaagacaacaaacatttatttggacacagccatgctgggtacctctggctccggatctttcccactgtagtccaggtattggcctggattgcagtcatctctaggcttggcctgggtagaatctgttccaagctcccttcattaactgttggcatgcctcatttctttgcttgctattggccaaaaacatctgtcttttgctatatgagtctttccacagagcagctcacaacctagcggcttgctccaacagagggtgtgggcaaccaaggcagccaaaatacttttgtaacttaatctcaaatgtaaaatagcattactttagccatattctgtgcattagaaggcaattaccagacccaggacacactgaaagggaggtgattacatgggacataaataccagggagtgggagtcattggaggttctatcttaggggctgtctgcacagtagctttagggtgggttctaaaaatgtgcatttccaagaaactccaggtgatgctaatgctcctcatctgaatcttgcattgaaaagcgagggtctacacttcctgcctccaattcctttctttcgatcatcctttgttgatcacactctttctgattaggccttctcaacctccactccactgaaaccgccattgttgcagttgccagtgacctccacatcattaaatccagcacttaaatgaaaaaaattatcactgtctggaagtctttctttacttggcttctggaacaccaaatttacatttcttctcagtctcttctgctagttacctatctgcctgagtataaatgttagtacatcccacagtccaaatttttggacctctttttaatctatggttaactcctaagtggtcttatcaaggcttacagcttaaattccagatacatgctaaccactctcaagtatatgtctcctatgagggcttttcccctaaaattttaacatgtttatcaagtgtctaataaatacctcaacctggatatctaatcataatttcaaacttaaaatatctaaaacagaactctttgttccttccccgcaacaacaccctttaggccccacctggcagtcttgcttctaatctgtgtttacaaacccagtacatactaccacatgtcaatcagttgttttagtgaaaaacctggaagtcatccttgagtcttctgttactctcatacgtaacagtcattaggttttaccagttataccatttaaatatctctggagtccctgcctcactctccatccccatgtcaccatcctagtctgaccataattaccttttttttttttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccataattaccttttatacagatttctgcatctgctcactagttgattacagctctcaacctcccacccaagtgattttactcaacccatctgttttccacgttcatgatttcctttaccgtataggataaagtttagatcatttaatgtttacagaaatcacacataatctggcatcttactccctccccaatcccattgatctcacttccctacatgctctctgtacttcagcaatacagggactgggctataactaacacttccatttgattcttcatgaaaattgtttccctgcctggaacaatctttcttcccttctttgtctagctaactataatttaattcaagtttcagcttaaacatcaccttttcctggaggctgtctttaacatattagactaggtttgggacaaccacagtgcagtccatagcattatgtacttcgctgtcttaactgccattatatattatactaatcatttaattatctttttctcccattaaactgtaagcttttggaaggccagatccagagaggtagatccaggtattttgaagcctaaaaaataacctgggagactctctttagaataaaaatgcaaaaattttatatgctcagacacgcacacaaacacacacacttaggtagaaaagtgaatattcatttataacaaatcacaacaaattacaacaactgataaatataaaaatatatgacaaatataaaaatacgcagtgaacatactgcaagaggccagtttcaaaagcccaaagtttaagcttcattaaattcccagtaaattcacatctgcatattaatcttttccaaagctttatgtctagggccaagaggaatgcttaatacatagcaggtactcaataaatgtttttgaatggcgtattaactgagttattttaagttatatttttcatgcgtgcaatattcaacacattttttataaattagatttctacaaaatgttttatgcattacaaaattgttctattatttttagttatttgctatggtcatgtgtcagatgacaaataatgtacattacttatatttcttagcaatttattgggccctatgcaacaggtctattgtacctctttactaattaagaacccccttgattttcataaaaaataagcagaataaccttctctatgtgcttctctgtatgtttttgtgtgtgcctatatttttacaggtcatataacagtaaaacttcaggattaattttgaattagtgtgcttttttaatagataaaaaatgtcggggggaagggatctattttccattttcattacaatatagttttgtaaacatttatccctggataataaagatgtcaatatttcatataacttgaaaaacacataaaatgttttcttcgttgttaatttgtccatattatttaagagattaagattatttgaatcaagaccgtaacatagcatttcaaagataagctactttgtttaaatctttggagtttaattcattaaaataaaagtaagttaagttccttttataataatactgtaaatttgctgaggagttactgtgctcatattaaaattgtgtgtgtgtgtgtgcacgcgcgtgtgtgttatcaagtgcagccctctgatcaatgctcactttccctcccattttcctaaatacatcatgaaaaaaggatgaggtttccgccttaattgcttgtgccttttattcacattcctctctcagccagaattgtgaaaagagtgttagtaaaaggctgcacaatagagcttttcattaggcctcagcaaggcacacaaaagaaggcttttggaaagagtgaatgcatgagtttaatttgcaggtggagagtagataaaaggtgctgacgcctctattattctcttacttaggtgacccttaccctgttcagctgatcccaactaccatggcagctgctgccgcagcaacaccaggcttaggcccactccaactgcaggtaagtcaggaaacaatacagaggagacaaaggttaagtaaatatcgaaaacagctattatggtgttaaagcaaaataaaactgactcgtgatattcgtctcacactttctgtttttaaatttatttgtaatgatcctcaaccacaagttgaaatgttgattctcttaatttttagccctgttttctgcactaaacatagcttatcgtatttcttttcttgccggtattattaagaaagtgagctgtagttttgctttgattactgcgtgccataattttgtcacagtatggtccttatcaaggtaaaaagaacaaaaaaccctgcaaaagatattcagacacttgaggagcaaggcgacttaacaaaaatgcatttcaaattgctcaggatgcccagtatcattgaaatggtctgtaggtctctttgttctcttgctaataccagctgagttgggcaagcaaggaaaagtagaccaaataagctgaagactaaataagcacaactttatcccagtcatcccaattaagacttttctagccgtgcgaaatatatattcctataatccgagaatgtcaacgataactttaccagatgtccaagtgatttgagaagctttgtctctgaggttgaaaagaaaatcaatacaattatagtaacaggtagctttgattaactgttgacatttttgaatcagcatcccacaaaacattccttagtttctatcggtatggacctgtgattatgcaattaacgggaatagaaaattatctaataataggattactctcctcttgtgagaagttaacctgaaagacacagtatgcctatgaatactgttagcctgaaagacacagtatgcctatgaagccagagataaagcagttatacttaataattaatttttcttcgtgaaaaggtattgtcatgataggtgatcttagtctataaggaaaatatagttttatattgtagcatcaagagacagataacatctggcctgcacatgggtttgtcagaagacctggtgggtttctgaaaggccagctgagtttcccaggaggaactaccagtgtgaaagctgagacatactgtgttctacagaggttaataacattcatttctattcttccttttctgtgaacagctacactgtgagtatctgttttctttgagctggaaatgtcttgggaagtgttggagctgtggggacaataaaagtaacataacatttgttaccctttgaaatgagatctggggaataactataacatgaaaaagtgattgtaataggtaaagctaaaaagagtagtggaattagcaagagggaataatatccagcaatagatttaaatataggaataggggttttagagatttcagatgttggttttcaaagcaagttagacattctcctttgaccattggattagcgatgagaggaagtgagagcaagttagaggcaactcctatgttcattgcacgactctcttcgaaagtagctatgttaagcaacaatctaatcaacttttcctgtagagacagtgggagaatatttgatgctaatttttatttttatactatatgagatttttatttttataatatatgagattatctcaagatattaaatatcttgagacattaagatattaaaatataaacaattttgtcactgaacaagagaaactttagacaccaaacatatatgttcttactttaactatgatttgagatgtaaatgggataaagttcctttcatagaagtggtattgtacccattaaaatgcatgagttttagagcctcaaataatcctgtagtataacaagaaaattaataatccaaaattttttcatggaaagccatcagctactattaaaacacatttacataaacatataaaaaagttgttttttttttttttgcagtgagaaaataaccgttattcagaacaaacacatgcccaaagcatgtcgtatcagagaacctggcttttctttgaagtggactgactctcacttttgctagggtgcttacaccaactcacttttctacttgttcctaacacaatattcacagaccccttgaccttgacttcagccttccccagagctacacaggatatctgttactctccctccctttgccttaaaatagcatcaaaattcttttttctccacaaacctgctgagatgggtgagagaaaagctaactacaatgcctagtcagatgttttattataagccttacctaaaattcaccccaatctttgaaacctatttttgagatgtttcatctcagtggagtataatatatggactagttttaattttctccaaactctgcttttaattatgctctgttaaatctctattttccatatcttaatatcttgagtagactgcatcactttccagtcctttcagttattaaaattcagtcctgctggaaactttaatctcatatccatttcatatctcactgcttccccttccatcgttagtcaagaatcccagctctagagaccagaaataagaagggtgcagcttactcttttgcttcttcagctccaattttgttcctgtgcagatgtgggtgggcttaggaagttatgtctgccgtgagataccgtggaaacagtgtgtgtgttattttcttgtgtattgaacagcttttcttggtctgttaagagaggggtggccaggtctgttgatctatgcttcctactctttttttttttatttggggtgtcaccactattggccaggagctacctgggtaacatgacacctgcctttgttcaccctctgtgctgctccatggagaaacctgtagtcttctactgaggtcctcttctgtgccctgttagagctgtggtggtagtacatcgcagtcctcctctcagcctgcagcaaacaccgcattgttttccagcaacccacctccggctttagaaaacttcagaagagaaaacaggcattactgtgtctttagttacataatacaccaccaagctgtacactgtccagttctcctaagacctttctcaccacactaaggatggaggagtctttcggtttttagctcaacaaaaagccagttgaggaacaacattcaagtttttgctttattctgccttctccagtttttgctttattctgctttttgggtaagcagggaagaccactaagaaccaagccaccctgtaaagctgttaacccaatcttctctctcctcagctccctcaccagacatcagctcatatatattgtgggaatggaaagatagggtgggaggaatgagagagaggtgtgagacagtaatgaacattgactgaagtagggccaggtcagcaaggttttaatgaggggagtatggttggtggtatgggtgctgtctagtaccaattgctgatgtctttctttagaaccattgaagagtttgttgttgttggcttgttctcactcgttttctgtttttgtttaatctgttcgtgtatgttttaagtaggtagtgataaactcacagctatactcgataaggcagcagtaagatgggttgaggtaacagtaggaagaccagttggaggaacagctgaaatagccttgccaaagaactagtggttttctgaattaatctttattcaatggtaatgagaataatgtggaggggatatatattttaaacacaaaaggatcctgttttcttttccttgggtgcaaacataatgattttaactcatgtaaagtgccgtaacaactgatgtcactagttaatatcacccatggttatggaatattttcttaagctagtttctctggtaaagattttccgaggattatcttatttaattcatattacgttttgtgttatgtattaatatctccatttgacaaagaagaaagcggggtcacagagtccaaaatccatggcctttgaacaattatatttgcttcttcaagtacaggagactttatgttaaactttggaggcattgcccttcttcagacatttggtaactcataaccagctaatgaaattataacaataatgctgactaattgacattaatacaaatactctgtgtgctttgcaataatgaaagaagtagcaggattcataatgacagctgtctacttcggactctgaattttctatttcatgcctctttacatggatatatgttaattcaggtacttctttttgaacacctagattaaataaaggacattataaatctattcctacttatggttgactttgtttacctaccatatgtgttttcatttgaaataaccttttgcatataattgttcaaacttggataatattatgataagtaaatccagaatttttattaaagagtgcagacaagtacaattattttaaaagacaagcaaaatgatatgctttaaagcaaactactgtttattaactattattttatgtccctggagatccttatataataaaaaattgttcatgtagaaaaatcaccttactgtgtactttcagaagcagttaaaatattctaaaaatcatcatatatatttgttatttaatggagaaaatcagcttaatctagttcatgtatataaataatacaaattagcatgtgccatagacaccatttattattttaatattaaatctgtctttttctttacacattttaaatctcccttgagcttcaattcacattagccaactgcttgttgactatgaagaggaaatatacagaaattcacagacactgtaaactgagtccaaaatggaactcatcagtagttgtatgccttgtccctagacttccttattctttggtcttagtgaatgactccatttcatctatttctcaacccagaaacatgagagctcttcttagcttctcttcctccctcttccccataaatttattcattcactagcttttcattccacctactaatacaccaagaatctatccacttccttccatcataattgtcactcatttgggtcgagctatccttatgactttcctaattcaccacagcagcccctaaactggtctttctatcttgatcttgcccctttcaatgcactctccactatgcattagtcagaataatcttcctttttttatttttttaaattattattatactttaagttctagggtacatgtgcacaacgtgcagatttgttacatatgtatacatgtgccatgttggtgtgctgcacccattaacttgtcatttacattaggtatatctcctaatgctctccctcccccctcctcccaccccacgacaggccccggtgtggtgtgtgatgttccccttcctgtgtccatgtgttctcattgttcagttcccacctgtgagtgagaacatgtggtgtttggttttctgtccttgcaatagtttgctcagaatgatggtttctagcttcatccatgtccctttctgattttagaaaattttgtcatgtcctcttcctgctcaaggaccttcaatgactctctggtgttttgaagttctttctccaccctggatctttacaagtggtgttttctcttcctggaataaccccaggaaataaccccattactcaccatctttactaatcgaatcccacttacccctcaggtttcaggttaaaacatcacttttttcagggaagacttcattggtcttaagtctggcttaaagtagttcccgcgtgttctgagagcatgctgtatttcccttctcacattgctggtagaatgttttaaatcatactttctagcatctaccagatggtaaagtctgtagcatcaatggtttaccatcatttgcacttaaccaagtgcttgaaatattttatggactcaataaatatgtgttaaataaagaatgaggaatgaatcttaacaatgtattttcaataaattattcatctattttgctcaaatagctatcttgctttataatattgaaattaagctgaatactaataattagttttctatattaattaatcaccttttaaaacgagacaatagcagaatttcaaatatcaaaggcatggttggctgatagaagaaaaaaacagtttgaatttggttaattaagataatgttgaaattttataataaactattctcatttaatgaaataaacatatgaaaacactctctgtgcctggtagcatgtttggcactacaatgtttacagacattaattttgtaactgttttgctccacatcacctactcagtctattccggatacattaggctgttttctggcccttatcttaccaaggcatactcccttcctagagttttgtgctagctgttctctctagctctttcctctgcatggaaggctaattctttcacttcattcatgtatttactctaataccatctctctgaggcctaccttaaccaacctacttaaaatcgtaaggtggatcctaagagatagcacacttcctagctcttttattctacatttttctctatagcactagtcatcttcaaatatactataaaatgtattatgtttcttatttattgtctttcttttccaaatgtaccgccccacaaggacaagaattgttgctgttgttcaataatgtatctcaggtatccagaagaatgcctagcaaatagcaggtattcagtgcatacttgcaaatgaaagagactatcatggctaatggtcataagaatttttaattaaaaaaagcagcatatattgatttctgcgttaaatgatattaatttaatggccagggaacttgatgttttttcttgcccccattggaagattctaagagtatgaaaaatccacagctctctgtctctcctgctctttcttccctttatcttaccataacagtgggttgctgcataaagaatgtgttttagcacttattacagtttatgtaattcttttaaaatcattataattcacaataaaagaccaaatgttacaatacttgagaattcctatattatgtgatagtgtgtgtatagacatatataaaaatatgaactactggaggtacttttatttgactcatggcttattctgccaatacaatactgaagtaaattatttctaaataatggaaggatgtgtttatcaaaataattactagccaattagcagctccatacactgagtttaccttctctcttcctctccttccttctttttttcattcttcttcatcctcaagtactcttttttacctccaagagccaatgatgatttagatatttacttatttattatactgatgctgactctttttaaaggcgaggggttcatttatatagcttacttatctatgttcattttaatattaaaaatgaatatcactatttacacaaaacgaagttacactttgaatttttggacatttgtgacaagataaaatcagctatgtgaataatctgtttctaattaataagatcaaatgatggcaacaatccatctagcatttatttctcatattcattttcgttataatttgcattttacttaatgggcatcatgaatatttttaatagtaataattcttctgtaatgtactgtttctgttttttgctacacttctaagatttgaaattggaaggaaatatttatccacttacttctcactttataaatactgtatttgtcttggccaaaagatggttgccacctgttctacctataggaagccaaaaatgttgactccaaccaatgattgatagtgataagcagaaggaaaaaaagattgaaattctttttggatgatcttatttaattcaaaataagcaagtagcatccaatcatcatttttattgacttaattaaacttttaaaattattttagtaggactattttaaaaattcataataatatttttggaataaaggctcaaaattccaagttgtcataaatgaaacctcatgggcttacagcttcagtaactagtaatattagtagcatgcattctctggaatagagaaaatgatagatgatgtgtgatcatgttagagaatgaatcatacaaaatatcaactgaaatcaatcttttttcatagcaatcataggtatacgaagtaatattggaaatggcttaagctcctgtctgatggagagtaacatcaaggtagaggtagatgaaatactgaagctcatctttttatcaaactcctgccagtctctgaagaaggtcaataattatgacaggacacagataaaagaatgctccatatttcccagcactgtgagtgactgagcatggctttatatgcttggccaagagaaacttccagaaaatcaataaggaagtaataaccatatagaaaaatctagatgtgaggatttttatcttgttattgaaggaattacttacaaggatgtatacttgttaagtgttcatctttacctaccaaaatactgtactactcagttaaacttttaggtcgtatcattttcatacagggtgaataatgatcaactgctcttcatttcagtcgcaaccctggtgtgctgtttgctgttggacttctgtctgcatgagtgagttttcttgcaggttaaaagactgaattccttcttttcctctcccttcgaccctgagcctggagggcagacagacagaagcacacatatgattaatacagcacagctgcaagagtgagtcatttgcatatgtattaatagaggcaaaaaaaccccaacaacaattaaattatatacagagacattttgcatactaaagaacatatgcaaataggcctgaaaaagtgcagccaacattttctctgacttttccaagcccatatgggctagagtcagagcccagcagtttgtcgagaatcccctttaaggaagaacctattaggaactgcttccatagttattaccacccctagagttcctgggaggtgttgacatttggacaatggagtcagtacacacagtgtctttttcatactatttctgtgttttcttgctttcagcagcttcatggtgtcttattacatgctgacagaaacatcagtacacgtgtgtttttccaaagtattcatttttattgtaatggtcgattaaataaatggtaaactttaaaattatatttgaaattttgttattacctatactaaagctatataacttcagtcagtgccaggttttctggtcacaagtccatgcccattccttgatagtatcctgtgttatcttaatcaaaacatgttttaggtaactttaaaatgtttctgggctaataaacatacataaaagaactgctgtcccaagaccagcagtagatgtaattctatgagcaataccaatttattgaaatttttaaagtatacttttttaaattttatcaagaaaaacagaaatattcagttttctagttttggctgtggataagaagagagggcaactaatgtgtttcaagttcacagattatgtttatcttagaaatttgttcttcagcctaattgttggtttagtttattttactagtattctttaatttatttaaggaatattttatgaagacaaattcaatcttcggagtaaaattttacctaaataagagttatcaccttaataggaccaatgacccatgtgaagacagatgcatcttaagaggaacaaatgctggggtttttgttactgttgttgttgctgttgatactagaaaactatttaatattatccatggatttttatccattattcgtatggtttagtcaaagcatgctactgggacatacaaattgcattacatacaacttgtaacatagggtggagtcttaattaaatatacacagaaaaatgtacttaattatgtatagatacacacacacaaatttaatgtcttaggggataattagaggaaagataaaatgatgaaagcaattttatctttttaagctattgtctttagattaatcttttaagaagcactttgtttagtgagaggcagtataacataatggttataagtgtggttcttgcagccatctcttccttaaattatcatactgttactttcaagctctgtgactctgggcaagttacctaacctctccatgcctcaattttcttgtctgtaaagtgggtataaatgacctcttattgttgaggattaaatgaaataatgcatgcaaagtcttggaacaataaatgtattatttctcaaataccatgtgctggatttgagttaatatttaatagtattagctgattaataattgttattagtagatttgagaactatttgttattgcttaaaggaagtcttgaaaattagggcatggcagactttccttacgtttcagagcagcactaaagtgtgttaataaaactgagacaaaatgtcttatttttgaagaaataatttcattcatctctgtggtataaaataaaggcccatcgcaagaatctatgggaggcaatgagtttacttatccagaagacaatctgggcagttacatgaagggtagtttttcatattttgctatggttcgttccttgttacaatatttatatctgtaaaatgagaataacatctccagtcaattcccatttttccatggaggtaatgcaaatgaattgtttctatgtgctgcctctaactattctaaataaatttcttacaaagtctaaaataaattatttttacataggtgcttttaatgtaatatgcaacttttttataaatcatataaaaatattttcttgtatagccattcaaagcttatttatttcctaggtaatagatacatgtccttgatacactaggatacatgtcccttattccacctacatgttgtctacagcaaaattatttcttgaattgagaaaatttttatttgaccaaacagttttatttcaaacttgaatatgaaagtgaattatttttatagacccatagtatcctggaatctttatttattcagcaaatatttattctttgtaagctattgagctaagcattataagaaatgcaaagatgaatcagtcaaggatccttggtggatgatagaggaggttgaaatgaaagagaatgaatgaaatatgaaagtggaatagagtttgaagaaaggcaaacaacctatcattctaacaagtgtatttgaaatgaaaaagacctcacagatggttgaaaacgttgtttcaaactattcaccggactccaagtatgttcaagcaccctccagatagtaccattgacttttatttgttttatatattaagttccactggttaaaattgtttgagttaaagatttctgctgctaagcaaaacttaaaaaccattcttctattccagctccttaattttatggatgaggcaatttagactctaaatagtgacctggctaaaacagatattaacaaaagggtgcccggaatcctagcaactgaaaattaaatctaccttcttcccattttgccatgatattcttaaaaataaatgcatatatttgtatatgttatttttaagttgtttcgtttaaaaggataggaagagaaattgttaattttgcacttaggccattaaattaagaaagaatgaataaaacaatggttaggatttgcatattggtaacaatggcaaccttctgaattgctttcattttgctgagttcagtgattgtgctctgtgaattaattcttttgtggaaagctattgaaagatcaaggaatttagaaaacaaaacaacagagaagcgtgctgtttcatatctatttgtacatagaaggttcaaagtgagattgtttacatcacaagtcttgttgacattttatttgcttcttagaagaaagatagtattcaaaaatgattatataatcatgcagataagacgttgcagtcatgaatgaactgttctgagagaaggaccaagaagaaaaaccacatgacaatttcgagctgggtttggttggcaagtgtcttcacaagacttgaaaatagagccctatttgattcctacagaaaaaataaaaataaaaaaaaaaagcttaagccagccctgcacatttcaaatttgctgtttcctgtggaagtttcagtattttcctgccaaattgagggtacgaaaacaagaggaaagggagggatgaactctagtttttccatttttcttaatcttgacctttctcttaatgccgtactcctttttcttatccaactgctccttgaatgaagaaagtgaacaaggagaaacggaggaacagactcaaagtatgctcacaaattatttgctacagtgagctttggggcagcgtaattaatgcctctaacatgaaaattacaacaatattatgtcttgctttctctactactagaacttcttcaacatataattttaaaagtaatagtgttagtgaaagttacaattacttcctttatggagtgaagcagaactatagaaaatattgtcctttcatctgtaacagttgcttaaggtaacagagacaattccatccgaaatttcactatactgtagcatatgactcctactattttaaatatgtgctccaagtatttttcatatggctagttccccacccccacacctggttttcattctttggtttaaaagaaattttaaattattaggaatagtataactaaaatatttgattaacagaaaggagataagcaaagacacttaaccaaacaacaacaaaaaaagttaaaccaaacaataaaaaaagtaaacgcccttacacattctttatttttattcttgttttggtttgatttatgctgctgctggttttcttccagagaaattttgaattttgatgtttttgtgtgacctaagatacaagcctagcattaaatacaatataaaaccataaaatatcaagtttttgtacatagaatatttgcacggtaaccagttagtagtatactagtatactgagagtgagtaaccagttagataactttcatgacttgaggtgttttttttttcctttaaaacatgctccactaaattttatttaaacatttacaaatgttaaaacttacaagtaataatatttaaatggtaggtttgatataatgggttatgagcttgagctctaggataacacaggccttatttgcatgtatctttgatcaagatattgaatatctcatagtctcagtgtcttcacctgtgaaatgagatactgttattcctacatgataaaggtgttgtgaggattaaatgacatggcacacacgaaatactcagcgtagtgtaagcattcagcctcattagctgttatattcatcattatctcctagattcaagggtataaaactggcaaagagcctatccatatttcaagttagcaagtaactttcttggatgcagaaattatattctgcagtataaaggtttaaggcaaatagagaaattcatcttaattcaagtttcggttgaacacctttggaagccaagtcctcatatttaatgcaagcagaacgtctttatgaaaacaaaatatcccttaagtataaaaatcttttcttctgaatgtcagattacaaaaatgtatgtttcaattcttactaaaaatacaaataatctatgtctctctttctttccattccgtaaaagttactagagctttgctttaatagcactgacaattatttgtgaaaggaacaaacattcctcttggaagggcaagccattgtgttactggaaatttgcagtatttgtcataataaagagagttttacagcaagaatgaataattagggcattataaaggcaaccaaaatagctggcctacctatgatgatccattctaacctcccatattgctctacaaatacagcagtgaattaacgcatttatgcccggtgttccgttattggaatgctaagcttgtgggagttctttatatcctactgcttaaggtcattgccagtgtcttctttttcacacacaaaaaaactgcaacctctggcataaatggattaagggttctagtctcaacctgcctcagaagtgatgtatgaatctggtctcatgtcttttaacctacttagcactcaagttttcttatttgttaaatacctataagtatagctatctacctatatctcatggagaaagggataagataaaaaaaaaaaaaaaaaaagcactaatgaaagcagccaagagcccagaaatccccagaaggaaactctgcaccttgtgagtggactttcctgattcatggacacatttattcatgtgctatcaaggaaaaaatgggagaagaataatgaggcaagcattgatttgaggcattcgaaagaaatgctttggaaccttgaaaattgtcaagccagcactgaagatccaattaagcaggaaagttttaattattctcattccatctccatggaataagaaggaagatgagcaggtcagaccagggctagataacccaagagacaacctaagaacattaagaacatgattacacatgaaaaagaaggaccatctagaaataaataagtaaatgacaagttggacataaagtagtttcatagcagaaatcagaatgctgttttattttgaactgcatagccaactagatggacaccatatactttttggtccttagggcttctaaagatttaaaaataggaatttccaaatatttacctttctgttcctatttcttgactatctctctccgtttctctgtctctttctttttctctttccttttttcttcattttttcctctatttttaactaccttcctctgttaattcctctttacctctttcttccccttaactattttcttcaatactttcctcctctcttttttcttcaagttctagctatgtttttattctcccacaattgtgaaacaatggagggactgtcttctttagaaacatttgcttgaggccgggcgcggtggctcatgcctgtaatcccaacactttgggaggccgaggcaggcggatcatgaggtcaggagttcaagaccagcctgaccaacatggtgaaaccccatctctattaaaaatacaaaaattagccggcgtggtggcaggcgcctgtaatcccagctactcaggaggctgaggcaggagaatcatttgaacccaggacgcagaggttgcagtgagccaagatcacgccaccgcacaccagcctgggcaacggagcgagacttagtctcaaacaacaaaaaacaaaaacaaatatttgcctgttggctgaacaattctgttagtaatccatatgtgagcacatgagtcaagagctggaattggggatttcaagtggcaaggatggtggatatcaaagaaaaagatatctgggattgttttgtctaaatataattgataacatcatatatattagaagatacaagccttcaaatgttttcatccatatttcatctctttgtattaataaagccaaataactttaaagagagaggattccatttagaccgtaacaccagtaacagcccccactttcacccactctcccattagaatgagatgttttcaaactgtgtttcagagattgggaaggaagtgtgagttctcttggcaaggaaaaacgtagaggtggaagcacagctcattatttttgtactcagaaagtactacacaattggtttcttagcatcagttgaaatggaaagaattgctttacactttgtttgtttaagagtctactatcattacgttatattcttattatcttaaatggtgtatggtgaaccctgactacctgctctcctgcacacttaaaacatttgctattcattctttatacgcatatggtatattatacatatatagggatcaatctaagttagctagtgttttagaaaacctttataatctaaaatggtagcaaattcccactttctaactccttcttaggaagaaaggccaaaatgtttaagaattaaaagtcaaagttgttgagtgagatcctttttatcttgttgcatttgtatcttttgttttgtaatttctaaaattattatacagtaaaattggctatattttggatgtacaattctgaattttcaccacctctgtaatcaggatatgggacagttccatcaacccccaaaattctcttgatctccttgacaacctcagaaagcaattctccaatctcctcctcagaaagtctaagcctggctgataagacagtggagtttgagcgtgggctggaaccaggtgtcttacattgtaataggtgttctttcgctccctccattttataactgctttcagttctgtttagtgtctttcaatccagcatttgctctagaaagtaaacacttggttttctctctatattactcctcaccttattttgctgaggtaaatttctacttttaattttattcttaaaaattttaattgtgccctaaaactttactaatttgtgtgaatcctctgtaggtttctttttatcatggtaaaatatgtttaacataaaatttaccatattaaccatttttatgtacacagttcagtggcattacatacatttacactgttgtacaaccatcaccactacccgtctccagaacgtttcatcatcccaaactgaaactacatacccatttttcaacaactcctcattctcccatcttctcatctctggtagtcagcattctaccttcactctctatgaatttaactgttctaggcacctcttgttacttaatcatacagtatttggccttccatatctgattttattcatttaacataatgtcttcaatgtttatccatgttgtagcatgtgttagaattccatgcctttttaagactgaataatattccatagtatctatgtaccacattttgtttattgattcctccatctatggacgtttgagttatttctacctttgggctattatgacgaatgctgttatgaatattggatatacacatatctcttctagatcctgctttcagtccattttcggtatatacccaaaagtggaattgctggatcatgtggtaattgtatgtttctttttttatgattgttatcctaatggatgtgaggtgatatctaattgtgatttgggttttcatttcattaattattagtggttgagtatatttttgtatgtttattggtcaattttatacctttttttgtagaaatgtgaataagattatttttgataaaacttctgagaattgattcctagataatatttgctttgtaatatttctcactttaggtaggtcttttatatttcttgaatgaaagagggataaatgagcaagtaaatgaataacactgtttctaagtaccatctagagcatttgagtcttagtaaccactagatttgctacttggggctgggctacatcttataatctagaaataagaatagtaatatttcctgccccatggtattggtatgcagattaaacaatgtgcaaaacactcttaacacagtagcatatcaagatcaaattaaaatttgctaataaaaatatatcagtgtttataattatctaatacatttgtcttataataatacttaaatgctttatgcttctgtctctactgttcatatgttaggagtactcttttataattgaaatattttttaaaagcataaacttcacaggatctaactcagtacctttcaaaaaatgtttttgctgattgaataaaagaatggatgaatggcatatgcatgtgtgtgccagtctcctgcacacacacaaacacaactttgttacatttgacctgtatggtttaaaagtttcaccatgttgtttttctcattactacccttgaatccaaagtatgcatttcctcaaactctattggattgatctttaaagaatgtttaagtcttctggaaaggtatcaagttaaaaaagaggtggcaaaagtttgttttttatttttaatggctaaaataatagactatagatgagtttatctgaatttcgtttctgattttctgacttattctgtggcattaacaataccatatctctgattttctgtcaataaaataatagtaataatatttaccaattaaattaatgatggtatagcatagtatttaagtaggattttgtgaatcttttattaaagtttatggaagtgtgatgtaccagatcaatggtaagttgacgcagtgttgatatattttaatgggtaaattttcccaattatgtgagataaaatgctactggaaaaatatttgtttcttgtactaaaatattttcacttcacatctgatggatttttcttcattttaaaaaaatcaccctttttattttcaaattcgctgagatctgagtttggagttcacatactgatatcaaccaaccattgaagtgtaggatcagaaaaggaataagtgatgatccaaataaaaaagagaaatattagatttttttaaaaaagctaatttgtcacttcactcattggaatatgaactgaatagacttctagcccttaaaatacttttttttttctctttttattgcctggaatcttaagagctttatcatttgcagtcataaaatgaaaatatacaccaaaccctcaaagggcaagtatgaaattaaattatatttgggcagctgtaaccttttaaaacgatcagattccagttaatgtatttcttcctgttccaagtgctgccatggtgtttgatggtgggaagcagtccaaagggcattgggagataataaattcactgtaaatttcaccccaaggcatgtctcgatacaccaaggcctccatttagcaaggctgacctaaaactcttgtcacatccaaaggtcatttaggttggggttggtgtgtcccatctatctttccttgatgtaaagagtgacagttgaaacaggattgagctcataaacagtcatctgaatatgaaaaagaagctagctttggagtaggaagggaaaatgaagagagaactaccttttacggtgtgactagcaaatgccgtggtttttgcaaagtcagtgaagggtgggttgatctcatagctcttgtttcagagcattctttaacttggaaggcattactggatttggttgatttaggatctggtactctttcctcttctatttatatttgtttccaaagctgggtgtatgttgagtattttttaaagaatctaatatttccaaccttcttttactttgaaatcacaatatttcttcccccctttgcacctgttctctttagttcatataccaacacatgggaataaaataggaggaaattgttgtagagaaataaagcctaatgtggtcttggaaaacagtgattttttctaacgccctcttaatcatgcacttttttaattgtaaaatataaataacataaaacttacattttaaccacgtttaagtgtacagttctgtgtagcattatatacaatgttatataaccatcaccactgtctgtgtccagtacattttcatcatgcaaaatagaacctctgtatttatcaattatttcctatttcttatttcctcttcccccatcccctgataagctctattctactttctgtctctgtgaatttgcatatcctaagtaccttgtccttttgtgtctggtttatgtcatttagcctaatattttcaaggttcatccatgttgttgcacgtatccctcaaacatatactttaagaatgactttagttctctcaaaaacaacatttacttataaatgttaagaattgtggatgtataagttctcaattataataatcataactaatatgtagtgtcaaatagagaaatattaaacaactatgtgacaaataatgaaagattaaattcttgcaagtcttcttgggaaaaagtttaaaaatcctttcatgaaagcagagataattatttactgacattttctaattatttagagtagtgcttggcacataataggtccccaataaatatttattaaatgaatgcatcaatttaaggcaggagagcagaagttaagagttgtttctctgtattgcttcgttggtacgtgagaaataggtcctgtgcaattgaaaatgaagcctattgtgatcaaaaaagtcaatgaaagtaaaaatgaattgtaaatgcaaggtgctattggagtgtgttattgttattttaattgatttatgagttatatgtgttggggtagtgaaaaggactcatttttgctatacctttttctttttcaaatggtctagaaaaatcgaggttggccaccatgaatttactcaaagcatagagttttatatgattaattcttcatataaattatacaagaaagaggaaatatttaaataaagatgaggctcagaatgttgaaaattatatatatagatttattctgtaatcgattttaaatctgtaaaaatgtgattaggtagatattacttcaattaaaagtgggttgtaggtgaaacaaaccctcccaatctattctccatattatgtctagactaatcttgtagaaatagaaatctaattctgtcattcctcttattaaattactatatattcccatctacctttgtagacatctctcccactgcactgcgtctcactggcttctttctgacactacaaacttgtcatgtttcctcccagcacgtagtttttctgccagttttttttcctcctgtatgtatgtaattatatcagctcatccttctgacctccaggtattcatagttacaggaaagtctttcctgatttgcctgcctgtagtgtagctctcgcttgcatgctcttagagcaccatatacttctattttgtagtattttgcacatttgggattttacttttcatttgtgtaattatttcattgatggctttcttgttctatgtaagctctatggagctaaagacctagaatgaaactggcattttataatttttttccatgaataaaagcatgaatgataaaagataataagaagtataacagctttctccatattgcattaccttgtttcctacaattacttaaatggttaaaatacatatcaaattgagaagaaaaccacactgaagcggtttttactggcagtagccaaaaggaagtaaatggatgaaagatgccaggaaaaatttcctgttggacacttcacatttctttcttgttctgcatccccaatactatcgctttttatcagaagagcccagcctccataaaaggtgctttctgaattacccttcccaggtttgtctctttgtttcagagcacacaaaccctactactgtattaaaatgaccagaaaatagattcctaagacataggctaagagttaagagctctgtaaaaagtcaaaaagatttggattccaacttcagcttgatctcttacctatgcaactttggacagatgacttttactctttcttggcttcaatgtcctgctccataaagtaaaaataatacctattccctaaggttgttgagaaggttccaagagatatgacatggacatgtctcacagtaagcattctataaacttcagctattatgattattattgctgctgttattctctgtccagatttcccctgaaatgtagttttatttagcataatttgtatactcaaagagccaaaactaatatttgtatgtgatactttcttaatcttaaaggtttatgagggaaggaggaagaaaaaagtaagagcggaatccgtaggaagcagtccttttttaaaacctctcatatgtgttgtttgttagtaataacagcaaaacaaaacagcaaccaaaacaacaacaataatagcaaacttaagtgactttgtggtttcttcagggagcgttgagttctgctactactgactcaagaagtctttcactcttgaagcctttaacccttggccttggaaactattatttttgactcagagttcaggggaaattccttttttcactggccagcaggtgggggattccacctctatcccactgcaaaagagatgaatttaatcatagaacattttatctggaaagtgttttcccatagtagcattacatcacagaagaatttcagggccacttggacttctgatactaccagttgtttaacctttggcaagttattgaaccactgttcaattcgtttttcatctttctcaccaaactcacaaaattgttatggtgatccctgaaatagtatgcaagcttctagcaaaatgattaacatatcgtagtcatggagaaaatcgtggttcttgtacttcctccccttatgtgtttcaagtatttgcaagcctccagcaagtatgtactctggaagtatgttttttgacatgcaaaataatatgtagtctgatttaatatgaaataactcaaattgtctttatattgagttagaatgctgtttaaaaatggcttgattactaccccccaatctgttgggatacactgaacagtgatttcacaaatatgaacttagccaaagacaagtgtttgctttagaactctttctgataatactgtaattctcataatacccaaattaaataatgaaatttagtaaccacagaaatttttctcctgatgaacaagcatttctcttcttaccgttgctttgaagggaatttcagcaatatttttccctaaattaaactaattaaagatataagtataatcactgatacatagagagatctgaagagccttccagccagtgtccttcttaccttgccagatggagatgtatttgctggttggtgacctcaggaatagatgcagagtgttcatcctcccacagtaacaaacagcaagtctggagcggcataaaaagggtcaatcgaataggtcatacatcatatggggaggcagatgttggaacatattgtaatggattactgtgcagtacacgaagatggcttatggagtagaaatacagggagggagtgagcgaaagagaaactatcagttggggtgttcttacatgactctcgcaaaatatatctggttctttaaggaactgcttcaattataaaagtcaaaatgttttttttttctagctgtttaagatttattggtgtgtaatgaagaaagccttttaaaaccccgtgcatttgaagtgtttcttatttataggctttagtatctgcagtgtgacagagacagcatgagagcatcatacctgtgaaaaaggtcttaagatttaagtaagttcaaatgtatctttaatttttagcaggatgctgtcttcacaccctcctaacactccacccctcattgatagcttcatattctatccaagtatcacactgagtaagactgaatttgcaatagaaaaatcaagattgtctatgtattattaatatttggtgatagcagctttaaataaattacattatatcttctgtacatgtattcactatagctttttaacagtaaaacccaaactatagccagatgtaattatttacttttgtatccaagcttttccaagttatatcaggcaagagtgatattttcaaggaagtgtgggtcataataataatttatgccttggagcccatacctccaagccccctatttcaccaagcatgcttcccagtggctcacctgttttctctgaaggcagaaaatttcatttctgaagttggtaacatttttcccctgatggcttatcctcctgccatctatcttttttttttttttttttttcttgagacagagtcttgttctattgcccaggcctggagtgcagtgccacaatcacagctcactgcagccttgaactgctgggctcaagcaatccccctgtctcagcatcctaagtaactaggactgcacatgccattatgcccagctaattttattttatttttaagtttttgttgaaatggggtttcgctatgttgcccaggctcgtctcaaactcctgccctcaagtgatcgtcccaccttggcctctcagagttctgggattacaggcttgagcctcagcagacagtcactaacctctggtgataccaactaactcttcagccttttgaggcctttgtccactcaagtcattttcttgcttgacctgataattcaaacccttatacacccaacaactgcaactttgttttttcaattatgctccactgacataacagctgttagctctccttcatatggacaaatctatagcaagtctgagtttgttcattctttcactgtaatacatttttttcttgccatcaagtttcattagaatttgtgtacaaatacaaaagattttaaatctctcagattatgtgtatgtgaagttgctcctcccggtgactctattccttagtatacccttccttactcccttcaggaggaattcttccccaacggggactccagactggaaattaagtgacaacccttcccactttcctctaggcacctttccccaatcacttttcccccatggtctgtgatagaactggggaagcagcaggagaaatgtttcacaatcccagcctccacccacttctgtggattaaccacttaggaggttagcggagaattctttccatctattctctacccctgtccctttccgctcaggtttgaccaagagtctcagtcctgagagctggctgtcagccctgtctactcttcattttttccaggcgtcaccttagtggttaatgaaagtcgtcaatgttcagagtcctaccttggcatgcccagtattccttgacggatacaaagaacacatatccctttagaaccctcattgtacctctcctctgttaggatttttgaaaattaaagaataaaaaattactttttgtgtaagtatataaaaaattcatttgagaggtaactatctatatgtattacctttttccaccattatggtgtttattattatgaatattttgataatagctatacagtactattaaactggactcttgcacagtctctctgataggttttaccctttaaagtcaaattcaaatatataaagaagttttaccactcaataataaggcagctcaatttgtaaaatacattacgggatataaatacaatcccattattgggcatatacctaaagaaatataaattggataaatgtggtgcatatacaccatggaatactatacagccataaaaaaagaatgagatcgtgtcttttgcaggaacataaatggaactggaggccattatcgttagcaaactagcacaggaagagaaaaccaaatactgcatgttctcacctataagtgagagctaaatgataagaacttctggacacacagaggggaacaagagtcactggggcctatttgaaggtagagaatgggaaaagggagaagaacagaaaaaaataacaattgggtactaggcttaatatctgggtgacaaaataatctacacaacaattcccctgacacaagtttacctgtataacaagcctgcacatgtacccctggacctaaaattaaaaaatttaaaataaaacaaaactcaaatatataagtaattcttacaactcaataataagacagcttaattttttttaaaaaaagcaaaagatctgaatgcatattttaccaaaaaagacaggaatggctaataagtacatgaaaagatgctcaacatcattagagaaatgcaaattaaaactacgagataccacttcacacctgccaaaatagttataattaaaaagacaataccaagtattgatgaaaatataaggccgggtacggtggctcacgcctgtaatcccagcactttgggaggccgaagcaggtggatcacgaggtcaggagttcgagaacatcctgaccaacatggtaaaaccccgtctgcactaaaaatacaaaaaaattagctgggcgcggtggcacacgcctgtaatcccagctactcaggaggctgagacagtagaattgctttaacctgggaggcggaggttgcagtgagccaagattgtgccattgcactccagcctgggcatcagagtgagactctgtttccaaaaaaaagaaagaaaatatagagaaactggaatcttcatacgttgctatggaaatgaaagatggttcagccacttcagaaaagtctgacaatttccttagaaggtaaacatgaagataccacattactcaacaaatccaatcctaggacatggataagcagaagaaatgaaaacacacaaaaacttgtaccggaatgttcatagcaggattattcactggaaaattggaaaacatcatccaactatccatcagctagataaatggataaacaaatattatacacccatgcaaataaatacttttcaacagtacaataacaggctactgatacatgctgcaccttggagagagttcaaaaatgttacgctaagtgaaagaaaccagatctctttttctacagtctcttccagcattgccccagtagtggggacaacaaaatagctttacctcacatctggccaaagagaagtaaaaggaatgtgttatttcaaaaagggggaggagggtcttctgctgtgtacagaaaagtcttaaatgctaataaacatattttgttggttgatttgaaggttaactttatggctttgcacgtgatgttccttctgcctggaatattcttgcattttaacttcatcctgcacttccttgaggacatatgtagcaggactgcagccatgtcagatcctggcccccacttcagaagctctttacaagtcagtcgaagtcaagatgatgagcctatttaggacagaagcgattccttgtctcttgaatggagctaggggtgggaagaggagggacacaggcgcaggcccaaacctgctgtccttgggccaccaggttttgacatggagctgcaaggagaccaagaattctaaattcaaacctgtcctccagatttccaaactgaaggtccgtagtcattaaacactaacttcctaattcctccctcccctgagcccctgaaaaccaccattctgctttctgtctctatgaatttaatttctctaggtaattcatataaatggaatcatactatatttgttatttggtgagtggcttatttgcttagcatagcataatacctttaaggtttatccatgttgtaccatgtgccagaatttcatttctttctaaggctgaataataattcattgtgtgtatatagcacagtttgtttatccattcatccatcagtggacatttgaattatttctacctttgggctgttgtgaataattctgctgtgaacatgggtgtacagatatctttttgagatcctgctttcaattcttttttgtgtatgaccaaaagtaaaattaccaggttatatagtaattctatcattaattttttgaggaaccaccatattatttttcacagtgacaggagcattgcacagtcccatcagcgatatacaagtttccaattcctccacatccttgccagcatttgttactttctggtgcttttttttttttctcttttgataggagtcgtcctaatgggtgtgaagcagtatctcttctgcttttgatttgcatccaggtcattttgaaaataggtttgtcaagacgggagaatgaaacatgtttaattaggcagttcattgacttatgaattataaatttttataccttcgacatgtgagttcctatctgtacttctgtcctggtattcagcacagtgaaggcctatcgtggttttcatgcattacacttgaagaacatgcaaaagaaatgctgacagtgttagggaaagtccatgtttaaactcaagttgctatgataattttctatgataatgtgaaaaaacattatgaaaaataatgggcaaagcaaatttattcatactgaaacatgctgctgtgttttgaaagattttctccagtacattagtttctctttaaactccacatttaagttacattaggaagctgaaattaagctataaagataacacttatggagccttgaaattgctttctgaatttttgctcacaaatgatattccctgttcctcctcttaaaaacaggaagagaaagaagaaataaacaaatacttttccgtcaaatatatatagtacatatctttttaggttttatttaaactttaacaggtcatattcaacaatttttttaaatcataatagatgacatatattttaaaatctctattccaaatatttaacacattgcatatatgttaattgttcttgccacatttcaaaccctggactcaaaagaaatcttccatttttataagtatatttgacctgggaggtgctattaatcatcaagattttagctctataatgttcttttagaagatgtaagtctatatatttgtttatgtgcaattttagaagtgacagctatttatttttgagtgaggactttatcactgaggatgaaaaaggattacaactttttccttatgcctacttaaactcttggggtgaactaaacaatctcattggtcacattttaataaaatacttaaaaatctcaatgacctgacttggattatatgaatgtatcaaattatcacatgtaccctcaaaatatgtacatctaatgtatatcaataaattttacatatttttaatatattttattgatattcatttatggcatacctctcctttctctgttttatatactggtgtttgatatgagattacactgggagaaaaggataatacgtataaaaataattttaaacaatttcacaaaaatagtattaaatggtatgcatgctcttatcactctccattcagataataacagtgtaaaaagttcacaaattatctttaggaatcagtatgttttatcatacagtacttaagaaagacatatttcagttgtaatcttaatgtgtttttttttttttaatttaaaatgccttttgtgcccagctctcctatgaagtttaatgaagttggtgatttgggggagaagaaatgtagggaggatgaaaagggggagagtaagggtagagagaggatggtggacataacatactttgcactgtcttcacaataaggtagaaatatctccatctcctaatccatgcctgaagtaaaggaaaatagttggatcaaaccatacactgtcatatgctgctggctcctgggtaagtgactgtatatggcatcatctctgtctcctgtgcctttatccagattgcctgggcacacaaaagggagacctgtagcaagatcccagttaaaataaaaattaaagatccagcaatcccgcttctgggcatgtatccaaaggaaatgaaatcagcatgttgaagagatatctgtactccagtgttgattgcagcattatttacgataaccaagacatggaatcaaccttattgtccatcagtagataaatggatacagaaaatgtgagatatatgtataaatacacacacacacacacacacacacacgcacacacacacacacgatggaatacttttcagccttgaaaaaaaaatcctgttatttgtgaaaacatggataaacctgaagcatattctgttaagtgaaataagcaaggcacagaaagacaaataccatgtgatctcatttacctgtggaatctaaaacagtcaaactcatggaaggagagagtagaatagtgattaccagggtagaaggcaagggggaaagaggagacattggtcaaataataattttataaaatagaaaattaaactttaagcaaactaaaaggatcccaaagaaacagcttatacctaccagcaaccgtaactcctactaaatatcttttactttctaaataacaaatatttaagattcggcaagtaaattgtgtatatttatttatcaaaaagaaggcatttgtcatctgtcttttccaaaatactgcagaatatccatatgcttcaactcttggttctgttgccttttgaaaagatacttttaacttttttcaaataatcttcacccatttttggtatttattttgcaaatagacattcagttactgttatgattatgactacaatgaggttattaatttactttgttcttatgctgataagatttaaattcatatttttttcctctcaagcaaatgaaatgagtgaatgaatgtgaattttatctatattactaatgagcctttctttctaattctttggattgtacaagcatgccaaattcattttggattttaaaaatttgttttatgtatagtcactattatgaaatatattaaatatgtacaagagatctatattaataatattttacatagtcattttctgcatttgttcaattttactgttccttgtttttaaaattttctgataaagcattgattagcagggacataatctctgccttcaaggagtttactggtcagtaaatggtttggggcaataaatcttgatagatatttttgtcagtgcctaatgcactgaatccaaatactccagatggcggttagacagtggactagtagtcaatcagagaagttgtgtttttagcaatttggggaaagtaacctattattgaaaagtggcaagaatttaccacctctaggtattaatgaaatagactagcttagaatttaaataagctgattgtagaatttctctactcctcacactgaaaagtacttgcttaaggtatttttatgggtatcttcataaaagcatgattgatttaatactattgattctaaccatagcataaaagctatgtcatccaaatacaattatactattttttttcccaaaatagcaacaattaattagtacaagttaaaatatctgttatcctgccagaccttttctagccccatagtgggccattagagatgagcagaaagaatgcctgttaatgaactgccagcccactgcccagcagtgatttggtgcacataataataaattataagaaaaactactgattagacttgagtaagttagatacaattcaagcttatgttggtggtggtggagaactgatcacacttttcataattttttaaaagtgttttattgagccacactttaggggaagttcatgattgaatggatctagtcattcagggaaatcctctctgtgtgaattaatacttcctttgtcaagaaggaaagaaagaaataaaagaaaaatatagtatatgtgttttggctttcttaaaaggataaatgatgaatatacacaaatgagaatagatgatgggtgagattacttacatacttatgaagacttcatatacattgtattatcatcctgttcctctgtttgtcttttcttttccccagttaattggcaatttttatgtgcccagtatgctatgaacttgaaattattttttccgtcttcatttcacaactgttactgcaattcaagttcctatgatcagcattatcactgttaaatgttgataatttcatagctgatatttctgtcttatcaatattctggctaaaaaacatcatatatattgctctcaaacagtcagtggctttctcttactacatattcaattaaaactcttttgcttatgtttcaaaagcttccataaggtgagtgtagcctacaaaactaatgttattttcctctaacatggctatgtatgcattgccctttctaccactcactgttccacaccaatctctatatttcccttgcagcaactagctcattcctgctctcatgcctttcttttaattgtactgccttcctagaatgccatctcctttttctatgtccaccttaactccatttcttctatgaaaacatacctgaacacactgatgcatttcttctctcttaacaccttcgacagtgacatacagttacagtatacttatagtctcattgttttctgtttatcagtcttgacttaaggcagaaactatgtttgtacactttctctctcctctgctatatcaataatagtccagagtcagcacatatatgttgcctagtttcttactttgtgtatttaatccattaataattataactattttttattgatcaggcattctttaccatgtgctttcctgagtgttttgtacacatcatgtgattcatttctcacagtacctttataaggtcaatttcatttatccctgaatttacatattaaggaactgtggctcagagaagttgcccaaggtcacatggcttagagttgcaattagaattcagttctgccttgtccaaagctcttgctttttaagttttccactagaagtagaaagcatgatctttcaaggagcttaaaatgttgaagagacaaaaatctaggttatggagcaatttgagacaaaaataggagttgcttatatttatatacatgtatgtaaaaacatatttatgaactttgagtaccaggaagacacgaagtaatcaataataaattctaacctaatcatttgtaattgtttccttaaaaactcattgtctaaaggaggtacaggtatgagggtagtgaaagagaatgagaatgcaatgttttaagcaatagaaagactggaaagctctgaggagttgtgaagttttagagatcacatccaatccctaacacattagtttcaaggtaagagtcaagttattctgttattctgcgaggctaagatactgtgagtctggttaaactaatgaaatgagtgttctctttcagctcagccttttttttttttttttttttttttttcttttttcttttgagacaacgtctcactatgttgcccaggctggtctcaaactcccaggctcaagcagtcctcctgtctctgcctcccaaagtgctgaggttacaggtgtgagccaccacacctggctcagctcagccttttatgtttagtgtcatcagtttgtttagtgtcacctgtttgtttccgatgttttagacaacttcactatcataaaaatacattcatcataatataccttatgtttaactttgggttttatctgttattatttaaagaaagatgttaaccagattttcactttaagacatacaggcatacatacgtacaaacataagtggattgtatagttctccaggtgcttgttatttcaggtggccttccagtggtcactagatttcatgcccctttcccatctacaaggtcaaccaatggttctgtgactgtagacatcacctgttattagggcagacacctgttattaggcttgattttgctttaagaacgtttaataaaagaaggaaactgctcatcatttcttggcttatttgttttaaaatcattcactacacatattttaatggagagaaaaaggagcataattttttaaaagtgtgaattaaaataagtcagagcagcattttaaaaaaattatccactcttacatatgtagccagatagaagaattattgtcagcttctttaattttactgaaatttcctattaacttgtaaatggccaagttagaatgcaagagtattaaaattcctgattgatcttatctgagcagactcaaagtatgttaaattctctaagacggggttcatttttgcttttgtgttagaatataacttttaggaaaacatatctatgacacaaaatgtgttgaaatagatatttcctggccttacttcaataccttggtgaaccaggaaaatctgatatgcttggtggaaaatgcagtgatgtgggaatagtggaaaactgatcacagttggagaagagtaattctaaaatttgtcctcttgcacagaagccaaatatgagaaagggtttatgggcaatttgggggagagaagagcaacctaatgttagccatcctcgaactgaatagcaggtttatgaaattctcatcataaattacattccgtctctgtattctgtagaaataccagcaaggcaaatgatattatactgttattatagaaatattgcatattcaactgggtctatctcttttacaaatgtttcttccctttcaactcaaaagcatttcttttaggacaatttaactcagatacaccttaattccatatttaaaagggtaaatatatttatttgaacgatgaaagtatatgtataacttttatttccaaatatgtgtcttctccatcctttaaatcctttaattcaataaactattttagagtttttatacttgtatttttaataatagttcttatatttctttggaaattatgactgtctctggtgcctaatatttaaatattgaatcacatttaatggctacttggttaagcgatttaaatatctaaataacacaaataaccaataattttgtcagtaatatgaagaatcaaaattaaattttgaataactgttttgttcacattttctttatcacagatattgtatgttccatgtcattagtaattataaaataatttcatttttagtgtataacgaatcagtaataggaacttttatcctctagtaataatacccagtgaaatcatttttaaagacaagaatacaatatacaatacaatatgaaattcataaaatgtaatatagttatctagttaacttgtgaatatacatatagtttttaaattcaatattagtacatgcattctactggtcagagttttaatctgtaaagtgatatcctaggataactggttattttcttaaagactttataagtagtttagaatgatgccagaaagaagtgctttttaaattgcagtatataatgcatagatttttaagacagatgggagaaatggatcaattctgatcatttttctttaaatagtaaactctcaagtcttcctttttgaagtgaattatccttttaatgtttatgtaattgaagacaatcatttttattctttccagttggctggggtaagaaaagatgtaattattccaacacataaaacccttatgagacaattattaatataaaaatatttttctggtcttttagttttctctgggatatattttacattaatttgcataaaattaagccataatttttatcgataactttaatgtatttttatttaggttatagtatctggagacttatgtatgtgtattttcacataaatgtgtgctgtcttcagttttcattattttatttagagagagacactgctaatcaggatctgtggcttatcatgagcaattttgttgtttggaatttctctttcagaaaaaaaatcaagataatccagataactatttcacagtacttctccttgagagcattttttcttgcttcattgtagaaattctagcttgcattgtaaacgctatccatggaatctcaagacaaatgagaaataagaaactgggatgtgtgtgtgtgtgtgtaaaatttatttaatattaaatatataattaaatatttagtaatttaaatatatgatatatttatttaataattattttcttacatagttatttaaaattttaacaaagttgtgaaaggaaaatgaaaagagtaataattaaatatttgatgtaatatttgaatttaaagcaacttccttgttttaggataatacatcatacggctatcattatcaaagtaaaatttttcttttattaattacttggacaattttattgcttatttaataagaataagtaatggcttagtggaagaatatgtgttttaggcagtattctttaaaaccttagtcgtcaagataatttgagatttgtctgtgtttacatatcatgaagtaaagtgaacttctggcaagcatccagttaatttttatcaatgtaggtagactgaccagataatcttcttcaagtacttttttcccgttgcctttcagtgccttttctgtacttctacccacctaacactcagaaaaattgtttcgggtgcccatttcaagaaatcaaagaaagaggcatacagggcttgaaccaatatggatagtagaaaattactgtgtatatgaagcatccttttgtaacacactgtgtaaatttaaagtagaatataaagagctcttaactagataatatgttatacttgccttctatagacattggaataaagtaaatttggatggctcttatttgctttgagtccttggacatactgaaggtgagatcacttatatgtagtatctgtcatttctcccctaaaaagtaatgaaatctgaggtgacagcttctttctttaaatattccagtgcactaaacaaaatgctcataggaaaaataccatatctgaatatatgtactttctgaatggtacgtttattttattattcacagtattctttctccctctctctctttttcttctgtagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggtacccttttgaagaagccactgtcttgccacttagctttatttttcattcaatggtatttattaaatgtctattgtatgccagcagctagcttaaactctgggtgtacaaggaggtaagaatcaagtaagggcaacaggtgtgcatgtcaacttatctgcatacattgaatcattcatttattcatttattcaatatgcgtgtatcgataactatagtagaaaatgtgagagataaaaaagattatcagatgggtatcttgtacccaaggagcttacagtctgattatgtagatatttataaaaatagccaaatagccatactctatgatacaaaataaattttgtaaaaagttacagataaagtacattggaagttatattgggaggcagagatcatcttcagggagagatcccatcaggagtttgccagagaagggaaaactgaaatagaccttaaaatacaagtagaattaggacctacagaaggtgttttaaaaatatcagtgactgttataatgtggtacagtgtaggtataattttagataaatcacccgcccaatgagattatcatgtaaggaaatgaaggtaatagtagtgttagaagtaaggcaatttagaagtggttttggtttttaagctaagaaaacattagaacacatggaaaaggatcagggaaaagtcaaataatgtatgtttcttggcctagaaggagagaaaaattgattttaaatttgtatttgtattaagatcttgcttaaatgatattgtataaatatattaagctttccatgcaagaagtaagaagagtgatcgtaaagcagtattccttgagattactcagggaaacaaccacaaataatttgattctattaggaaatgttaagtagaaagctgacgcagttagtttaccagcaaaatatatatatatatatatatattttatatatatatttattttgctgaattatgtagaaaattgcttctgttctccatcccatgaatgccatgttgacatgtctaaaacaaaacagtgtaagaatagtcacaatcattgaaatacacagagaaaaggattagaaaatattaaaagagaaaaatccaagaatcctcaaaaaatctttctctagtaccctggtggctctgtcaggatgtctttcagagttattgtatactccagagagtaaatcagtaaggagaagggatcaatcaatcatttggaaaagggcactctaacctccatcttcctagaattccccagtccttttccatattattaaaagacaaatattttggggaatataacttaacctggacaaggaccttagaccatgctttttcagcaatatgtagaaatatttaatgaaaattattgtacacactacattgacagtaggagtatacatatgccactttgaagatctatttcagttgtttaatggactgtgcatcttctgtgcttaatgtatatctaaggcctggtctgcttttctttataatcacaacagcatgtaagtttttaaaactggtaataattttaacatttcttaaatacatttaattttaaagtagtgataattttagtgtttctgtggaccagcagttttcatgtattacctgtaaagaaaaatgtactttggataaaataaatagctgtagcagcatagtcattgtcacacacagacaatgtgtgtctgtgaggtattattctctgttttttcccttgatttattgatgtgatttcacatcatgtttcgtaatgaggctttacgtcaggacattttgctttatgattttaggatatgtagctcacttttaaatggctgacggatttttttcttacacctacattcactttttatcattgataccttctcaccagattacttatacaaatcatcatgaagcttttgatgtcagtcagcctcatccatttatgcatctactaatttgtccattcactcatttatccattcaaatgtttattgagcagtcgctacaatgattttatttaggtaaccatggaaaatgctaaagtaactgaaggtttgctttgctaagattaagaaattgctttatgaactatatagttctatacattcatagaacctcatagactttgtgcaaaagagaatgagtatttcagtagtgtcagaaatctgccacatcctgtggtgttatatacctctgtttatttaatacaagtgaaaaagtagattgtgtttctatagccatgattatacattatttaaaaatatagttcttctttgaaattcaatgactttttgaaagtgagcctttatgaattttctatcatataaagtttaagaaaactttatgtggtttatagtgggtgttgtacttctttccatccacaattattgtaaaatacacaaaggtttaactaagaataaagtgcctcttttcaagtaacaacgatttaataaaaatatgccctttctttgctcagtgccctctagcatactgtccacaaccactcttattgtcagaaaagatttcttcagtgtgtttgtgttttagctcagcagtaaaatgtagtgggttaaaaatagccacaccaataagtaatactgttgtcattttaatgaagaacatggccaaaaaaatacaacctataataaataaagaggacccattacaatacatgaatttactttcttgtagcctggaattgacgtttatacatagcataataaacattttgacttcacaaagctattttattcatgtataatagccatcatttattatcatatttatgtttttaagcaatcgattatgaatgtcttgggggtattttctgtgtgttttattggcaaatgttcatgtctatgttaccataaaatagagttattttattaaagggttttgtgttgtctacatacctacctggcataaaccaaattgatggtttaagttaaaagtacatttgctgtttggaacaatgaaatcataagtcacaaccaggtgatgatgtgagattaatgatcttattgatagctgtggaaaattaaccatgttctctgagttgtattgcctgcctttcttcctgggtatgcttttgcctttgactcagaactctagagagggacacaaacaaaacttatttgcaatttgcaaaaaatggaagggggaaatcgaaaggagggggctccaaaagactgtaaaattgtacagcatgagtcctctgatgcatgctgttttcaatctgctgtgtgccagttggtggcttggggagtgtgtgcgcgagagagaaaggataatgctgagaaatgatagagtggctgtgacctccaagctcagcctggaaatccaagacattgatttcacttagcattcctgctgagaaatctggcggagttcagttgtaataaaagaacaagattctgttctaatggtaatggcgtatgacagacatatcactttgtctgtcctcagcaccagagagaggagaattggagaaaggtcacctgacctgcctgtggtgttatacgagtgctgtactgagctttgaactgcagcccaggagcataattatttataatattaaatgataaagaaacctttagaggactcacagtgaacctctgaaaacggcacactggagttgtgttctgtaaatgtgaaaacacaaaaagaaatctggtctgttcaaaatctgcattcaagaacatgcatattgttgcttgttgagttacaggtccttgaacttactgtttgtgaactgtttgcactaatgcctgacatattgtcatgagttactttttcttttctcaatgccttggtttttttagtcccaagccaagtatgtgtatatatatatatatatatatatatatatatgcaccccccccgccatggtctatcttgccaaagactggatgatacagaattaagagcattgacagattttaaaaatttctcagctgttacaataaaatttttctaaatactcatacgcttgtctcttcagcaattatttaatttgttcccttttggatcttactccaggactatttttttcattgacccacaaaagcgaatatgtttagctcttcgcagatattattctagctcttgtgtgtcctaacagctatgtttatggctaaatgttggcaaataagtctgagtgaaagtataaaaccttgaacttttatgacaggagatcctgtttaatgaaaattataaaaataattctaccttctcacattaaagaaaattatttaattgaggtattgttaagcagtattgacgtttgaatcacatatacaataatgttgctttgagtctgcttatggccttaacaaatgttttaattatttgcttgtagtttaactttctgccacagaatgaaccaatatgcaatgtattcagcaactttcatttttgcaccacatatttattcaaatgaatttccacatactttcatgtagtcttttaagagactagatgacctttgctttgttatagtaattgatctttcgatacatttgttttctaagaataaattatttcttttaaatttaatggaatcagtatcaggcttaaaagagttattttaggaggaagagtatttagactcagtttcacacacagctcgtataattgttagttatgaataggcttatagttctgtgttatcaagaagtcctcaaatgttataggtgtgctaaacatccaaacttcacattgtaagtgttctgccattgtaaaagtagctacctcttgggaaaatcctaagagcaacttgtaaatactattaaacctaccttggtgtttgacggaaacttacatattgcctgcagcagccaagaacagtcagtttaaaaagctgatgacaagagagaattcctgggtgcttttcttttaaccttgccgtgaccctggtcataccccaagtcacagttgtgtttctatcaatggcaagagcacacagattgtccgaatcaattttttgttcttttcgaatacttctgacagtgatgttcccatttgctcagcagtagcacctgggagtatgacaaggaaaagaaatatttctccgacaagccagaaatggccctaaccagctgaccagacacaatcagattctttgagctgcactatccttataatgttgcttcaaattcagaagcaaaaactggaactttattgttatctgagcctctttcaaaggcatagtaaagattttgcccgatgtggtaccatgtgtttctgttagtaatatcagcagtgccgatgactcctattagggaacctatttttttgctgaaatggtaccaatcacatagtttcacgctatcaagtaaacgttatatcaatacacactaatctgcagggtagaattttgtagtttaatactatgagtcacaatttgtggtacacatacacaccagattacttagcaatatgctagcagtacgagaaatcagaggataatcaaaattcatcttgattgagaattagttctcacaggagatttgggaaatgaaagcatttttggtaatttgagacaatgttttataatgccaagtggggaaaaaggcagaatacaaaccgcacatacagcataatcacaaccaagtctacctaccactaacacaaagtataaaactttatttttaatattgtgacaaaaaacatctgttaaagatatagcacaagagtggccgggtgcgttggctcacacctgtaatcccagcactttgggaggccgaggtggatggatcatgaggtcaggagatcgagaccttcctggataacatggtgaaaccccatctctactaaaaaatacaaaaaattagccgggcgtggtggcaggcgcctgtagtcccagctactcgggaggctgaggcaggagaatagcatgaacccaggaggcggagcttgcagtgagccgagatcgcgccactgcactccagcctgggcaacagagggagactccatgtcaaaaaaaaaaaaaaaaaaaaaaaaaaaaagataaagcacaagacaacaaagagacttcatgagtttgaaatggactaggaaatgctaaggcctccacagcaatatttccatggtgaaaagttcaaaaagcactgctcaatataaccataacctcatttaatagttttcacatttcatctgaccatgtgaaattttgagtggtagtttctagaggtgttatttccaatatgttaaagttttagaatactactatttgacttactctgagagcttttcaggtcaaaatctcaaatcatggcttactacacagggctaaaactggtctgtgaatgtagtatttctaagtaattcacagtgctgaaatagtattaataaaagaggagccgccatttatctctacatatcagcatcaaatcactgatccatcctgaaactgttgggcctggtacttttgtagattccatttctcccacaagttcaggacagaaaggggtattagcctcagctaattataaccgcatttaaattgaccattttctaatcttaacagtatctggcatatcacttaaatgctagaatctccttaataaattattctgtattctttgttaaatagctattgaaaacctctttctctcctttatttcagtatctgtgaaataactattttgttagcctttgagatgtaatatggatgtgtcatatactcaagaggtgaattcatctaagaagaatcaccccatagagttaaactgcaaatgcagcccattatcattatcatcacttcctgggtgggacatatttacagtggatataacatagttgccctgtcattttaaataaaatagttttctttttgtggttctgtgttgctacatggaaataagttaaatgaaatgttatcaacagaacccctgtgatgagcctcctcctctccttttcatctttattcagttgatggaaatctcaaacagctaggtacttaaacagaggcttttctgggctctgtggtattaaatgtccaaatagatcattaggtgaaatattcttatgatgcagaaagttgagggttggtcacatttttaccataaaaacaataaaaattataaaagaggctagttgtaatctcagcgttaaatgaaaaaagcaaaatatgcagaatgatttaggtaatgtcctttgaattttaccagcctgggctgtgtatcccagtatactgattttgttttgacagaaacatgtctcatgcacacagcatggtgagccatgtcaaagctttttaataatgcaaaccatggggaaagaagaggatgtggagcatgtgcagactcaggaagatccacagaatcagattttttaagggaaacttggactgtaaagtaggtgcaacccaaagtagatttcaccatctaaaaatctgtgtgtttgaaacattgtaatcaaaaacagcaggtagttaaaacctaagtcgtttagggaaataaaaacaggacaataagaaaggatgtctgggtatagttcaggactttgaattatattctaaatatattcatttttaaagataaatgatatattttctacctgtcacactacttatctagctattgttatctgataaaacctcaatgaacatcatagctaaaaatgctaagtcattattgtgtcagagactgagaaagcaaaagtacgtttctgtagttactcttttttggggggaatcatttataattttgacttcctaaagcatactttaaaacagttgaaatcttttattttttatgctaaactattgatcattgcctcctttggagctgtcaataatcaactcctttttatcactttagccgtcacctgtactggaactgtttggtttgagacttgatacgtgaaactaaggaggactattcttaatgtcagagttggttccctctctgtattaaatatatgttgcttacacattcttacttattcataaaagaagaattttagcggtctctcttacagagatgcctcaaagtataaatttgtttgtaaaatgacaacaattactgatgtcttatttaggttgatggaaaatagtatatatgcaaaattattcaatagattttatctagattttccactagagaaaataaagaatactaatagtatttttaaacattacgaaatggagagcagaaagagaacgatatactgactacacagaggtagacatgagggttggaaaatagacatgtaatattctaaactgaagagtacttaaaaacccgaagtactcaaaagttgtatttgtttgataaaatgtataagacattttatttatagaggtatgtaagcttaagttggaagcccagaaggtattcagtccaagacacaataacccagtctcaaggtaactttgcttctgcctagagtctcgcaatatcaaggagtccaccagttaatgagacagcattgtcttattcagaataagtcttttttgttattttcttcattgttatggatttaggagtacaagtacagttgtgttacaaggatatattgcttagtggtgaggcctaggcttttagtgtgctcataactggaatagcttgcattgtacccaacaggtagtatttcagaataagccttaatatcacaatgttcttatttaaagagaactgaaagcatctttccaggactttttcttgtggtttcactgaataacaattacattattcagttctctttcagttgcaagtgatagaaaatggaagtacattcggtcacattttttttttttttttttttttttttttgaggcagagtctcactctgtggcccaggctggagtgcagtggcacaatctgggctcactgcaagctccgcctcccgggttcacaccattctcctgcctcagcctctcaagtagctgggacaacaggtgccaccacgcccagctgatttttttgtatttttagtagagacggggtttcaccgtgttagccaggatggtctcaatcttctgacctcatgatccgccggcctcggcctcccaaagtgctgggattacaggcgtgagccaccgtgtccggcccacaatttttttttaagaagttcttcagatttcatgtgtggtttaatcaggatcccaaacaatatcttacagagttgatttgtatttcctagctctgctcttttttcattcttaaaaggatggtccctttttagtgttctatagcaccctatgtttacatctaccattcactgattcaacaaatattatttctatcatatatcaaatttaattcaagccagtagaactacagctgtaaacaaaacagtagtactcttacaatttcacagtgtaatggggagaagcgaactatgggcaattaaacaaatgggtaattttgtgcatgctaagtgatatgaagaaaataaaacatggtcaaagatagtgtgctggggacaagaaagggaatcttcttgggagagagctttaagggaagccctctctgaaatcgtgaaaaggaggacacctgtaaaggtctaaggaaaggttattctaaacaggagggaaagtaattgcaaagactctaatatgtgaatgagattagtgaattcaaggttcagagaaaaggctggggtagctaaagtgcagtgaacatgaaggagaatgataaagagtcaggttgggaaatgagaaagaccagatcctataggattttttcatgttcaggactttgaattatattctaaatatattcatttttaaagataaatgatatattttctatctgtcacactacttatctagctattgttattatgtactcattgtcttcctctcttaggtattatgtctttgtagcaaaggaatttttttatctcctgtgccaattaattaattaattaatattttaagggcttctacagcactcccttagaaacatactggaatttgagccccagtgacatatcctggatgttgctgttggagagacgtaattccacaaatatttgttaattgcctgtgatgtgttggagtcctaggacctgaggatagtggtcaacagtgtagatagatatgtgtgctcacgtagcacagtgtataaagtgagggatatgaagaagaatgtagatagagacaatagatatagttgaagaagggcagcaagtacggaccaggagtgtagattcaacgcagaatacttcctgttttgtttttttttttccagattcatttcatcagcaggttttcgctggcaatataggaaaacacatacagttgatagtacctgtcaccacctatgtgaagcaagttacaaagtcaactttttagatgatattttgacactaacactattacatgagtattcattttaaaatagtcagcttaaaaaactataattgctacatactagtgctcataagagttttggagctcttgttttacttaatgccttttaagtagataaacaagtcacataagaaaaaacacccaaatttctgattagtgtggtttttgctttcatatatgtttaaatcccacttccctctctctctctctccttttttctcttccttcttctctacctctttccagttagtatatgctttttaaaggtcacacctcctgtcatataaacatgcaacgccacctgcttaacaaagaaaaacaccaaaaacttctgtaaaacttttataaaatttatttaaataatgttattttcttggtaaaaaaaattatatcatttatttaaacatgtactttcttaaagcacttaatattcaatttatattagtgagattgatgagtttatatacaaagatctaatacatcagttttattgcattatatttcataaaatgagattcttttcagttttacctgttttcacattcactaatgtacatacaatatggtagtggcattaactgcacaaagctagtgtaaggagcaatagagattattttaatccagagcctatccaaaatattataagaaaatgaggttctccatcattattcatatggtttctcattactgctaacactcagctgaagaacccagtcattcttaattatggtttttaaaacaaagaccagaaattgtatgacttgattagtattaaatgtgggagaaaaggtcttcaacagatgcagtggtataatttacattacctgaattgtttagagtctgtgtaatatgatcaggggaattcgtaggcacatattccttgtcttatgtattgtaaagttggagaatataggaaacatgaactacctatttgaaatttagaaaaactattttttttaaggaaacagtaatttatttatttatttatttatttttgagacagggtctaactccattgcccaggctggagtgcaggggcgcgatcttggctcactgcaacctttgcctcccaggttcaagcaattctcctgtctcagcctcctgagtagctgggactacaggtgcctgctgccacacccagctaatttttgtatttttagtagagatggggtttcaccatgttggtcaggctggtctccaactcctgacctcaggtgatccacacgcctcagcttcccaaagtgctgggattacaggcatgagccaccgcgcccagcccagagtaattttatatctcttatttaaattgaatatatatttgaaattttgtctatactgaaataagaattttgctcattgaaatcttcagcttatcaatattaaatttgaaacatgcactctcaatggttcagaattattgaatattgctaagaaactgattatcagactgctgcttgaaaaataaaagtttctaaatatcaagaataggtaggaatttgtcgaaacccaagtcatataccaggttgtaatgggaagaacatgctccttttctagtcctgaatctccttgtagatagtatcttttgatgcttcttagaattacacactttgccttgtgagctgcaggacttaaattgcaatatcccacagcttttagcagttgcattttcaaatgtgaactagctgattccattgggtgactttttcagaacccaacagtttaagaaatatgttttatcattttggtttttaaaaagatgaggatcagacatctaaatttatagaaaattaaaagaattttcctttttcgggtcttatcagaataatatgaaagaaaaaatgtatactcaaatagataaaaatgtattttctttcaaattttttaccaataccaagaaagtctaataacctcacattttcacgaaaccgcaaattatattttcttaaagctctgttgtagtgctttgcaaggccagttgccagcattggtattctgtgggagactttcatttaaattggacctttaaagaaccaaggaatcttatttttttttactttattatataatttgaactgttatgatttgctttacaattttgatgactttggcagtgtagatatttcataaataggagaaaaataaattgagaccagaaatagaaaggatgaaatactacaaaaattcttctcttgtggtatttccagtagcacttcaaataacataagaaaaaaaatactgttgtgaagtatgttttaagaagcattgtgacagcaacaggaatgtctttaaataggtacagatttgtgttttctatacttctctatgcaactcttctgaggatcaaagtttcactttaagccagtgggagctcaatattcaggtcaaccctacatgaatacagggcaaggcaagaattttgggtcaaatgatggaatttttagtgccagttttcatgcaaatagcactgtcgtttctctaaaaaatgatgattctggtcccattttaagagaacctctaggtaatttgtgtttgttttgattttgcttatctttttctattagcattcattaagttacactgaactagaattctgatctgttctatccaggactataatttatggagttacaacaaaataagtgaagaagatatcaattctataggatggaccacattagaaacatcttctatcttattgaattttaagtagctggcccctaataggctcttaacaaatgtacacctgattaatgtttgcattataataactaaatcttaatattaattgaaccctagttatcatagtttgtaatatcattttcactgtttcaatctttgcaaaattatgcttactaatacaacacaatctaagagaatgtgtctgtataaggatttttttaactgcagtaatatgctttctagctattgttaaggtgaacttttgaacatttgtataactatatatttttttagaattgagcacataaaataagacattgagaatttaataagacaaaaagaaataagattttttaaaaaatattttttcaaaatatgtttgagtcctgctttaaaaaacaagatccacttagaatagatagttaataaaatataacttgtcataaatgagttatcttctactgggtaaggagagatgagaatgttttccttgggaaagagacacgttgtttatctgttccaagcaagagacattacattttgcttgaaacaaagcaatacgttgtttatataaatttttaaaaatcatgtaatgactgttattcacagatgagccttctagaattacttttagaagatgtcaaaacaacttctatagaggattcttcagtaaaccttttgagcacctctaatatgctggacactttggtagaataaaaaaagaacagcaattaacacacagtacaatataatggggaaaacaaacaagtaagccaacaattaaaatactgtaggctaagtgctattcaaagaataatatggaggtaaggaagaaactttgtaacataacctggggagaaataggagaataaggaaaagggttccagaaggtgtgacatttagaaggtttttgaaggaaaatggaaacagtctgtgcaaggacacataggtatgaatgaataaaaggttggattttatctgaattttggagaaagaaacaaggttgagtgtaatacatctgtagaactttgtgagtgaatttaagaagaatgaaaatataaagatacaagtgtgtaaaaaatgaagtctaacttccttagcatggcattctgcaatctagccccacctacctccctagcctaattaatacttctgcctttctcccagttccagaaatgtatacttcagatgaaatcactttctcaggtatcatgctatttcaattatttttgcctatgtttgtgacactggacctctctgggttgcttctgccctgttcatttcacttttctctcttttttagcaccactagcaatataatatccatctaaaccgtcatttctatatagaattctaaatagaatttgctgttacattgtatgtcaccccactgcacaaacacatactccttgaatagtatcaaagcacacttataatacttcattgtacttgtcttcctttgtatgatcctcagtcccatgagggtagggattatagcttaatcatccttagcaccaagcacaatacttggcttgtaattaatgctctacttcttttagaagaataaatacatgatcaaaggtcaatggtttggatcattggaagataaggcagtatgagtagaataagattgtacctaagaaaaatgaaacaatgttatttatacaaaacgactctgaaatttaaaagtaagatttgttcttatttaacctgtcagtctaggtgaaatatactgaatttaggaaatatgagcctttgaccactggagagatattatctatagtgaactatgccttacttcccagcccttactgtgctttaaataaagtattcgccatttacctctttttgccctggttctgattgtgaaattgggttttttagatatcttgaaattaggaaaggtgtactgtagaaaactcagcaatatttaggtcaggtataaatgaattaattggcagtctgttttatgcattacctccatgagtttgtttactgtgaatacatctttaagtgagtggacctcccttacataagctgctgaagagtcgagttgatcctgaaatgaaaggcacagcctgtacaaatattgtccagttttgttatattgtttaattgatagttcaaataaagttttaggatggaaaaaattgtatttcattttgtaaggttatttttctctgcttctcttttatgcaaaaaaaaaattatctcaaaaatggcagagaaacttcccacccatacaaagacatagtcgtttatgttatatgtatggatatatttatatgtatgcatagtcacacatcacttaatgatggggatatgtcctatcattggtgatttcattgttgcataagcatcatagcatgtacttatacaaacctagatagtataggctactacacacttaggttacatgatacagcctattacttctaggctgcaaacctgtacagtatgttactctactgaatagtgtaggcaggtgtaacaaaatggtatttgtgtatctaaacatagaaaaggtatagtaaaaatatagtattataatcttatgggaccactgtcatataggcagtccatggttcaccaaaatgttggtgttcctatacagtacatgaccatatatttatatgtgtacatatgtgtgtgtgtgtgtgtgtgtgtgtgtgtgcactatcccatactacaataatcaagaatacagatcaattttatctggcaatgtgatggaccaaagcaacattcaaaataagataagctctaaggcaaatatactcattttgtctctttaattctttctaaaaagtatgatcaaaactcttgggtaatgatgtcattagagttgctatataaagtcttttatggaattcagactgtaaatttattattcttttaatgttatgggctgggaaaaattaaacgagcattacagctgagtttcactacacattaattattttaatggactatttcttaaatgaatatctgataaatcaatcttgcaattcctcatgctttatgacatgcttgacacagtatagacacttaagaatcattattctgtgagagctttgatacaaatccaaaatcgttataattaagatcaaactcttacctgatgctcagttctaagccttttctcatctttatttgaattttctttcacccataccttgaatttaatattatagtatcaataggcagaatatatcatcaagctaagcatctttaatatgttgagaaaaaatattttgtctccagagcataacataaaaactggccttaactgacattctgtataaatagtcatcaccccttggaattctttaaagacatcagttctctcctggtcactgccatgaagacaaagaatgccttaatgactctattgaggttatcattaaaataaaggagatttgcagacatcagctataaatcactataaaatggccggtgggtaacctttgacacaactcatttgaaataaacctgggatggattcatagcctttggccgagccagtaagtgggctaaaggtcttttccatcctctccttcacttctttcaatattagttcctctccaagtgactggaaaggaattggatgtatataaattgacatgtgtattaagttgaaggcaaataggtctatataaataatagtgttaaggatgtttatggtgtttattcgaaatatgtattcttttgatataaattttaggattatgaatacattttgaatttatcgtagctactttgttaaaatactttatgatttagtgtcataaaaattttgtgagggtctcgaccagtattactcaaattgaacattacaaggtgcctatctatgggatagaaaaaattcttcagaattaaaaagaaattacatgattgcagtctaatttttcaaagaaattattttttaatgattatttttcctattggcatttaaataatagagaagcagctttgaaaagttgcctaagcttacacctttatgacttgggttcaagtctgaggcttctttaaggtatgactgttagcaaatttttgagtatcttcaacctccttctctttatctgtgaagtggggttgatgatatctcgtaatctttctgtacgaataaaataaaatatatggagatgttttgttacttgtaaaatttagatgtcaaggagtaaatagtattagaaaatcagccctgaaaagtgaagagctatataataatttaagttatttttaaaagttagaagtttttaggttatgaaacccactaaacatactttcatagttttgtaatgtttaacttattcttcaaaatgtttgtgtaacaaatagtatattgggctttaagtatttatttcttccttaaaaactagctctctccatgacaaaattacattataaaatcagcatttcttttggtgtagggagaagttctcaggtaaaaatatataaaaaatatataatatataatatctgtatttaaatagacctatactgtgccttttatttattcactaagaggttaattatgagagaagaaaaaaggaaaaaacactttaagtcaatcataagtgacaaataattgctttgatgaatatgttgaggaggggaaataatctttaggtcatttctagtaaaaattcatctaatcaaaaaagcaaatttttgagacttaatcttccaacaactcatgcccttgatatatttttgtaagttttcagactcttcaagaaaaaaaaaaaagtggtctaaggattcacagaataaggaaatgataactttatgaaaagttataaaatttaaacacctaatatccagaattcaaatccaagaatcaatcactttagtgacaaataattcaatctaaataatccgaacgaaatgaaatgcaagaatttttttttccccgtaaaactcttccttcatgacattgttttagattaatcataatgatatttatttcactatcgaagtttcctagtcacttacattgccttaaaatgttttctcttctagtgtatagatttcttctgtctcatgacctaccactctcttgggaatagtgtttgtggaacaaattaaagaattaacctaccacttgggggaaaaacaagagacaggggtagatggcacaactgttctaattttgtgttcataaaggaaaattgctaattaagtggccttgttgtcttactcgaggttcgtgatcttgtgctaaggggaacaaaaatgcagacacatacacacggagtgggtttaagagcgtaaagtttaataggcaaaagaaaggagggagagagagagcgcgcttcctcatgcagaggaaggggatgttcaagcggatttctgggtttggggagagatgtggtccattttatagaggggcttaaggaggccgtatttgattcacatagggcccaggagattggattgaccaggtgtcaggtgtgccatttacatagcccgtgaatcttttattatgcaaatggggtttacctggccgttgccatgacacccacacacgggggcgacaaagagaagagaggagatatcctccatgttgaatgtacctggcttctgacatagctgccggcatttacctatgcaaacttctagcttgcttatctatgtttgcagcttgatttctcagggtgctttttgttagaaatgttttaggggctgctttttattaaagaaaaattccactgagaactcctttaacctcactaactgcctaaataatttcttactaactcctatatcactattactgtactgctcttaacctgaacagtggaactcagtctaggttaaagcaagtggagtacgagaagtgagttttgcatttaaattttatttttacttatttttggactttttacctttgtcttcaatgactgccccctttcctctatctgtaatgaatggaatgaaaaaagttgtagtttggatgtactgacctagtcaagtctcaagttacgttaataggaggaagcctgtggctaaatagttcctgacaatggctttgttagcagacatctctgagtagaaagcagtgagtcccagggacatcaaactttcaactcttaagaggaaagcaagggagcaaagttctgaagactgagaagaactgaaattcaagtggtgaggagaattcattacaagagatttaaatatggagggatacattttggtagtgcatatgttcctattctgttattcacaagtcaaaatcacatttgctcgatgtgtatgtgcattgtacgtaaacgtaaataacctttgaaatgctatattaaaaacaataggaaaaacttagaatttatcgagttagttattgattaatctccactatccattaacatttagtagttaatagtatctagtaaatttttttctattcaaggtatatgtgggtgtaaagagagtactcagatcactttaaaaatgaaaattgtcttaaactgtttgaaatttgattatttagccacgagatgttcaagaaaacaacacaataaaatgaaatacagtgatatgaatgctacactcagtaacactagggtgctgccttaggcttccctagccttttcttgcttagtgtctcattctaatgtttaatccattaaacacacacacatacacacacacacacacactcacacctgtccttctccaaggttctgtgccttagacaatttggccttcactcatctcccaaatataaaccaatgcatggtttatatcagttaactgtcgtaactgtcattactcattaaacagtcagttatagtgggttcaccagactgttggagatttgtgccataggagctgtgcatgcatgtatgtgagcactgggaatgactctttgatgtaattaattggagctcgtaataaatgacttatgcataatgatgctttctatgatttctcccactctgccaggttgttatctaaagatggcctatctgcgtataaccagaccaaacttttcaaagatctgagaaaacataaatctctcagagagccatagatatatttttaaaaaggaattttggagccctctgggagtccttcaaagtatttcattttgttttgtttcaggttcatcagtgtttcattaatattttcatcagtggttttttccccccgtcaatgggctatccgtgccttcatgtggtatttttacttctcttttatatgactccagtggatcaaaccttctaccactgatttgctttgatgatgatgtgttgttgtgctttccttttgatagtaattccttttgtagattccagtagagatgctgatgtgctcattttgtacatttaggttcaggtggaagtaccatttccaacatagagatgatagtagaatttgatcagcatgacttctatttctttgttttataaagtcgtattgctctgtgagctcctgttttactttttttgttaatctattccatcattaaacagttgtgtagttcttggcttatgtttgtatacaaatcttccagtggaactaacaggaaagcaacaatgacaaatgctttgtaattataaatttaaggacttatcaggtggtgtcaaaaacacattacattttcttgttcaaggagtgatcaactctttaatttctctaaagcatttttaaaagcttttggagatttacatttagaggttaaaaagaggaactggtgtgattattaacatcaattcttactgctctatgcttccttttagcctcttggtagaagaactgttaatcattttaaaagataacagcaatcatccagccgtaatgaacactataggacaaaataaccattattattaggaatttgaagttgtctggggaccagaggttaaacaaagttgaattggaaacaccatacatttcctactggctcatgttataactgttctcatcacacattattgttgacacgagtattcctcgcattcttcctcttttcaagaatagttagaaaagcttactctgtggaatttctatgagtgggttttcatgtgatattgtgggttaaaggtcttccaatatgacattcttcttggtaaatatatggaaactgtatttatacagtatatttataggacattttggaaataaaaagtaagattagatagagagttaatctaaaatgaaaaattcaaaagctaaattagagatcttaaagggaaaggagaataaagattaaaagagaaggaaggaaaatgtaaaaaggaatggtgtggcactatttggattaattcaaggcaatttttgaaattaaaaagtgaatgtgaagtatagttgatatttcagaagccaaactattctttatttgttttcaaatatatgtgtgtgcttgcgtgtataatttacagcatcgaggcattaattcaacaaagtcggaaaacaaggaaaatattaagatactaagggaaaatgagcagggggcattttaaacagcaaataaaatgatgggtactctttgaatacctttaaattaattaagggccagcaaattaaatgtaaagaaacatgtaattaccacattgaagaacatgtccccaaccacactactagcatctacttttaaaagaagcaggtatacattaagcaaaagtgtaaaatggcaaataaggaagccaaatgagatgctagaacatattaccctcagctaaataagacttacatttaaatggccatcaagtctaatggtagcattaacacagcaaaagcatacctatcaaagaattcctggagctctttctgcctgattaacaaggcattttgcaatttgtaagtctaaaagtaagcaactgatcatgaaaaggggtttcaagactatgtgctatgtaagatgatagacttgatttttaggaacctactaataaggagttgggatggctacgcgagtaggattattaattccttgaagactaagaaaataattttaagattgttgcaattatttttatcttaggttactttgactcttgcacgtaaatataaaccttttctcctttaagttctgctcagcaggtacacttccatctctttatagatcctcatgatacttgtttgttttgtttcttctagtaaacctctatggagctgtagtgaagaaatgccttatttgggtaggagaggtgaaagagggctcccacagtccatagaggtagaagacgaaagagaaaggatgagtgctgcacacaagctagggaagaggtgcggcaacagtgcacattatgcaattcaggctgtcatgtaacttccctacttaggttaatacgatcatttcatcagagaggataatagcagcagcatgattaattttgcaacatgtttcatgaatgcctttactcatccccatatggtattactgctacttatttcacatgagtatttatgataaacatggggacaatcacagttttcaaatcatgcagaggaagaagcctgaaattttatttatacatatatatatatatattttttcaatcattgtgtggctgttgaagaatcaaagtgtttttataaatgaaacattatattgagtataaagacaaactgttctcaaaggagtttaaaaacacacacacacttccacttaaatctatacctaggttttaaataaaaagtaaatggacttcttttctttattactgatcacataaaaccaaagcctcaaagctacatgcctaaatgtcctttggtttatgtttttctaatgcctggcatataatagccattaataaatagctgaaataccattagataaataagatatggatgaatgtatggatgattggataaatgcatctgttcttatctgttgcctttagactggtataaatatgttaactgccaaataaattttgattttcaatcattaatttaggtaaatatttgaggaagtgcaattttgagatacctgtgatatggaatgaaccaaatcatcaattagataaaatgagaatgaataaagatgtgaataaagatgtaaataaagatgaaatttatattctgaagggtttaatcatttgcacgtccttggtagtgcattttgtggtctagcaacctacatgtgggtatatttccatgttgtgaggataagaatagagaaacagaaacaaatagaattctccaggatgattggatctctgttatctagttctctattaaaactccttaacaaagacttgaaaagctaaggagtggggagagagaaataacaccccaggattgctaagaatgctttttgtttgttaaattatgtttgatttctctaaatcatttggtatttgtacattataaaattatgactattatacaattatgttacagtaacatattttcttctaggataaattgttatttgaaaaccaactaaatgaaatatattgtaactttatatatttattttatagtgtttgtaaagtttatgtggaataagtttatggtgacaattggtattccctcagtgcgtctaaggctacatatttgtttcacattctttatgcaatggttttttaatctgttgcaaattttcattggctgggattaactgattaaggcctctatagtgtttctactactgtgaccacaaactggtattgagatgttagctttcagacaagttatcgtagctataattatgtaaatggaacatcccagacctatatgtttatttggattttacttactttgcattctatcccagaaaactacaattagcccagtaattgattagaagaagttatatcatgagtgagcttctaagacttgtatttgattatataaaatattattttcttgtaccatgtgtacatgaactcttgggatttttctaaaagaatagtccaaaccactctttagcattaaaggaaattttcaatgctatatagcatagaggtcagagaagcacaaaaaaagtcaccaagataagtgaatttgcgccttaactttttaatgtatagaatagcaaatgtttgtattacatcattttattgcacatatattatctttcatgtggttattgtgtaacagaattatatagttaggactgaatttcagaagttatattccatcagtgcctttttaaatttaagattaaatttgtcacagaaattaaaagagtattgtatgttgagtccaaaaacctgggtttcattagaactttctaagccttactttccaccacaagatttgtaattacttcatagtcgtgaagattaaataaactctttggaatacttataatgaaccctataaatgtaaattatagccttctactagttaaaatttgtttagcttacacatttacttaaacataaatgcttattttatatttatgatatacaagtttggagctactaggcagataactaaattcttaactcttactttgtgtataaatgaaataattatgaaatatgttattttcaaaagttccaattggcaacctcatttaacaattaggcaagtaattaacaggaaattgctttgctcactgcttgatggtgtagttgatagaaatagtatctttttcaattatttttgaccttgaaaattactcatatccttttatttgtaagtaatttatttaacatgtttaaatgtgtgttttatttgtaacaataggagttaatcatgttaagcttttgaatttctcctacataaaattacaagtaaaaaacaaagtaagagaagtcttaccttcagcttttattgcacatattcatattataagaatgcatgccagaaataaattgtccatgtccattttatagttaagatttttaaattttcatctagtcaaatgaaaaataattaatagaaaatgggaaactagtgtaatttttgtattcttcataaataataggcatttggtatagcagctcagtagtaaattattaaaagaacaaaattgcgaaataatatcatataatgggtcaaaattatttatacagttaccagtataaagatcaagaatgtgagttcttattaatataccattagcctggtcacacaatggaagagaaggaaagggcaattttgaatgacatttatatcaactttggaactgtcaacctctgttatgtccttggggccttgcactttttggctttcagacatctgtgctgccttgaatgtaggtgaatactaagagtttcagtgggtctcttgctctaataaatgctttgaatagttatctttcagcatgggcatgtaatagttattagtgcttaaagctaagacatatgacacttcatcccatgagcacccacatccacatcatcttcatcaataccgccattcccccctcactatacactcacactgtgtttcctctgtgctcataaatatcttccctgttccaactctgggaatacagtcttttctctttgctttctttttctttgctttgctttgctttgctttgttttgtttctttttcttctcttcacattcaagtaaaacagccatctttgatccaagcatctcccaaaacttttgcaagagttatgatgatgtcaaaaagaagttctaaaggcatcatgacagaagtcagtttcacacagaaggtagtaaacaggtagtatattgctaggggaaaacagtgcctggaatatttacagctgggtagtaaatagtaaagtccctgacagtcaggacatttaggcttaattgaccaagagtagatctggattctaatctttattttctcatggaatctcagtaacattcaatttattatgcatatgagtgtttccattattagcatgtgatatgtcccaattatattttaaacactgaggtaatattacatatttttaaatgttatcttcttatacagaagaagctttttaaaggcttttggaagtctaataaaactttttcaatagtccccctttattttaatatacgaggcagtggctcttacacttgagtgtgcatcagaatcacctgggaatgaaggcttgttaaacacaggttgctgggacccatccccatagtttctatgatagagaatttgcctttctaacaagttcccaggtgtgcttatggtgctagtctgtgagccacatgttgagaagtattcattcatactagattaaaatgtgaggacacaatacttccatattgctgccaattatgacatcatatatatagattatggttgaacaggtcatgtttcagattgaacaattagggataatattgcccctatagtttttttttttttttttttttttttttttttttgacacagtctcactctgttgcgcaggctggagtgcagtggcacgatctaactcactgcagcctccgcctcccgggttcaggtgattctcctgccttagcctcctgagtagctgagactacaggtgcatgccaccatgctcagctaattttttgtatttttagtagaaacaaagtttcaccgtgttggccaggatagtctcaatctcctgacctcatgatctgcctgacttggcctcccaaagtgctgggattacaggtgtgagccactgcacccagccattgcccctatagtttttaaaatgctaaagtaaacttctccaaattaaatgttgcatcagtgatggaattatttcacttcctgtcaagatcttatgaatcaatatagatttggtataatagtctttaatttcttacttatctgacatcatagaagattgctaatttgaattgtctcatgaattttcaattttttttttctgaaacagacaatataaactgaaataagatctattacaaaggtaactttttcctagtctgttcatgggattcttaagtgcacataaccacagaatcaaataataatctaataatattaagccacttaaaaatatagacttgaggccaggcgccatggctcatgcctgtaatcccagcactttgggaggccaacgcaggcagatcacttgaggtcaggagttcaagactagctggccaacatggtgaaaccctgtctctactaaaaatacaaaaattagccggacgtggtggtgtgcaccacgtagtagtgtcccagctactcaggaggctgaggcaggagaatcacttgaagtggcaggcggagatcacgatgagccgagattgcaccactgcactccagcctgggcaacagagcaagactccatctcaaaaaaaaaaaaaaaaaaaaatatatatatatatatgtgtgtgtgtgtgtgtgtgtgtgtgtatatatatatataaacttgatatcgatgtcatattttaccatttaaccatttcataaaatgatttatttcagtggttcttttggtaggactgtgcattaaatttttgtatacagtaattaacatatactttaatgtcacctgactaccccatttgattaaaaatttttctactttcaacaaatcctgttattggtaaatattttatgttcttaactcgtgaaatagctacgtggaaactaaatttttattctacaataatattaatgtaaaattagatatattgtaaacgttgataaataaacaagtggtaagatattccaattttagagcacacgaaaggaacaaaataactttttcaatttccaatttaaaaagtgatataatgttaatattatctcattcttatattcttatatgatgtaatataaattttaatgatactgtatctataagtctcatgtatgaaattacctaagagaacgatttaaaattgagtataaactgtgttttgacctgtcaaaccatagaacagctggaaatcatcaaccatgctgaactgatcacatgatcttcgtgacacatatagtataagagaaaccaggtactgaaagagaaacctagaaaacacatctggattttgaaaacatggtgtttgtttagtgtttagaacagtatgacatataaataagttgcacatagtagggtgatgttaattatgtttattttcatttttagatcaaattcaaaggtgtttctgtgaaacctagggagaaaggattattttctaagaaagctagaaattttcttgtgtgtgcgtgttgaatttggagagcagttctgatcagaggcacacaactatctgtggtcctccatcatgggtgttccaggtgctctgcctaggtaccagggtacaaagatgcatcagatccaaccccttttctttggagattaaaaaaaaaacctacctacatcatatttcagatttaatgtgtaatatctctcaatacaaatgaatatagcacaaagagtagctttttaagaatatttcttacaggttacaaaaattatctgctttctgtgggtagttgagtacacatgtactttctcttatacaaaaggtattttgaatgtatagttgaaggaggcattatgttgacagctaagcaaatgctgtaatgttcagaatgaatgttaagatcactgattggtagagtaatttgatgggaaatgacaggctgcatacctgtgtttttctaggcattttttatcagcctttccttatcacagctcatgttctaatgatcattgcaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggtaagttctgtttcttttgttcttgctgattttctgtttatggctattgaatggaatcatctttaaatggcacatcacacccactctatacacggcttgaattctataggacagcttcaatttgaggaaccacctaggtccgttttaaacatgtaaatgaaatttctcactaaagtctaagttataatgccctcctgaaaatctaattgtgtaggttatatctatatttctaactatgtccatacaatataaaaagaggactaagtgactaatcgcagtgagcaatgatggttccagaatgttattgttaggtgacttactttttgcatcactgaaatttccattttttttgtgaattgcacaaagtatacattatgatgaaatgcattttgcctctatcatcaatcaaccataaggatgtgaagtttgttcagtttcgttctgtttgaggattacttgcaaacaccaaagtattataaagagtggatagcttcaattctatataattgtaaattcagtagcataaacaaaatagtagaaaacacttctataagctgactttgaaaaagtcaatgattttaatttcagcatacataaatcagactgcagatactgatttcaacacaggtttattgatatttgtattatttttattcaatttttaaggaggccagccctcaaggagctcatggtttagttaagggagagtcattcattctatggtataagtcagctataataagcgctgttgcagagcacagataaagttctacaaagagaggagagtgttggattctgtctgggaaggactacagaaaagtatgagttagatatatcctaattcaaactgagccttgaagaagagatagattcctaggcattctaggcagtaagaaaaaaatcacaaagtgaaatagcatatttttgagaaatgcactgatttgtctagattgtagaaaaaaatgtgtggtggaaagtgatcagagctaaaactgaaaggatcagatggcagaatgatgttggaattcaggaaaccattgtttacatgtaggacaagaataagttacatgagatacaaataaacaatgataaaggagagaatggattaaaaagattaatcaaggaagaattgacataattcagtcacaatagaatgtatctggtaaaggtcaagttgtagacaggaaactagaattttgaatttatgaaataacaaggattattatgcctctattaacaatgaaaggggagcccagaattggagcaggtttgggagaagaaataaaaatgtaatatgtgttgaatttgcagcacaaggaactatctaggtagaggtgttcaggaagaagctggaaatacgagcctcatcggtaaaagatgtgctagaattttagatatggaaattattccatgatgaggtggttgaactcaggagagcaaataagtccaccaaaaaaggctgtgtgtggtaagaaaagaagtggagtgaagaatcataggtattgcattagatactaatagataaataactaatattaatactataatatagataactaatgtattatttattgctgtgtaacagattaacctaaaacttagcagctggtattgcattagatactaatagatagataactgatattaatattataatatagataactaatatattatttattgctgtgtaacaaattaacctaaaacttagaagtagaaaacaaccaatatttactgtctcatttattattatttattgtttaacatttattattatctgttttctggtggtctcggttctttgccacataggcctgtccctagggctgcttgtagcatgacagtgaaccttcctgaatgagtgatccaagggaagaacaaagaaaaaggcacagtttatatcacgaaataacctgttctccaagttcatccagaggcaattctgctttattctgtttcttataagagaatcattaagtccagcccaactcaaggcaaggagaattaggctccaactgaagtagagagtataaaagtatctttgaacatattttagaacaactacactttttttagatgcaaaactgatgaagagtaagttgagtgtcttagaataagaatgaagagcaagtgggtattttagaataagagtgaagacagggtaatgtcatactagcctaggaaaacgaagtttcaaaaaagagggattatttaatagtgcaccttctgcaggacaattaaagaacatgaagaataagagccttaggatttggagttcatggacaggtagactgacagagaagttttaatgaatggtttgaatagatttccagttatacagagcggaagaatatgaagaaataaagttaatttggtgatataaactcatctttttctaagtttggtgttgggaagtgataatagtttgagaaggctaagtagagacaggttttaaaataggaatatgtatattactcttcaaggggggagaggaagaagagttagagacatgtatagatatgaaaaagtgcaaaagacatgtatagatatgaaaagtgatgggaagggattaacccttgtaaaggagaaaaacttttcttcttcctgagactgaaggaaaggaagagataaatggtaacatttcagagaaattttggaatgatcagaatgaagtctgaaggagtgtgtatcaaatgctttaatctccacaaagaagaattccagattatttgttaagaggaattcagtctgggcagtggggccacagtgaaaagaggaacagtgaaaactgaagctttgagaagtttgaaaaaggtttcagacacatgtgtgctttttcatcttatagtctaactccagttactctgctcagcatcctaaatgagctccaagattagatttactttcatgtactatgtaaaagaaaaaatattttatttggcaagaatcattcactatcataatatacatgtaggcttataaatgtcatagtgttagtacatgagcaacttttgtgatgttgttagaactggaatatgtgactagtagaataactaatatgtttttatttgtatcatgtatgaatattttttctttagcattcccaaagattaagcatgggaaagtattttagaaaggcaagaacatacttaacgtcatttatcatgactttccccactactaaaacatctcttttttttttttctgaaaagtcctttcaccacatacacatccctcataatttccaaggatttaagtctactacaatttacttttctcttttcaacaaatgcagatgttgaaagctgaaactttaatgagtaataatgtagttggataaaagctgtgaggattaatggtgttgtaaaggtcactcctgaaagaagaattaatgtgtgatgccattattaaaccacagaagactgtggactgaaagatgacttaagttatcgttaatcacatggggctctttgctatatatctattagctacaaatatagaaagtgactttttgaggttggtgaccaatattacagtgtattctataagaatgcttttgatatggtacgcaaatgataggcagctccaaaggaaggagatccttaaaaggtatgaatagttcagaagaatgatggataattttagaatcttttgaccagatgttatctttcccttattggctttttccacctatatcgaacatatgtatagcacttttaacttttttttcaaagcagttttttcatctattttctcactgcagctgttctacaattatagacccttaactagatggagtagatatccatataatctagtcaaagcttgttatttagcagatagggaacacagacctaaagagcctgtgtgtctacctagggatttgaagtaattttttgtcagagcgtagacagttctatgattctatatttattacctcagctttaattttaaggaaataaatgtacataaaaatctagtaacttatccagacttagagccaatggattttggagccttataaccatgatctattggttggtgttcattctttttagttgttgccttttggtagccactctgcattagatgctcttctcggccatttatcattttactcatccatacaataaatgagatttaaatactcttcctttgccatacgttttgcttagtctggaggataagcagacaacagcctttgactgagactttaggtgcctacagtctttttcctagcatatctttgggacatattggaatgtactgttcttagccttcattcctcagaggcattaacgcatgaaaactaaaactatacctgagcaaatgtagtaaatgcaaattgacccagtaaaacaaagggcaatatttccaagtccattaattggctacttgagttgtacaacatgccaggttaagacacgatgacttaaaggaggatattattttgaaagtttgttagtttacatttttattttatttatttattattattattattatttgagacaggaacttactctttctgttgtcccggctggagtgtggtggctggagtgtagtggttggctcactgcaacctccacctcctggactcaaatgatcctcccacctgagcctcccaagtagctaggactacaggcatgtaccaccaaaaatacaaaaatatgaaaatatatatatatatatatatatatatatatatatatatatatatatatatatatttttttttttttttttttttgagttggagtcttgctctgtagcccaggctggagtgcagtggcgcaatcttggctcactgcaagctccgcctcctgggttcacgccattcccctgtctcagcctccagagtagctgggactataggcacctgccaccacgcccggctaatttttttgaatttttattagggacagggcttcaccatgttatccaggatggtctcgatctcctgacctcgtgatccgcctgcctgggcctcccaaagtgctgggattacaggtgtgagccaccacacccgaccaatttttgtatttttttagagatgggttttctcatgttgtccagtctggcctcatactcctggactcaagggattcgcccacgtcagccccccaaagtgctgggattacaggtatgagtcaccatgcccaggtttttaataagcaaaatttatacaagggttttaatgagaaaaaccttgtttgcaggaaggtgattgaaggaatgaacaagaatattgtgatgcatggaaagccattggattatcaggaagttgtagatatcattcaaagacatctgacaattaacatttgcataacactttacagtttgcaaactgctttcacatgtattatctaattccggtgagctttcacagataaaaaaattgtctacctatcagggtgtcaaaaatgtaatgctgatcaatgaccacaaaaatagaaaaaaatatatttgttgaaaatcactggaaacaaatatgccattacttttacttacaactcctatataaaataaatacgtagtaaataagatttgtgtggcactaatatcatctgttaaattcatgaattttaataaacctgtaccatatggtccaggcttctattgataagaagacagaaattatcaatagatttggaattatcaaggcagatactttcaacttagaatgtgcatttatttcttcaacagatcctgccctgggccaaaggaataatagattgtactaaaaaatgctaagtagtccatagaccactatgaaagacaaatgcaagacaataggacactaaaaacattcacaaggttttgaaggaacacatgtgtgggaagtactcatcttgtcaaagaacatgtgtagggtatgtaagagaagttctcacagaaggggtgatgtttgaataaattcaccaacacaccagaaagaaagagcctttcagcgaaagagaaaaacttgggatacaggagtgtggagtgaaaggatgaaggcctgtccttggaaaagggggaatgttgtgtacagcttaaacgcaggacacatgagagactggcaagaggggacacaggaaagataagcagagttgacatcatgaggagactcttaggccttgtgaaagagtttgggacttatctcagaatgatgattttccaggaacattaaagagtttcaaaagttccagtaaaagctgcatactgtgatctcttgaagactcacaatgcacattaacatattcaggattttaaaaactcatgcaattaaacctttttaactttaattttgtatttcttacacttatacatggaattattttttcatgggctattacaggtcattatttttgaaatgtttcttgaagcactacggtaccagaggagggtttgtaatcagggatgttgacatcaatttttttaaatatacatagatagagagataaatagatatttttatttttgtctttagacagagtcttgctttgtcacccaagctgaagtgcagtggcaggtgaacatggctcattgaagcctctacctcccaggctcaagcagttctctgcctcagccccccaagtagctgggactacaggcaagcaccaccatgctccactaattttttgtgtttttttgtagagatgggatttcaccatgttgcccaggctgattttgaactcctaaggtcaagtgatctactcgcctcagcctcccaaagtgctgggattagaggcatgtgccaccatgcccggcatttttttttttttttgagatattcttaaatgctttatctggaaagagaatagacatgaattcaaagagtgtaagcctaaagataggaaaaccagttaggaggccaaggcatagtgagatatcaggtggctttcatgaaagcagaggatggagaagcaaatttgagagcgaggaagaagtgaaactgtcagggtttgcctgccttgtatctttagagggtaaaggagagaccttaaattactcccaagaatcggaagggcaactgacaaggtctatggaatatagaaagaggggactgaggccatggaaagatgatgaattctgtgccagacatgctgcatatcaggtactcatgggacattcaagtagagaagcttagtcaataaacagatacatgtatctggcaatctggaagggtttgaggcaagcagtagttattttacagttcttgggatcatttctcaattcttagagacatggtaaagaccaagggtggcatattggtttcctagagctgccattacaaattactgtaaactgggtgggttgaaacagaaatttattctcttgctattcagggcctagaaatctgaagtcaaggtgtcagcagggtgggttccttctggaagctctgaatgagaacctgttccatgcctcaatactgctgacagtcctggctcatagatgcataactccaatctctgcctgcatattcacttggctttctcccctatttctatgggtcaaatctctctcctcttataaggcaaccggttattggatttatggcccagcctaatttcagggtgatctcaccttgagatccttaattacatcttcaaagaccttgttttcaaaagaggccagagtcacagataattaagtttaggacttggatatatcttttgggcagacacaattcaacccattacaagtggttttgtattttattttctttccttgtatagcagccattactactttccttttagagtttatctcctccaaaattagactttctagtttgtcccttcttttctgcctctgaaaaaaatatataaggagactttttagttaagaaaaacagaaattttgagaatatttttggtaatggttaagaagaaacactgaagcataaaacatcaaattgcaggccaggcatggtggctcatgcctgtaatcctagcactttgggaggccaaggcaggagaattgtgtgaatccaggagttctagaccagcctgggcaacatagcaagactccatctctacaaaaacttaaaaagtaactgggggtagtagtgcccatagtcccagctactcaggaggctgaggcagaatgattgcttgagcccagaagttcaaggttgcagtgagctatgatcatgccactgcactccagcctgggtgagaccttgtttcaaaaaaaaaaaaaaaaaaaaaatcaaatcaaattatagtgaatttaacaaagttacagaatctcacaaatttcttacattaatgatttctaacccacattttccaaatctcatttgagatgttaactggaagttatattgacctttgccatctcattttcctcttaagactgaggttcaccaaacctctcctatacacatgccctcccatctgatcctgactttagatgcaattgttgcttgaatctataatgaaggcagaataaaatgtatctatcagataaccattatatgtctctttggcctttatggtctgacgcccatttaactgaacctctgtgcccgccaaggaatgacatcccctcacagatttcatcatgatagtcaaagccatgttaataagagtgctaagagtgaacatatagggaaaatgaaagtgtaaagagtaaagaaaggagtctaacatcttttcctgcctctgcagataccaagtgctatctcttccttcacatgtgttatttcatctaattcttccatcagctttaccttcattttgtagttaagggaagtgaaaacttagattgagcattaaaatttgtcaaatatcacacttaccaagaactggaaatcccagatgcagttgaatccaatttccaaattctgcttattttactatgccattttataaagtgacagttactgaatagctttcattgaccatttattatgataaaagatgatatttactcacttaatcttgacatttctgttatctagtgagtgttatccctatttaaccgaagagacaattgcaacttagaacagtaaaacaacttgtgtaatttatatacctagtaagtgtcaaagctaggattttaattcgggcttgcccagctccaaaacacatccttttttaataattggcatcttgaatcaaaatctaaggattaggtgaaggaaggatcccaggcagggataccaacacagaggaggcagtgaggaaaaaggaacaatgctaaaatgagattcaataaagagaggatggtcaatgctgtcattccctctcaagaaatggaaaatgtcctttggatttattcgacaactagagaccaattgcaacagaaacaagattgcactgagaactggagagtaaggagggaatgggagattatgagataatgtatctttgagaagcttgacttcaaagataaaaagagaaacagtgttggaaagagagggcaaaacaaggttaaagaagacactttatttgcttgttttcggagaaaagagaaccttaagtatctacaagttgaggtggtagagatggtggagacaattagatagatgatataaatgagaaatagaattatcaatgaagacgtatagaaatctagaactcttattaggagatttgccttgattgaaagcaaggaaccatttttattgaaacaggaggagcaaaataggcataaatggaaataaattaagccagcagaaggtaagagtgagggtagggtcaggaaggtgagagttcagccttgctgctctttgcaaaatcagaggcaaagccatttgctgagggagacggagtcagcagggttaaggatttggtgactatgaggagaacaaactgtaaagaaccagcaaacaatcatattaagattgaatgttgtcatatatacatggctttatgatttaacatagcagatacaaatgttaacatttcatacagcattataactaaaactcaagagtctctaaaagcaagaatgtttattttaaagtgaacagttatttctacctgcacagaaacacacatctcaaattggaaataaccattacagaacataggtctgtcagttactccccctcataataatttacattcctcttgcatctatattaatcatttttcctacacaatgttatcttggcagtccctaaaaagcataaagaattcatgcttttattcagtgccatgtgccaagccatttcaaatatatttgtgttctggagaagctaattagactacatagaagctaaatagactacaaaaatgtatgatgccaggttgtgtataaacaggggttagagcataagaaaatcagactgatcctcttaagatattactaaatgaacatataccaagaccatcacggtcatgtaagagttgtatttctatctagagtaatattgttcatgaacaagttcaagaattatacattaagaatgatgtacaggagatccaaattaggatgttgaggataataaaatacaaccatcttttacagtaaatattaactctgaagatctgttctaggtttagagttgttttcaattcactattgtgtttataatgagcagagatgttttgttctttgaataagttccaatgaatttagctctgaaaggcaaaatatataatcactctcaagcttcccttttctatcgcctacactggaacttttctttctgcctcaaggagatcagaggaccaggtctactctgcgcatactaacaggggaagaggcatggatcatttagaaacctgccagcactgaagtactacatcagtttctgacatcggtttcttcaatagaaacgtttaagcagcaagaacatattctatgttttttggcaatcagcagatcagatagaagagtctagcaatacaacaaggatgtgtaatctgacatgattagacaaggctcttagtaccagaacattcataattgagacaaagagtattaataacactttcctaacacggcagttagccattttatatttcctttctttaatcttagtgtttttcaacaaatcatgggatttaatagcgtgttttggcagattagaggatttatggcccagatgttttttgttctaaaaatggattagggtgtaaagtttgctggaatccatggaacatgttgaggcaagccggtcattttatgtgtgattagtgcctgccttctgtctcacagtccctccatctgtcacaattcaccaatggatctggttagatttagcctcgtgtcacaaacaagtcccttttctgggcagtttcgtattacagattcattttatgccattttatgccctagttaaaagatagggagagagaaagatgagatattagcttttctttaaatatttgcaaaacaatctttttccctcagtactaacgtacgtctaatgtcatgcagatcatcgtactaatatgcatcaaataaataaatgaccagtgttaaaaataaaattaagtaaaaattagttttggttgttacacctgttattttgtaacagcaatattttggtagtgtgtattactaaccatggactgtggagttgcatacataagctgatcatttggccatcttattaagagtgtgaattaagtgtgactatagtcaagagtagccacaatttcttatcaaacaattacaggtgcttggttacattctgtgcttgaaatttagcctaactattacaagtttgcatcaatagcaaaccactgccacctgtggtttatttcaccataaatggatttttaggaagaaaatactcttccgtcaaataatgatttatttcttctgtatataacaaacttaatagtgctatacagaccctcttatgtggcctttctaatactaggagagactcaataatcatagtcataattatgaatacctaaattctgtgctaaaattcaaatgttccttgcaggaaaaaaaattaaaaatgggttttatatttgcactacaaaataatattcgaataataactaaagcatttacttaaaaattaggttttcaacttctttcaaaatagttggaaacaaccatatgtcacttaggtattatatttttattacagatatttgaacatattggaaacatgtttatgtatgactatatggatcagtcattgtcaattattcattcattcattttagataaattccatggagaaatcattataggccagacactacctattaccaagaaaagtgatttttatggttaaacgctagcctagacatgcttttatacaaaagatatcctttgatctgtctcatgttcaggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggtcagttcataaaataacttactttctagaaatacttaattaaattgcctaatgcttttttaaaaaaaatatatttccatcttcttatcatcctcaaaatgattctctgtcccttttctccctccattaatatagaaggcctcatcgccatcctaatcaaaaccatctggaaatagaaagagttataattctcttgatccatctccaaaccttattgacaatgaatatccccttttacgccaccagcttgtattaaaacaaaatggcatttgaaatatctgagtctgactaaaagttttgcttttcagagatgcttaacttgtatttggggatgagctggatttgaaatgctgaatcttctttaatcagcataagcttggatgatatccatgctcatattctaagtatttaggatcctgagcttgtcataatatgtttccagtgcaaaacactgtcaagtgttagatgagttcacaactggaaatttttactttatcataaaacaaaatgtacttattaaaaactttgacgttatttgtattataactaaggccagtgaaacttctgaatttgtctgagagacaatgatttcaagcccttttgtctaagcctacatggtgttttatttagaaaaatattataagttgtaaaatcctcagaattatgtactgttggaatagttgatatgttttgaactgaaattttaaaatgttacccagtgcgctttacagaatcctctagataaattgatccagtagataagagaaaaaatgatcagctacttagcaataactggaaagttaatcataatgggaagcttatgagtcaaacagacttgtccagaatgagcagattgctaatttggatagctttctagtttccaaggttttatgtggagtttgatgtataatcactaagaagctggcaatctgcatagggaaggtgaaatgtatgggtgatcctgccacaactgctctttccctggtcctaatatgataaaaattaaggatggagaaacgatttcaattctatcgtgtgtccaggggagagagcaaaggatagctcagtatacatcccttgcagtgttacaacataagacgtatgacattggtgtcctgagaagggcacatttttatagctaagcaccaaaaggaagggggaaagcaaagtgacagttctaagaaggaatgatagcaagcataaaggaatttatattcaaatatttaaacattcttgaaaggatgcttgaacagaaattccttttctctgctccccacgtagaaatgagtttaacactcagccagatgctaatgcaaagtgactcaagctattcctcgcaagcatagctaaattgccgttatttgttaagcgcattgaattcagctgtggatacagcagttggttgcattcagcaagcatctgtaccctttttttttttttttttaatcctccaaagcagagacaactctacctatctcccccttctcttccccagtgctggctgggaattgtcaagtgacaaccgaccaaatccttttggacaggaagccttcatcctgagttctatatacttgcaaagcaggccttgtggttggatcagggagcccattaaaagtactttgatggtatggaaattcatcttcatgaagctcctaggcccctaagcagcgtgctgtttagctgtggttacagatcagtcattcacatcggagggcaataattgcgctgacggcttgtaaggcaatggaagtacataaaataatcctaggccttccaccatggcactgtgagttaatcttctctaatacagatcagctgttgttctaacacatgactttatgctggcttcagtgactctgcacagccttttgattaagtaacaggagtggaaccatctgcattcactttattccatacttgtccattgttaggggaccttattgccacttctcgttccatctccacagtcatactttatttctctgattagcacctcctacttgggttgcaggagtgagagttgcctccgttgatagctactgcttcaattttcctttctcttttgtacagttataacaactttaaaaaaatccatttttgaaataataccttccaaaacctgttggacagttaagatgtctctgttctcaagatgatcatcattcctgaatctcttcatcatgtactttcaatgcagttgagttacatcttgaactatggtcttataatttaggagtttttaagtgaaaaacttaaattatgaaaatgaagtagtttcatcattgtagtagtatggcaaactcttgtaatataaaaggaaacctcaatcaacggatctgaattatctcatcccttatgttactctgacacctgaaaatgaaattgagattattgaaactctttgaagcaggtattactctagtttgtggttgacttttcctgttgaaataacttgggtgtcatttctagaatattaatgatcaatctatgtctgtgtacatcatgaaaatgagataataatgtcacacttacatcttttaattagtaattattcaacattagcacatgctatgtattagagacggtggtaggtactggaggtattgtattaaaccagaaaatatgagctctgcctttatagaacttacagtttggatcaaattattatctgactgctactcattacatatttatgtgtgtgagcccacctataggaattgaataaagactccatattgcttagcatgtcaaatcagttacatccttgagttgacaaaggtagatatgttttctctcatataaaccacatatctatgcatatagtgttatttttctaatacttatctttttattagagttttataatcactcaatattatctatggccaataaatatgtggattagtaattggtttgaaattttgccatagagtttagtgaaagacataaaaaatatatgataaattcctcttacattttgcactattatcttatatcacttgaatcccaaaagaagggcatttttttctgtctaaagtaatactcccggccaggcacggtgactcaaacgcctgtaatcccagcactttgggaggccgaggcggggggatcacgaggtcaggagctcgagaccagcctggccaacgtggtgaaaccttgtctctactaaagatacaaaaaattacccgggtgtggtggtgcacgcctgtaatcccagctactcaggaggctgaggcaggagaatagcttgaacctggaggcggaggttgcagtgagccgagatcacgccattgtactccagcctgggcgacagggcaagactccatctcaaataataataataataacactcctaactccccaaacccagaaaatatgtgtaaggtaaggagtgagagagataaagcagaaagaaagagggaaaggaactgggagaaaggaaaaaaagaaaagaagttcagccgggtgctttacatcaacataaaagatatcatgacctgagctccagatgattgaaatcttgtggtggagatctgttttcttgggtacacagccttatacacattaacttttcttcatatctcaaatagccagccacgtggttatcccagctagaaggtcttaattctgaaaagctgtaattggacagtgaaaacaattagaggtgtgaagatagggactgatgatttctcagtgatatgtaccaaaacacatcatgaaagtcatttttaccgaaacacattttaatggaagacttctaagagatttttttttaacttctttacttttcctggaagtgtttcatcatacccaagaactgtatgtgtcaggtttcttggaaactctgggacacagtgttatttataattgtcatctctggttaattgtagactgattgtatattcaaataatgttatcttttgccacacagctttgtcacagattagtgttgtgggtgaaaaagtgagcttctcaggtatgaaggaacagaaagaagcctctcatattttgttttgtaaaaaacacactttgcttcattaccacccagatggcacaactttgttcatagagtcaagtacagattcttgagcttgtgtttgaaagtatccatattaataagagattataaaaagctcagtttttgttgtcctgatcccaccagacagtcttaatacaatagaggcccagtgcactcagccgaaatgagaaacagaccagaagcttttccgtttgtgtcactcactccatatatacttaacctgggaagactgtgcctttactgtcatagctgttaggaacgagtttcgctacatgtatcaggaaacctgaatgtagtagcttagatagtgattcatggccgggcacggtggctcacacctctcatcccagcactttgggaggctgaggcaggcggatcacctgaggtcaggagtttgagaccagcctgaccaatacggagaaaccccgtctctactaaaaaatacaaaattagccaggtgtggtggcgcaagcctgtaatcccagctactcaagaggctgaggcaggagaatcacttgaacctgggaggcagaggttgcggtgagccaggatcacgccattgcactccagcctgggcgacaaaagcggaactccgtctcaaaaaaataaaaaagtagtgattcatttttatcacataattgaagctcaggactaggaggttggtggcatgagttcatcaacttgatatcagagttgaaatctgtgattctcttgtcttttccctttgggtcacaaaatggttgctgcacctacagctatcccatccccacgaaggcaggcagattcaggaaggagaagtcattttctctttgctaacttcagtcttcattcatacgggggtatttcattcctcttctcaagctgacttccacaaacatctcattggctagaactgggttatatgaacatctttaagaccattactggccaaaggaaaagagactactttaaattgatcatgaattattttttaccactaaattagagagctaatcctgtcttctctgagatcaggggatatcttcagatcaaaggtaatgttagctgggaaggaaagaagggcaatggctactgggtaggaacaggcgattgtcagccacaggcatattacaaaaatgacatcaaagctctcaaatatttccttcatgaaactggtttgttttgtttgtcttataattgttaccatctatctatcttttgcccttccactcttacatgtccagggtcttttttttttttttttgaggcggagtctcgctctgtcacccaggctggagtgcaatggcgcgatcctggctcactgcaagctccgcctccagggttcaagcgattcctctgcctcaccctcgctagtagctgggactacaggcgtgtgccacaacgcctggctaatttttttgtattttcagtagaggcaaggtttcaccatggtcgccaggatggtctcaatctcctgacctcatgatccgcccgccttggcctcccaaagcgctgggatgacaggcatgagccaatgtgcctggcccatgtccaggttcttataccttgtctggggttcacaaagaattgaatgacacagaagcatgtgcacaagaagacgttgcttgataacaggttaaatctataaacgtatattcacatacacaccgtatacatgttaagaccaacttctgtatttcttttcttatgtaaaacagatgtcactcacaaaaataagcatgcatatgtgtgcatatatctcttaaggcagagaatttattcactgaacattaattgcctacagtgtacctggaatataaacatataatgcatgctatgaattcatctgtcattataaatcatagctggaaaaatgtcttcctttttctgctgagctttagtgaaaattctttgtaattttctgtcaaataagatggaaatttggtaaataacatgtatattttaattaagaatttactcaataatgacagtagtttcatttttgaccctttctgagtcatattcataagaagccttaccacagactatataggctgattgtaagtaaaggttagttttgtttgtctggcacttggaaactcgtccattacaaccacctctttcctgccattgtccaacccttttctttccctttaacagagtgccaaacatgaaatgacagtgaccaatgttgacttaatgtggatgtttaataataaaaaaaagtgtgtcattcccagcattagttacaaatggcagtaagtgtatcggatggcagccctgtaataattttacatccatcattctttcctgatgcttcgctggccatctgatggatggggccagcagtgttaactcttcggaaactgacacagtgtatgtagttcagcattatctaacacatgctccttcccttagataaggagaagggctgtgaggaattgtgaattacaggttttgctttaaaaaagtgaatatgaaggaactcatgcctctccagtcggtggaagttgcttccattaatgatttacggatgggttttataaatgttgcctttagctaaagtgaattataaaagtcaaattagaaatagatatttcaatagctagagaaaaattgtataaaggaagtaggcatgttaggtaaatccttctggaggaaaataagatagacctttgcaacagtgtggtaaagcagattttactaggggtgtgtgtgtttttaaaaaatgttcccaatgttttaaatcctctggttagaatttgcctaagaacaaattaaaataacacaagtgattaatattttctcgttttaaagtgagcgtatattattttttaatctctacatttacatgtaattatttatttggtgactttaattaaaagatacacaaaacctgaagttgaatatttgccttcttattatcagagtctctctaccctgcaaatttatataaaatgaaagggaaacggctttctaggcaactgattattagaaaatctagaccagctttttatgtgcaagttggcatttgatccttaggttttcttttcttttgttttttcattcataaaaccttcttaattctgagtatcttagctagggaacacttcttatgggacaggaggggagaggaaaaccccttagtgaatattatcagcacagagcagccagttttcaaagaccatgacaaaaaggcaaataggtattatgtcatcaccatccatcactctgtatgtcagcctttcaataattccaatcgacattctcgacaggctgatgcaagttaaaggggctgtttgtttttagaaattgagtataggctgtctatagccttttgttctagatggttttcttctgtgtcttttcatttctttctctttatttcttttctttttgggggtatttaattgaaatacatgccgagtctgcagactgcaaagatcagagctgttttcgtccagcagtggtaactatgcattaaacattttgatttgtttgagcttgaagtttagtccttttttgccatttgcttcatggagtttgtgtatatttacagcctctgcatttaatggccacatgccttattttcacagatggccagtggaagactttttctttctcttagtatagcctgctttcagttttgctacatttgtcacagtgccactacttgcagctagcaagtgcccacgcttggtggggagcaattatggtgtgagtttttaaggagctttttaaaggttttttttttttccagtaaactttttatggtttaattttctagcctagaaaagctgtgcatgttttcaaacagagagtcttgtgttctttacatcattctggtagaggggttagtgtaggatggtccaataaaatgagactcatagggcatgccaaattgggctttcagagagacacccacaggcctctctgatgattgaaactgtctatttgtttagggattcgaggatatgctcacaatagtacttctgaaaagataagtttgaaaacaccatgtatagaatgatgttgatttttttaagtatattatttccataatgcatagataaaagactaaaagaatatacaacaaaatggcaacaatagtttagttatgccaaggttatggggttgtaaattttcaaatgtatttccacatttctgaattttctaattttcaataagtaaagtaagactcacttttgttgttgggccagaactgctctttataaaagcctagcctatcaaagagtggtctttcttttcccccttgattctttccttcttctcctcaagatcaaacagctgccctcaagacacttacttacaatgaagacactgaaataataaaggagaagtttgttttgcagttactctctatatttagtagatagattctttattatgtttattgcaagctattttaccaatatggatttaaaactattattaggaaaataggaggaatgtcgcatttatttaaagggtctcattgaatctttccaatcacatctcttctcctcttttaccaataaaaaagacttgcttatgcctatgtcataggagtataacagctattgatatttattttgtaccttaacattttctcatggctttcccttcatattttgttctcactctgtaatgtaaatagaacagtattctttgtttaaaacaattttttaacttgagatttgagaagaatagaggaattcaagtggcagatcagtctttaaattgaagtcttacagctcaaagcccagtctcttttctaacggaatatggagagggaattccagaaagtaacgcagttcctgttcaattcgcctgtgccccagcattggtcatgtgtagcccttggcacatttttgagacttgatcaaaaaaattttgtttaagcaatcaccatctccacaatctgtacatctgttttccaattctttatttttcctgtatttgctccttccttcgttcttcctgtcttcactgcgcaccaaaccccatcactggagaaagaaccaagaaagcaaaaacaatatactcaatcctagttactttgtttctcctagcagctctgataaaacaagtgacgaagtttcagctattcattataaggagatttaaaatatctattctaatatatatttttctctctctgtatttaaaactaccatggatagttgaaaagagaactataaccctgatgtgcctgtttctattgtcagacccagcatttctgaaccaagccatgactctttaaaatggtcagattatatttatttaactgaagtaactactggctactgaggctacatttgtaagaatcctgccagttttatagcttttattccatgaacaggaaaatttgaagaaagtaatcctatatgtttctgtagctcagtaactgagttacccattgtttatagaataattatcatcagacaacattccacttttgtgtttacatttgtgtagccctcccaccaactggacatcctgtgtaggttgcaaattgtattatttttcttagttggcctcctgattttctcacattaacccttctgatttgactcagtatgtataacatgtctgtctgccacggtttggaagaaacacaaccttttctttagatattggctgaagcctgaccatatataaagacatttaaaatcccaggttttgtttttttcccctcctgcctcccttcttccacatgtacacaccataagcaccatgataacaaagaagcaagggcccatattttactgtgatagtattcctgtgtaaagttcttggtgaattgtttgttttctatacattcttttgagtagcttttctgtacattacacatccgggccatagggatttttttcctccctgtggcagcggttttctattttaaggactaaattcataatgttgaatggggacgtgtaagtgtgtctttaacaaagtacctgaatttgtaagtgtaattactgttggacagtctcttcacaaaatatgtctgaaaagcaatcagatttttgtttttttcataatttgaaatgtcttccttgaatttaagaaaagaattatggaattattgattacaaaaccatagctttaagtgttgaaacttattaatgatttttgagaaaattatcttttatgaatagagaaagtataaaaatatgacaaattacacaagaacctgaaaaagagacttcagtggagtggaaagaaaatatcagcgatagttgtctttaaatatcttgcacatctccaggtttaaaaagaatcaaagcctgttttctgtgagatatgtgtcaaaatagttttgttatattgagttcagtcaagtaggacataaaatcatagaattgaaggtttgaaagaaaatgaaaagggcctatcattcaaccttgaattgcttcttcagtatctgtaatatgctaggcaggtagtcgtatgtccaccacttgaaaatctctaggaaggtggaaacttcttccatcctgagacagcccattcaatggataggcagctctgactattagatcactcttccttcactggttcattatctttcacctgataacttacaatctttgatcagtgttctatctcctgactacatatggccaaactctatctctgtttcacaaataacagctgtttattctttttaaacatggaggttcttaagatattttatgtaaagacaatgattgttgattttttcttcctactctactcaaacctttttttttcaggatcctgtgtaatttcttcattatgacaacaaggtttaatggataggaggatgctcaaaaactgagttaaactaagttaagtccaagcaattattatcattgagtttccccggtctgcattccaacacctattaaaaaagaaaatgaggccattataacattagtttagtgaatccataccagcttcctgtcattaccacaacctctaccaagtgctctgaactaatctttataggtagccccatcttttctggagtatacattaagtgctaaagtcatatttcctcaaatttctctcttcataaaaatcaaaattagatatttgtcatcagttttgaaatatccctcccattttaaaatcacttctttgaaaatcattaataaggattcatcagtattatcaagtcattttcatatattgaaaagttattcacctggaccaaaactctcaaatttctacactgtgtgtttctgaaccatcttcgactttgtagtacttcttaagaaaacttgatctgttaatacatttcacttgatcagattgcctgatgaaactaacctactaagaagttgagtcagaattatacaagcaacttttcatgaagcaagctaccaaattttacaaaaggaaattagattctggaacaaaattatgggtttcaattcatgagggaattcagaaagggaaaaaaaaaaatcagtattagataaggcagattttgtggatacctagaccagaggatgtatatggacctttccatcccctgagttcatatctcactataattctcaatggagaaaatgaatagaaaaattttcttcaaggattattaaattccagaataccaaagggtctatggctattctcacggataaattcatacttgatggaggtaaaattagtgacagatctcttcaacatgtacttttgttagagttagaggaaagtgtgtatttgtgtgagtgtgtatgtgtgtgcacacacatatagtttatatatcatttatacataacttacaagaaacccttttctcccattttcggtgttatattatgtgggtagatgattattttctaaaaaaattgagatattaataagcaagagtgaaacgagaggttaaagagtggacatgcgccttatttctttacacttaagctgatgaaaaaaatctccaactgataaatcgttatgacattataagtaatctttcatcttctttggtggtctgtgaggttcacataattggagggttttttgtttctttcttcccgtgtcgttaatatagtagaagaccataaagaagtgcagccagaagaggtttaactgttactgagtcaacatttgacagtcacactctattctgtcatttcatgcatgtgctttttatgacttttatagctttgtgagctttatttcagggatgtccattatgatagctgatccatagcctatctctttgtgtatgtgtgtctggtggagagcgaagctcatcacttagctgaatcccagtttcagggagtaatagatgacttatctactcacgcactgtttaatttaggattaggtaactaaggaaatatctacctctaaagtacagtttgtgtgttcttttgttttgactgctctgtaaaatatcaacataggatgcctattagaacctttgcaaaaatagtgaattttcagttgttttttattttttttaagtcaaaataatggagcagggaaaatttttcagtttaaatatgtactagacttacagtctggaactgtaactcatcatgcctgagtatgaaattgaaataaaaaacaatgattgaatatattgtaaatgatagacaaagaggggaaatttctgagaatatttagagttgttactaaaattcccttttttagtgcatatttggttatacagaatagagtttataatcataacaggctacttaatactgaaatttaactatttctgtaattctcacatgttagattccctgtcttttcaattttccccactgacattttaaaaataatattaaaagtatatctatcttaaaattttcaaactaatgagaatctaacacatgtttaactatcattttacaaattaggattctgggactcgaggaggataacatatttgtctaaagcagtatggctaatatatacggcagagagtttgattaaaatatgatattcctgatgccaaaactcattattttctaacctcaaaagtgtcctcttcccatgaatccctgtggcctttcgccattcagaatggtttttggcttagaagtatgaattgatactgaccacctccaatcaacaaagtgtccatatctctttagctatttcttggctccccttttagattcccaccatagcctgggattatgtgcaaacagtacacatgctgttttgcattatgcaagtctctggataagtcacagagcacaagaccagctaccaagttccccaagtgaatactaatacgttaataatagttttctgtatgtcagattttggagttactcatttgcacccaggaaaccatgtggtctacaactgtcttctgtcgatgagatacaattcacttcgatcttgtttcaagtcaacataaaatcagaagattttttcaagtctgtttttaaacagacttaacctaatgtttctccttgatctcagcaaacctgcagagttgtaaagatgtgattaggcagataagactcatctttgcaaaggaatctagttgttatcccattgctagtttttattcaagagagaaagcatacaggtcatcttgtttggcccataccccaggacttttacatgttgactactttgttgtaattaatctctttttgccctctattctgacatcattcagcgcatttagaattctggcgagtattcctttaaatgtataaaaatgtaaaaagaaggtaaaggagagaagaccaatcaatcttgtcattttcatatcagcattcctaagtgctgtgctggatttgtgttccagaatggtgacctttaaatgggggaatgggatgctatttttctgcagaaactcttgagtaacatgatttttatcagagccgtgatttttatcagattataagatctatatcaccaacatgatttttatcagattataagatcggtaaaaaattgtcacttgtgcccatcaacatttatttgttttcccaaaatcagtttctttggtgtttcccattttcaacatcttcccacttaaccctctgcttacctgaaatctactgtccttgttttgttccatctgcctctatttagaaaagagtaatttatttataagaaatttgagaatcaaaatattaccttttccagtagtatttgctcttatgaaaaaacacttttagaaaaggaaatatttaacccacagaacagaacctcaaatggttgagctttatacatgatagtgcataggtgaactctttcagagaggggatggctggagacaggtgggattaaaaggatagagtaggagagatttttctagtgtgtcagcacttctgctttataacatttggctgagtctttcccctcctatatgccattcaattgaatttaaacttttgagaactattcttaaatcccattcattcttttggtggttcaatatattacctagacacctaaccacatataaatttatatctacttttatacataagtactatgtgtcagctttataggatcagttgtcatatggaattataggacaattattttttacttaagttattgtctcctcacatcagtttctttttcttctgaatttattgtccacactttttttaaaaaaaatgtggcaacgttatccttttgatttgcatgctgttataatctgttttaattaaaggcatacctcacattctccatttcctgcaatcacctttccttttgcctgttctcatgtctgttagcttaaattactatacaaagggttacgagaaagtacagcttactgtgttgacttccactatgtcccactgacgtcctcttgagaagcatagtaagttttacttttgggtagctaactgaatcattttattaatattgggtgcattagtggtggataattataggttacttattgtaaaaactgagtgtgactttcctgctcatatttgttaattttagtctcttggtaagacagcacagcatctgtagagctgaactcagaaccttggaagtcacttaacgtgtcgttctttttctactttgattaattttgctttttcttcttgaaagactttgcttcagaatggaaaactctctagaaaatgtgtagtattattgccctatactgttaaatcaaaagctaagaggtgatccaagccccgtacattcctcaaagagagtacagtaaagtcttcattgacccgaggactatcagatcatgttgatggaatgtgtgtatgtgtgcgtgtgttttcaaatgtaactgtcttttgttttaacagctacatttactgtaaagaaagtctgttaagctggtgtccttgatgctcctgagctcagctgaatatatacagccgactctctcagcaaaagacatccaaaacatatgaagcagctgaaaacaacaacttcacacacaaaacaaatcgagtcagattctacagttttaaatgcgtaacttatttcaactttaatactatttaattctatagaactaaagttaatataaactattttgtctccagtttctctactgtattttatactgattgacaatttaaaaatagttttctattaaataatgtacataatttgatgaatagagtacaggagttccaaggccactgacttaagagattttttaatttagtatgtacagttgtcacattgtcagagacttcattgagataaagcatgtactgtgttaagaatttcaatatctcattagttcttggtgggaacattagttgggccctttacctgtaatacaattatcttacatcattgattactttctgtgaacattttattgtgtcaatagcagttctgcagtgtatgtcgttcactagtatgattcatgactatgttcctcagaaaatgaggtgaataattataaagaaacttgagataatgttatgagatccaatggatgcatttcttaaaactgttttggtgctgtttggtactacatcatcctcagagcagtgctggagagttcacgagaaagttatcaagtttcattatatgctttttctgttcctaaagtcacccagtttcttaatttgacagtaatgtctcatatggtttagattaagcattatatttttcttaaaaataatttattttgaaatgctatgttctccatgaatgtgaatcgtgcactgcatgcttaaacaacttgatgtctctgtagatctaattttggtatatttgtatctcaaataattcgccaactcaatattttggcttagcaatccaaatcaaattgtggtccaagtagcaggcactcacattggatgtacagagacttgacaagcaattagcaatgaatatttaaacgtcttcattacccttgcatgaggaatgcagatggcatttgggaagatggcaaccagagggcactactgtgaattatgtttctattatttggtcacctgactattggaagactttctctgggcttcacgccactcctatacttctactgtctggccaaaaataaagcagacattccaaatgtaaaacaggttgcttccatgaaatttctgtgcacattttgtaatttgggaaggttgtctccaaggatcccggcatatatcccttaggcataccaaacccaaacgccaagactttataggggtctatgagaatcagagttccttcaaaaatcgtgctgatcatccccttaatgacttcaggttaatgtgctgaacgtaaaaaggtgaatatatcaacattgcatcctttccaggagttaatgtattatatatgtggcccaaaaaaagaaagtcttcaaataattttaattcctagactgatctctcattataatttttttaaaggaaaaaacaacactggagagtctgactcagcaactggcagttaaacagaatgaagaaggaaaatttagccatgcaatgatggatttcaatctgagtggagattctgatggtttgtgaaaattgttcatacatattctaataatgcaagaaagtgtctaggtagtgccaattaaaactgctaaaaaatagactagacagccacctcatacctcatcattacaataagaggtcacatatactgagcagtccccatgtgccaagcactctgctgagtgctttgcagaaatcgtctcatttaattcctagtcaacctaggataagtcccattgcagagaaagagcctgagcctcaggagttttgaagcattttccccaggtcacagggctctaagtgtcagaggcaagaattaaattcgagatggcatgattctaaagcaaatgctcaaaatgcttagcttcccaggctcaagtgatcctcccactttagcctcccaagtagctgggattataggtgcatgccaacatgcccagcaattttgttttttttttttgagatgaggacttacttactatggtgtccaggctggtctcaaactcctgggctcaagtgatcctcccacctcagcctcccaaagtgctagttttataggcgtgagttactgcatgcggcctcacttccctatttcttgtacccaaaatgaactttttcagaaatttgtttctattggctcattttttaagtttctatttgtcaagccctcaccagaatacatggctcagaggacatttccacgatagtttcttacattttggaacccttctccctagtgctatgtactacatagtcaagtgtcgggcccactctctataacctaactagaaaccagctgcacagctttatgctcccttctcataggccttcagacttctgttttctgtatcatctctgaacattctaaacatccacagtgagaagaaattaaattgatactctgatttttaatagcgtagcaaagagggaaaaagaaggaagtgctgttcttcttatacaataccctgaccgggaacatctctctactgtcaggtggcatccatgcattttaagcattcctttggcagtaccgccctcaactttgttactactacagggaagttccctgcatatagagaagagtgcacaaaggcaaaccagtgagatgcatactttgagagggggtccccttgaatcctccaatatacacaactgtttactctgtgccttgggccaattctacttttaagaccaggtctatactaatcaagggactaaacaaacctgaacgttgaaacacgtaattctatcaaaactgaattttactcaattggattcaatttgcatttttctgggtctaatgttgcaaacattttcttctattttcagctccacttagctaagataaacctagcctatgtacatttaaagagcttgtttagatttgatgaagacacataatgttcattttattgcttatgttgctgtaaggtgtaagaacaagaaaaggcagatgtgcaaatgatcacttgctagttacaaacccattttaggaagatgttgccatatatttgcacttattttgtcaataaaagacaattacgggtaataacacatttcataaattttaagttgtattagcatgataaaatatacccacagtaatcagcattaacacatcaaagtttttgttgctgtcattacctaaattcaatcatgcttgtatgtgaaatattttctacttttcattaaatcaaagagcatgttattaatgaaaaatattgagaaacttcaccaacaggtatgctatgttttgaatgtgctgctatagaggtcttcaagtttgggcaattttgtttgattcctgtgtctccaaatttaaaaataaagaaaagatgaggaatgaatacaaagcaagaaaagaaaagcagtgcttttgttgataatacagtctctacaagtccccaaagtatttttaaagttttggatactatcaaaatacatctacttattttgtgataatacccagtgaaaacctactgtcagagttctactggttctccttattttctctttgcctaaactcaagtatcttggaagcaatttaatctgctgaagccattctaaggggtcacataaggctggaggagtgaatgcagcttccaaagctatcgttgttaactcttgaattgtgttttatcatctgtgaatcttactgattgaaatgtgactgtccatgggactctttggataactttaaatattagggggaaaattcaaaggaaattattatttttctcatcttaaacatgtgactgtagactccttaagaaactagaggaatgtaactgttcatttgttcttttccataccagttttacatatattttggggggcagacctgtcattgctgtatcagcatatgtcatgcatttgtcagcatataatttcaaagaaaagccaattatattacagggaaatacctatattgtttttaacctcaaaatttggtcagtgtttttatttttgtaacctcggagagagaaagagaacataaggtactatatgttcagacagtctttaagtagcaaagatatatcctcccctataatcatccattctgccaaattgatttgtgcttctttacctatttaatgtttctacactactggtatgcctgttgatttaatctgactatcctctttccgaattgcatcaaaaatcacatatcggagtttattttgagctgttgaaagtaaatggtgaaacagtccattgaaagaaagagaaaacagattagaaattggttaaaaatacaaatataacatttgccaccacaaggcttatcagaaaaacttcataaacaagcatctgtcttaagaactggaagtaccattatcagaagtactttttcttttcagatatcttaatagactgaaaaataggaatgcaaggaaaagagctgacaaaagttttaacgctaacacgaagtgatgtttcctgttttcaggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggtaagaaaaccattaagaactaagtgacgtatggaataaaggtactgttctgttttctgcagttgtggaaggatcctggatttggaggccatacaggtcgtgttatttgcttatccagaaaataaacatcatcattgaggcttcttctggtgatgaagcattctatgtccattgagaaatatgccatatttctatagctcatgtagctgtttgtcttcatactaattattttaatgctttatcttcttcaaaaatctagaaatatttttactaaagctgagaaaaaagttgctttcacatgagccactagatattgctactgatcatttgtattcatttccttgcatactatagacaacttactgttaatcttaaggcctccttcctctctcatcatcctctgtaacagaaggataaggagttttatttgcggaattcatcttgttgtgggggtgagggtggaggtggggaagatgtttgttccagtgctataattgaaaatcagttttagattttcagaacacaagaagatgtagagtgtacatttttacatttatacttttagtaaccttaagtactaaaggtacttttagtcatactaaatacttttctgccattgcaacattcaattgaacagaaaacaaagtacgcatttactctacccacacagagactgtagcacacaggaaaaatggttggggagaaagggtgctgattataaagatacctattatagaccagttcaggtcccagggggaaaaagaaaaaaagaagattccattgcttttgtgccttatctgacatcattatcactgtcattgtcattcatcactgtctgatggccagatactagacaacctaagaaaattttgatgattcactctgtgacttctaagagttaagtgacaaaaatagaatagaaacattttatcagaaaatgttggttttaacaaataagtaacaaaatttgtcaaaattattaaagttttattagaattcgtaaggcacttggaattacacggagtttataaaaatagtatcacttttgattcattacagatcatctataaatggcaaacatatgcatgaggttttgttttgcagatggagtctcgctttaccgcccaggctggagtgcagtggtgtgatctcggctcactgcaacctccgcctcccgggttcaagcaattcttctgcctcagcctcctgagtagctcggatgacaggcgcgggacaccatgcccaactaacttttgtattttcgcagagagagggtttcaccattttggccaggctggcctcgaagttctgacctcaggtgatccgcccaccttggcctcccaaagtgctgggattacaggcatgagccaccacgcccggccgtatgtttttatgatcccatattctcaacaaagataatagatgccacctagtccacaaggtgcatttgtaatgggatcaaaacaaaccattagccacttaaaattgtgtctcatttttcacctaaatgttatctaaaaagacatgaacatgcaaagctttcagtagtatacatagaaaatatgaaaatctgtgtgtaaaaatatatatcatgcataatcaaaaacttgaactgatcaagaggaaatacacatttttttacatctctaccagctctgatctatttttcccttttgtgactatattttttgtgactatattctaccttccatgtgaaatttcctatctttaaaaaacaacataccagtttcatttgggaaaactctagaaaagaatactttatgtaagcatatttcatgttttaatatatcagttattcccaaattagaaatccaaaattgtcagaataaaaaccaagttaaatactaagatttcaaaactgtctttatattattcaattcttgtgtctgaataccaaaaaggtgataatcattaattaaaactatcttaactataagagaaatatcagttttgatgataagaaatgatattttaggaaatgtagcaaaagtatctatggaaaagagatgactggctatgagaattcccttctgatttgagggaaagaatattagaatgaccatatgattatattataatagacaacatgaaagagaatactgcctaatttcagtctttctgatgaaaatgtattctttaaagatataacatttatatttaggaacaaataaaacattgaggtattttgggctcaatatttagtcacagctttaaataaataagtgatcttcaaatatccacaagatcattctaaatgacccatttcatacaaaagtacaaagaaagcttgatgttttcctctttgctgattgttttggataacagcctccgacagcatgccgctaattcattctgcttaaaacaggcgcttgagctgggttgacattttacgtagtctctggggatcgtagttgacattttaaagggcttctaagcattttataataccctaaaatctggttttaataagccattctgctgaaattgttaacataaggaatcaccttttactgcttggcgctagatcaggggaagagggacatctttttctgattagatatacagtagtttagttggagtaaaatgtgcaaattcactacagaccccacggagatgacaatgttgcccagcgcaaactcttcactttcagtgtattgccagatttagaaaggaaaggaataatcgttggaccttattttttcccctattttgagcatcaaatacttttgattgaaacttcctcttttgtcatcaggaggaaaacccaattgtccttctctgctttttattattattattattattattattattattattattattatactttaagttttagggtacatgtccaccatgtgcaggttagttacatatgtatacatgtgccatgctggtgtgctgtacccattaactcgtcatttagcgttaggtatatctcctaatgctatccctccttctctgcttttttattctaaaacgacaaccttttgaaagcagcagggaatgaataaactccctgtacatcagtccagagtaagcagccagccacccccaaatcaagtagatattttttctctctttttttttttttattgttgtttatccaaaatattttcctgccattctcatcaagtatgtttcaggggttagttaacacctcagctgcatacaatggttatagtacctgcaaagccattgaaatcaaaaccaaacttgtcagttggttaagctaattcaaggttactattttgaaaatgaaaactggatttaccaccaaatggaaacactgccctgtactgtcataaaatatagtagtcagtcagccatttgacccggttagtacttagcctatctttattcttagttttgaaaagacttggaattattatatggccatattttaaagtgtaatttaggattcagtgatactctcaaagaaattatactatcaagagttaaactattttataattcccgttcatgccagatttggaagccaacttatctgagaatttacacatcttttattatcccatttctttacatacacgcatctttttttcctctttttttttttttttaagccagaccagctttctttaagttagtctaactcctctttccaccgaaagacctcaactattatattcttcctcaataggatgctcttctctttgtgagccccacgggagtcatttctacagcaaagccttcctgacctgcagaggattgatcttgcctcatcatattctcttaccttcctgtactttctacaactataaggaaaataataaattttgtaattagatatttaatgtatattccctgactgaatataagctgcaaagagacaggaactataactttctgtattcactcactactatatatttattaaggaatgaatgcaacattatgtacatagtaggaaatatacaaacaaacagctctcgcattccaaggcagattacttctaagcataaacattttctttcctttgagaggccaaagccttttggcgtatagatcatttaaacttagggaagaatctttggcaattccccttctaattgaaaatgcttggccaggagtggtggctcacacctgtaatcccggcactttgggaggccgaaccgggcagatcacgagatcaggagattgacaccatcctggctaacacggtgaaaccccatctccactaaaaatacaaaaaaaaaagctagccgggcgtggtggcgggcgcctgtagtcccagctactcgggaggctgaggcaggagaatggcgtgaatccgggaggtggagcttgcagtgagccgagatcacaccactgcattccagcctgggcgaaagagcaagactctgtctcaaaaaaaaaaaaaaaaaaagaaaatgctggtttcgttttcgaattttgggataaagctagctaataaattttatattagatcaaccatccttgatccatttatcagtgtattcctatttgtgagttatttatggtaagctcactttccactccctgatctgaagttcaaaaaactggtataaatgcttggaagaaactcaatgaaaacggttgttctagttcaataggatcataaccatatctgtgtttatataggccctgagaataacataatggtattcaagtatcttcagagaataatgctgggccaacaaggagtttgagattgtccctacaaatgatatggcttgaccaaccaacctaatgttggatgatgctatttaaacagaagtttacgaaaggaatagaaaaagaaactctattatttgcactgtaacctgagtttatactgtaaatagaataaattcacattggctttctagatttggaaaaatctatatttatacctatgcaatacaatatctcttccaatggtaacatttctaagggaagagatattgcctctttcactgtatgctttaataaatgtaacagcccatattgaggaactctttacatgtgtaaggaagaactattcaacagtgagctatttgcatttaagatagggagttacgggtgagtaatgaactcattcgaaagattctaagatcttacttagatgacatttgaaggcaggtataaggccatttggtagggatatcctagttccagtttatcggtctttgtgcattcgcgttgagttgagatgactatttgcagataaacacacttcatctgcaaatagatttttaaatcactattaaaaaaaaaaaaacgctattactactgagggctgccagcacgctgtcacctctcaatccgaacatcagaaggaacaaactccggacacaccgcctttgagaactgtaacactcaccgcgagggtccgcagcttcattcttgaagtcagtgagatcaagaacccaccaattccggacacattaccacttctattacacatagccatactgacagaatccaagttttaaaccatatctaaaatgtgaattagcataaactatttttatttaagcttcaaacttgtcttttttaatcccagctaaattcacaccaaaattaatagtgaaaagaaagggggaaaacaatttgggttattattactaaagcagactgtatcatgggaagtgacgtctttgtatgttattgaaattgatttattaagagaaaatcgtaatacgcatttacagtaattgtgacctctgctatattttgtatagtaggtggccatatgtaggaaagggcatacattatagcacaatttaagttatatcaaatctgagtttgagtcacagatctgtacttcagtaattatgaccctggctaagttagtccatctatttgaatctcaattttctcatctatgaaaatagatagaaatgctgtctcttttataagattgaggtgaaaggtaggaaaaagacatcagtatgtcaaggtttcagcacagtgtctggcacatagtagttacccactccatgtttattaatattataattttaattataattaaatgtttaatcaaaggaatttttaattactaccattcctgtaagcttaaaatacttaaacattttggggaggatgagactacatgatatatgttgggaacttttgtagtaaaaaacatctcccacataaaaatattcaataactagataattagtctcagattcaaaatgcatgataacatatcatgtaacttttctgttcacatgtgaattatatcatgatctaatgtagaaatgagaaatgtatccattaaattatctatgagctttaagggacataatacaaaagtttggctagaatgcaaaccagaaaaaaaaaaatactgcccagtgtttatatctttaggtacaaaaccaccaccacctctgttcttgtgggatctcactaatcaaaaacaggtttatgtatttctgggttttggctaacatctcaactttagattttcttgttctcagccatatcactttctggaatgcttagaagctgtgcaaattggaatcctaacctcctttcttcataggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggtatgtaccttttagtcatttttctcatggggcaaacttcctgttatacttaatgggatgtgaaacatatttgttcagttgcaaaaagacattttgaaaaagaatctgagctcacagtattttcagagacaaatagtctcccacatgatcttgaaaaatatgtccatatgaatccactgcaagttcctagctctaccatgagatttgttaacaactggtttaaaaacaagatatctacaagcaaatgattttgaagttttctattaaaaacttagaagtataactggttcttttcttcattggtttgcattacttcctaagcttcaccatgataaattctaaaactaacaactttgttgagacaatacaaaataaaaatcatttcaaaagcaaaaatacttatttctaaatatagagaggttagtgagctatcaaggtacatgtgtggcctttgtggatcacacaagctagggattatatttagggtgtaacaaggttgggaacaggaggtttcattctgaattgagaacgcagctccgagatgttttacaatgctcccgtggcaaggttgttgacagtgctgtagatgggctacagaaatgcattgcttctatagaattctctcaaaaacccaaaataaagttgttcatatttgaaacagaagttagtttctaagagcttcttagaataataaatattgttctaaatatgggcagagaaggactcataaaacctttccaaatctgctctgtcccctccagttccttggaagaggctgcatgctctgtccagtggtctgtgattcatatgcaagcacatgactcctcacaaagctaaacacaatgcccaacagttcttgggcaaatagtaaacatacgaatgaataaaaacaagcataaatgcacatcatctattcatcctttccaataggaccacctacattatttataggaccagatgcaaaaatgaggagacagggtctcttgttaaaaagttattaagaatttcaagtctgtggcagcacaactttaaaccaagtatgggaccttagtgcagttgcacagtttgtacatccatgaagctgctcctgcttcctaccactacgaggccagaactgtttcagagactcagtggacagtgtgaatttgttcagttctggtgtgttctgggcagtaaagttttattttgagaactctaatgctttaggattttcccattaaaatttaattatctttagatttaattctagggaaaaatactatttctgcatgttataatgaaagaaaaatgaacttggaatcaaggacctgggttcttctgcttcatctttctgcacctcagttttttaataaaacagtagtaacaaacaggattaagaataagatggacaacacatgtcaatatcttgtactctataaagcactacctaaacataaggtattaggcctggtgcggtggctcacgcctgtaatcccaacactttgggaggccgaggcaggtggatcacctgaggtcaggagttcaagaccagcctggccaacatggtgaaaccccgtctgtactaaaaatacaaaagctagccaggtgtggtggcaggcgcctgtattcccagctacttggggggctgaggcaggagaatcgcttgaaccctggagggggaggttgcagtgaggcaagatcacgccattgcactgcagcctaggcaacaggagcgaaactacgtcatctcaaaaaaaaaaaaaaaaaaagaaaagaaaagaaaaacaaggtattaaagttcaagtaggatggagtttgaaaaatgttaggcaattagataaaattagtaccttagaattggacattgctgagcaaattaattatgtagtaaagtccacatctaactattcacttacccacgatgtctttttggaaattcctttcttgacaggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccgaaacaccaccctaaagttggatttttacatataaataaaaaaagaatcccttttatttttctctctctcagaagacttgctctggggttttgcttggaggagctgatcatatcctgcatgtcagagatttcattttgtttgtttttctgtttgtttgtttttgatgactttatttacatttgaactgcctctttttgctagtgttgtaatgatgatgatgataaaataataataataatagtaataataataataatggtcagctgttcccagattagtaagttatgtataatttattttatttctccctttctattttattctgctctgatttggaagtgcagccaataagctgttagatatttaaaacaaatttccatctccaactcatatatgtatgtatatgtatatatatatatacatatatatacacacatatacacacacacacacacatttacccacaattttacttctctttccgtaagttttctcttttttaagaattttggccccaacaatatcagttctgatgtttaaaacaaaggagtgaattaataggagggtcgtgttcaatcttaattaacttatgctctcatcactcattttagttatttaattgccacagtcatctagagccaatttttttttgtttttgtttgttttgtttttaagcactctggataaggaaaaaatagacacttgtttttatatcatttttatgtacaatgtgaaaacagatttttaaaaaatttgttctctgtctttgttaacaaattccttccgatttatgtgggttcacctctcacgtttgctggatacttactttacaccatgttatgaaagatgctttgttttcatttcatgagtttgggctacaagaatactttgttttagctccaggtagatgccattgaaggcattcatggctgaaatcaattctaacacacttaccgatgaattgacaacactttggtgtttggtcttttttttgttatattttgttttatttgaaggggaaaacaaaattgttaatggtgacttttaactgctgaaattcaaaatttgattttagttaggtttatgtccgagactaaactgtgcatgaaccgaaacaaaaagcaagttcataccgctgcattctgttctcttgttctgacggttaattcactggacatcaaattttctttgccctagttttccccaaaagaaaacaaaagcaaaaatagttatattaatgttgaaagtgctttgaagtcacttgataaaaggtgctatgaatagcaacttactgtgttactacattgcctttttggcattggttgatttataattttggtaaaggatcctaaaaccctgtattctttttctgtgccccataatgaccaaaaaagataaagaaaatgagagtaagatcaaaagatcaaactaaaacataaacagtctccttcctgtctgctttcttacctatctgttcacactttatctctttccctttctctctctctctcacatgcgcgcgcgcgcgcgcgcacacacacacacacacacacttgccccaacactgagaaataatcttgccagaattctggtttttatagttgttgtagtccgtttctctaaaaatagtcctgttttcatatgaatctaagagaacattaccggagaaaataaagttactcatttatagttactaataataagttagtgattaacttaccacaattggataaaatataaaactattcttcagcacatttatacctaaattagtgaagtccatttgtgaagttcatttggcatctgcagttaagagttaaccatgtataaaatccctcccaaagaacataatcatcgttagaaccaaatcctcttataaagaacaaatataaaaaagttttctgtggtgaagctattttatagatttgatttccggagtagaattttaccttaattcacttaaagaaaattaaccattttttggtccaacttcagatattttcttaatccagaagctgtgactgttcccagaagaaacctcttatatcacatttaaaacataaaaaataattacactttcactcattctaatgggtaaattgttgaattgtaataaacaactgtatatttacaaacaggtttataaggtatttgtctatcaaattaataataaaataaaacttacggggtctgcaaggaaaactatgaaggccacttaaagtggttcaggtatccctttgtcttgtagggcatagctgttggtttagccaggcttttacagtatttaattttaaagtatcctataactatcaacttcccaggttgaagacgatgtgttgagtttcctactgattgattgattcctgtcctccccagtgtttccgtcactggttcactaaaacagtatttatatagctccactggctctaaagctcttagtccttctaatattttggattttacaagtaaaaatggaaaaaaaatagaaaagagacaatcaaatgcctggagcttaaaacaaagtatgtgcaacctaccatctcacttgaaatttaataaaataataagtaattatgtaaatataacatagagttatagatttatattttgttcataacacatagtgtaatataagttgtatattttcatgtttttggttttatgttatcattcatgccacaataaaaataaaacaggagtttatgtgctcttaaaaaaaagatgtgggttgccaccaacctgtttttcgtttttgttttttgtttattttattttatttttttgcattctcctttttcagtattactgccatgcaaggcaccaataaaaacagcaaatgtgttctt

SEQ ID NO: 554 - DNA, 17302 bp, Homo sapiens
gggccggcaggaacttgcttgtgattggatgttgtgggacggcggcttctcattcgtcagcctgtgactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaaggtaaggggccaggccgtcgcggcctcctggggcggtcgcgggatgctggcgggtggggacacgagctgcacagattcgcccgcccgtgacccgtgtcctgtcggctctgccctcccgcagtggaaatacgaatcaagcaaattgagtcagacaggcagaacctcctcaaggaggtggataacctctacaacatcgagatcctgcggctccccaaggctctgcgcgagatgaactggcttgactacttcggtaagagctggagagcttccctgggcggaggccaggagccccttggggttaggtgacacccttcagaaagggctcgctcagatgtcaccttttaatgagatctgacatgaccacttatggaaaattgcagaccctttcactctctgtctcacttccctacttcatttttctctatgaaaaatgggggggtggttggggggcggcgggcggggcggtctctgtcggacaactcagctctgctgtttacaggtccaaaacagctgtagtgaatgggcatggatgggctgtattccaataaaattttagttatggatacactgaaatgtgaatttcacataattttcacacatcaggaaatttatttaattttttttaaacagagtctcactctgtcacccaggctggagtgcagtgcagtgcagtggtgcgatccctgctcactgcaacctccaccttctgggttcaagtgattctcctgcctcagcctctggagtggctgggattacggtcgcctgccaccatgccccgctgatttttgtattttcagtagagacggggtttcaccatgttggccaggctggtctcgaactcctgacctcaagtgatccacctacataggcctcccaaagtgctgggattacaggagtcagccactgcgcccggccagaaaatagtatttttaaaaatatatgtatattttacccatttaaaaatgaatgaataaatgacatggttagttaaccagagctcagatagaagaataacccgaagcagctccttctgcagcttatggaaattgctaacctaaaaatgggcgcatcaggctgggcgtggtggctcacgcctgtaatcccagcactttgggaggctgaggcgggcagatgacctgaggtcaggagttcgagaccagcctgaccaacatggagaaaccctgtctctactaaaaatacaaaaaagttagccgggcgtggtggcgcatacctctaatcccagctactctggaggctgaggcaggacaatcgcttgaacctgggaggcagaggttgcggtgagctgagagcacgccattgcactccagcctgggcaacaagagtgaaactccgtctcaaaaaaaaagacacatcagttttcctggccagagaaaaatcccagcctgtttctgcactcccttattaaatgtccggagaaatgcaggaggctgtacttttctgctgggttgcccttttctgttttccttattattaactatccagcatgtagtctccttcctggatagaaatgcatggtctgctcacatattagacattgaatgatccttttgacttgcccttttatttattaagccattcatttgcttatttctccaaatactgagcatgtgtcagtcacagtgctaggtgctaaagatgcactagggaataaaacagacattgtctctgccttcaggaacatacagattagtagaaaagagctattagaaaaatccacatacaattatgtaattaaaagtataggtactacaaaggagatagaatagagtagtggtcagtgagcatattgtgctttctatgccagatgggcattgtaccaagtgttttacatacattaactaatttttcttcataactaataatatccctatttttcaaaatgacaagattaaggcacagagaaattggacactttgctcaaggcctcataagctagttagtgggatagtctgtttgaacccaggtattctggtttcatagcctgagatcttaactgttttacaagatactatgagagtttctagcaggaggttctaacctaactttttattctacatgtaaatctcacaaagaccttttcattcaacacgtttactgtacatctattgactgctagatttttgccagaagcaaaggatgtcatctctggaattcagtccaaggcagggatggacatttaaacagctttgagtagttattgggtataatgagggtgagcaactaactctacactttgcagcaaactgctgagatagaaaaataagcaggctgggcacagtggctcacctggaattccagcactttgggaggccaaggcaggtggattacttgagcccaggaatttgagaccagcctgggcaacataacaagaccatatctttaagctttaaaaaaaataattaaaaataaatttttaaaaaagaaaaataagcagagggcagggcatagggtggggattcatgcctataatcctagcactttgggaggccaaggcaggagtatcacttgaccccaggagttcaaaaccagcctgggcaacatagcaggagaccacatctctacttaaaaaaaaaaaaaaaaaaaaaaaagacaacctggacaacttggcgaaaccctatctctacaaaaaaacacaaaaattagccgaatgtggtggcgcatgcctgtagtcccagctacttgggaggccaaggtgggaggatcagttgagcccaggagacagccaaggaggcgccactccactccagcttgggtgacagagcaagactctgtctcaaaaataaataaaatttaaaatatattttttaaaaagaaaaataagcagaatttttggggtgatgtttgagctgagttttgaaggatgagttagaaatttgttaagtacggaggtgaatttcaggcagaggaaatacaaagtaccatggcaacaagtcatgagagtcagtggcacatttgggatataacttggagaaagaatagattagatggtgaaggtccttgaaggttagaccaagggctggaccagttttagaaagataaatggtactattaggcaagatgatttattgttaaaatgtaatagtaactacaacgttctttttaaagcccttggaggaaacaaacaggccctggaagaggcggcaacagtaagtgacctttcctattttccagccagtggttacttaagtctagtccagtccccagatccaactaatagatgcttactgtggaagaggtttcataaagggacatcatctgtttgtgtcaactgaaaaattagagttggaccagacactgtatacatgagacccagatagttctgagccctacagaaggtggcagttctgtttttgaccaatttcttgcagtcctttgttctgaactctacagcggaagtagaaagcctcaagcccaagttcctttaagcgcctgagtcattacactatgcattggcctgctagatgataaaggtgtttcatcatgtcgtactgtagaagcagtgcttttgcttgggatgctcagtattccccaacccctctcatctccttcctcccagcatcagtgccaggattgaaggcagtaagatggggatgcaaaatagagcatttaaagctgcactgtccagtgtagtagccactgggcatatgtagctatttcagttaattacaattaataaaattaaagaattcatttcctcagacatactagccacattttacatgttcaatacctacatatgactagtagctactccatcagagagcacagaaatagaacattgctactcttgcagaaagttttatgagacagcattgggaactagtccatacatgggcttcacagagtccctaggcactctaaaataatatacaaacaatgcgtgtgtatgcacgcatttgtgtatctttctgttagtttattgtagccttgatcagatttacaaagtaaaccccaaaattacatcttttgttgagttgatcagaatcatttggaatatcagggtttgaaggagtctgaccaccaagggcacatagcagatctccgccagcttcattcagaaggtaaaggtaatgaggagccaattatcaatttggaaaaaattggagcatttgggagagaggtggggattattcacccccctacatacactgagctccaatgttttaaaagagttacctctgagatgaattatgcttactagctaatgcagttctctctttttaaattagaaatacagaactgcaaatgagaacttctaatgtaatatgagagagccattgttaccacaccaagttgagagaattctagccttgactaatatgatttaaaactccagaaaggaacgatagaaaatctataaaagctcttagttgggaagtgtgttggggctcccaagaccacctccaggtttggtgattcactaggaggattcatggggctcagcatacagtcacacccatggcgatgatttattacagtgaaagtatacaaagcattaatcaacaaaggagaaaattgcataggacaaagtccagaggaaaccaggcttctaggagtccactccctgtagagtcaaacagaacatgcttaattcaacacatatgaaatgctgtctaccagaaaatctgattagagagtcaatgcccagagttttaactgggggctgctcacataggcatcctctgcctagcacatgtcaaaatcctagactttcaggagggaagtaggtgttcagcatgagccatattgtttgcataaagtttaggcacagtgaggcatcttgttaaggaaaggtgggaatctttctgaaatcaagttcccagatgccaaccgaggccaggcttgcaaacaggcctttctatgtgtatcagtctcaggcctgctctgttaactgtcctgcacagtagatgcccagtggcctgccaccactgatgactccataaaatgccagttgtttctagagatggcagaaggttggcaggaatgcccctactttctgttgcatcaagcctggcaaacatcagtaacttattacagccctatttcttgctaagcctaagacagcctcagaatccttctctgagtatgtcaagcagtccctaccagaaatgaaacctgtgccattccaaacctgtagtaattattctgatgtttacatgtgttctataaggaaaggactgtgaatcatgactgctctttgtagtgcccatacttattaccatatgaaaaaaaaacgaatttgaatggtgactggaagcctttttgaaggacccaggatcatcatagaaaaccttattgagaccctgtagatttatcgaaaaaatggtaagcttgacacaccaccaagtgttgtagaggatgtagatcattaggaacttgtattgtttgcagatgggctgtagtcaagggtaaccactttgggaaacaatttggcataatgcgaaggctgaatatttatgtaacctataatccctgtcatgtcctatccaaaggatagagccaaggggaaacttggacatgtacctcagacacatgtaagacagttcaaggtagcagtgtttataatagcaggaaactattgatggaagatggacaaatccattgtggtatattcacacagtgggatatgatatagcaatgaaaacaaattaactacaaccacaaagagtggtgaaaacagccaaaaccaaacaaaatgcttaagtacacacttgtgaaaaagcacatctgtgtgtgcacacatgtatacacacatatgcatgtatctgtgagcacatacacatgtacctttcgataaagcaagtgcaatgatatggttacccctggggaatgaaggattaggagactcatcacctttggaagaagagataagaaaatggaacaaggaatgaatacagagccagaagcaagttattggcaatgttttaggtcttgggctgtgtggtgggtttatgggagtttgctatattgtatattgtatcactaacatttaacagtcttatgtattaaataatagttttaaaaaagtttttatcttgaaatattgttcctcatattttggtggaataagcctggtgctttctggctatgtttgtcataggctgacctggatatcaccgaaataaacaaactaacagcagaagctattcagacacccctgaaatctgccaaaagtgagtacctttcaaaactccttgttgtacagaaagaactgaggctcaggttgcttggttggctgctcaggcagcgccttgttggtagagcctcttccctttaatgtctggttcttaatcttgtaaatccaaaaacttgcttttggatggtgcatttagttaattttttttcccccgaacagcaattcaaaccagaaatttagttaattttaggcaggactgctaaaaaccaaactcaagacccgtgtgcgagctaaaatgaaagtgaaaaaaggggggaaaaaagctgtgctagaaaccaaacattgttgcctgcttactttctcctgggttaaatagatgacaagatttagagaggtgttaaaagactggtaacaccaactgagacgctccctgatgtaatcaacaaagttgaaagcgaattgaaaaaggaatgactttctctgcatataattcaaaattactcaattcaggccaggtgcggtagctcacgcctgtaatcccagcactttgggaggccaagctgtgaggattacttgagcccaggagttcaagaccagcctgggcaatgtagtgagaccttgtctctgaaaaaaaaaagaaagaaagaaaggaaaggaaaggaaaggaaaggaaaggaaaggaaaaaaaaagttactcagctaggcgtggtggctcacgcctgtaatccaagcactttgggaggccgaggtgggtggatcacgaggtcaggagttcgagaccatcctggctaatacggtgaacccccgtctctactaaaaaatacaaaaaattagccgggcgtggtggcgggcgcctgtagtcccagctacttgggaggctgagacaggagaatggcgtgaacccgggaggtggagctggcagtgagctgagatcatgccactgcactctagcctgggcgatagagcgagactctgtctcaaaaaaaaaaaaaagttactcaattccatgatctatccacataaaatcatcttacatacatgtcccgcactctgagaaacactgtcttataggaaaagttgtatgggaaaccaggttttgactagtgagcaaggaatcggatcaggatgaattgtgacatggacttaatgtcactgtcattaagctatgatagtttgatgcatccaattcttataagaacatcctgacccatggccaggatttcggggctacacaccagggcacgctctacagtaggcagggcaagctcaattattcagaatgctgggctgtccctacaaagcatcatatggggtctcttaacactctggttagtttcctttgtctaaaccctctttcttaaaaagtcttctttatttttagtccatttcttccttgcagcttaagattgtgtacattttattcctataagaaatgtgaatgcacaaaactttattttcatcagaaataccaccctgttgaaactgtttcttacagcacgaaaggtaatacaggtagatgaaatgatagtggaagaggaagaagaagaagaaaatgaacgtaagaatcttcaaactgcaagagtaagtggacactgaggttggaggctgggggttatcacaagacaagcaaatacaaatgcataaaatacactgttgtacaccagagctcacagtttagtagagatgatcctactttacatggcaatgacaaaagagataattgactggtgtgcaaagtgtgtagaacacagaagaggaagctagcaagcctcccctaccccactaggacatagacaggcctttcaaggtgagtgagagtctactagctagagaagaaagggaagaggaacagtattcaggatagatgggggaggcggaaaactgaagatgaggaaaccagttagaagcctatgaattcttgaactgacatgctgacactatagaatgaagggatggtttttagataggttttagaaagaagtggcatggttggtggagaaaaggaggaatcagagacaactgcatggtttctagctaaggcaaatgctatccagtgaggtgtgggacccaggtggcagagggtgctggactgggggtggtggagcacatgccaattgcatgacatgttgaccattcattacttttccaggacatctaggctagacagaaatttcagcctggagctcagggagaagagggagatttgagagatacactgcctcccagatctttaggtgtttgtcccagtgtgggagtggagatggttgtgcagggagagcaggaagggagggagtcagggtggacactagagggagggtagagagaggagctcctaaggcagactgccaaggaagttagagaagcaggaaagacagatccatcacggaggacaagggaggagagaatatatggaagataaggagtgattcttgccagggacctcccaggccccaggaagggagcactgcagggtttgcctttgattgggcacctgggacgccctgagtgaccttcacagcagccctttatgtaaagtagtggggtacaagccaggctgcaatcagttcaaaagagatttacctttaatcttggtcaaaatcctctattttgaaaacccagccagtggaagtccttattcaattagttatgttctgaactttttaagtcattgaattctgagatacaccttattatatttagtattaactatccaaagcttgttcttaatgctttaaaaaaaaaaaaaaaaccctccttaccttcctctttgctgggttttttgtaaccttagtctcatttgattgtgactgcaggtcaaaaggtgtcctccatccaagaagagaactcagtccatacaaggaaaaggaaaagggaaaaggtagtggattttctaaagttgtggtgttttgggttttattggagagccatatatatcatggcagaaagtgaggggcagtgaaaaggctctggtggctagtgtttgaaagcagcttaaaatcactgaatccttgagtatccaagctggaggggtctctagaaatgacctaaaccaaaaccatctccagtactttaatgtacattctctatccttccccacttttttttttttttttttttgagacggagtttcaatctcgttggccaggctggagtgcaatggtgcaatcttggctcactgcaacttctgcctcgcgggttcaaatgattctcctgcctcagcctcccgagtagctgggattataggcatgtgccaccatgccggctaattttgtatttttagtagatgcggggtttctccatgttggtcaggctggtcttgaacccccgacctcaggtgatccacccacctcagcccccactttttttttttaagtatagcaagaactgcctgttatgtttcagttcctgatagtccatatgtagagctaccccatagctcgtcatagagtggctgtcacttacctataattggtttcttgaaatgttttgtccagtcctgcaaagtgaagaacctctatgggcttgagttgattatactggactctaccataagccatgtgggggaaggtacagcagcttaggagagtagtcaccgggatgcatgtctgtggaggagcgaactcatttctcttgagcagtgcagcagctgcctggcacaaggacagaattccagctgggggagccttcgcatgaagaggctgtctccttgattaaaaagtcagattctgaggctgagtgtggtgtctcacacctgtaatcccagcactttgggaggccaaggcaggtggatcacttgaggtcaggagtttgagacccgcctggccaacatggtgaaaccctgtctctactaaaaatacaaaaattagccaggtgtggtggtgcatgcctgtagttccagctactcgggaggctgaggcaggagaatcgcttgaacccaggaggtggaggttgcagtgagccaagattacgccattgcactccagcctgggcaacagagcaagactccgtctcaaaaaaaaaaaaaaaagtcagattctggaggcagactactttggttcaaagttttggctccatcctaattggatatgtgatcttgggcaagtttttaaaacttgatgcacctgagtttctgcatctgtgtatgaggatggcagcagtgctggcctcccgtgttagaagggtcacgtgagtcgatgtgtgcgaggcgcccggagcagtatctcacagtcagctctccacgtgtcactcctctgctgctgccttcgtggaacctgagagttggcatacctgatggccatttcttacctgtaggtcaagccgtgctaacactgttaccccagccgtgggccgattggaggtgtccatggtcaaaccaactccaggcctgacacccaggtttgactcaaggtgagtatcgagggaaacacttggatttgatgggactccaacattgagcactacccagagaaggagtgtctaagaaaatactcctaggccaggcacggtagctcacgcctgtaataccagcactttgagaggccgaggcaggcggatcacttgaggtcaggagttcaagaccagcctggccaagatgatgaaacgctgcgtctactaaaaatacaaaaattagttgggtgtggtggtgcacgcctgtaatcccagctactcaggaggctgagacaggagaattgcttgaacccaggaggtggaggttgcagtgagctgcaattgcaccactgcactccagcctgggcaacagagtgagactctgtcttaagaaaagaaaagaaaatagtcccgagtccttggcctgggatgccttgtcagaggacagtggccagctgggtttcctggtgtatgcctctcccttaagtgtagtttcacctatcttcagtggcaaaatgattctttaatgggagggaggtgaatattctgcctgtgatgactaggaggcctctaggtgacgtttttggccttttctgattcaaatcagaaggtttttattttatttttaaaatatttatttattatgaggcagggtctcactccaatgcccaggctggagagcagtggcacaatcacggctcactgcaaccttgacttcccgggctcaagtgcttctcccaccttagctcccaagcatgccaccatgcctggctaattttttgtttttttgtagcgatgggatttcgccaggttgcccaggctggtctcgaactcctgagctcaagcaatctgcccacctcggccttccaatgtactgggattacaagcatgagccatcacacccggcctcaaatcagttttttaaagatgagtaggcactctcctgtactcttggtagaagtaaaaattgatactgcttttttggaggctggcataagcgaggatattcttgcagcataagttaataccttccaaagaacctagttgaccaaataggagatgctgtatagccattaaaaaagactggatctgtgtgtgctgacagggaaagagcaccgtgatcacagagcatctccgagcaggttgctgaacactgtgctgtatgatcccatttggttttatatacatacaaagtttctggaaggatagataaggaattcagagtggttacccctggggaggagagcaagaagtggttatctctggtgtggggaagtgttgaagatttattttctacttttaattgccactttttttttttttttttttttttttttttgagacggagtctcgctctgtcacccaggctggagtgcaatggcacaatctcggctcactgcaacctccacctctcaggttcaagcaattctcctgcctcagcctcctgagtagctgagattataggtacatgccaccatgcccagctaagttttgtatttttaatagagacaggattttgccatgttggccaggctggtctcgaactcctgacctcaggtgatccacccccctcggcctcccaaagtgctgggattacaggtatgagccacggcactcagccagttcccacttttctttactgtttgttttctcacatgaatatgtaacaaaaggcatttagggaaaactaggtagcagtattttaactgtcttgagaaattagtataatgatgtaatatctaaatcatcctcctttgcctctgaaaaattcctcttgatggaagcagccacgcctggaaacaattaaccagcgtatttctggctttgtggatggatggatgatggcacccatatggagctttggacctaaactttatgtggataagagttggctttttgtaagatgtatgttcaataattacaaccttctttctccagctgtgtttagtcattactgctttaaaacattttttttttctaaatttagaacgtgctttcttaggaatgtatgacttaaaaactgcaacttgaggccagagtaaggttaaaatggcctatagagtttggtgtcatccaattgccaagctatcttcacagagattttcccattctagggtcttcaagacccctggcctgcgtactccagcagcaggagagcggatttacaacatctcagggaatggcagccctcttgctgacagcaaagagatcttcctcactgtgccagtgggcggcggagaggtgaagtatttccaagggaagccaggccacagtgtgctgcttagtcaagcatttcttttccctgggccctcacccacgcttcaccctcagagtcctttcagtgcgtgggtcctgatctccacacttctgcgggactcagaacccagttttctctcccaggttagaggcccagactgcaaagatcgttgctcagctctgggttctgtttttctgttttttggttttgtttttgttttttgtgggttttttttttttttttttgagatggagtcttgctctgtcaccaggcgggagtgcagtggtgcgatctcggctcactgcaacctctgcctcctgggttcaagcgattctcttgcctcagcctcctgagtagctgggactacaggcacacgccatcatgcccagctaacttttgtatttttggtagagatgggggtttcaccacgttggccaggatggtctcgattgcttgacctcgtgatccgccctcctcggcgtcccaaagtgctgggattacaggcatgagccaccgtgcccaccttttttttttttttttttgagatggagtctcactctgtcgcccagcctggagtgcagtggcacgatctcagctcactgcaacctctgcctcccaggttcaagtgattctcctgcctcagcctcctgagtaactgggactacaggcacatgccaccacacccggctaatttttgtatttttagtagagatggtgtttcaccatattggtcaagctggtctcaaactcctgacctcaggtgatccacacacctcagcctcccaaggtgctgggattacaggtgcaagccaccacacccggcctccatctgttcatcaactaacatttgcccatccgattgtagtaggcccaagaagtagacatggggcctgcccttagaaagcagctcagtggtcaagatgggtttgcaatcatggtacctgtgatatgcgcaataatagagatgttaaagggtggtgcagaggagggcaccaccgaggtatgcgcttagtctagaacccggaccatgagctgtgccttcagctttgtataacttaagggattctgaagcaagctgagctcagtgtctctgggctgcatggagcgagttgctgacctcagcccctgtgaggggaggacggtttgtttcagacatactctgcagggcatttcttagatgatgtgcgtgccttttgtgcccaggtaatccagcctccaccctagtgatagtgctgatgaagtcattgtctccttagagctaatatccttcctgcctgtcttgccacttctccatcccagccattccccaccactaagtgcaggatatcaggggaacctaggggttccggccctaagggccatggccagtttaacccactcccctttctattcagagcctgcgattattggccagtgacttgcagaggcacagtattgcccagctggatccagaggccttgggaaacattaagaagctctccgtaagtctcatattcatctccacacataggatgcctccagtagctttcttgggctacctttatttaggattgtcttttgggcctgggctaatactttctacttaaatttgtgttgtcttccttcccccaagagattttgactcttaccctacttagatagcagcagttctgttcctcagttgatgttgagttttgttcaatcccagggtgcctgccacagaagttccactgcaaaatcaaaattctgcctcattcaggcagttagtgctaggggtatgttaggtcactattggccaccagaaagtgaaacctagagtagctcaagaatgagggtcggggcttgttatcaggaatcttacagaatcaaagagcgagctgaacggccaagcctctggagtggtggggcccatcagctggggcctgtgtgctcatttctctcacacatcttcattcctccctcagcagataaccttctccacaggctccaggttctgtgcttacttaacattgttttgcatgtggctttgagtaaccacacctccaatcccaactttattgctctattgcccaattgttcaatttcttgtcttggtttaaattctgaagagggccaggcacagtggcacacacctgtaatccctgcagctcaggaggctcaggtgagagaaattgtttgagcccatgagttcaaggctgcagtgacccatgatcgtgctgctgcactccagcctgggtgacagagaaagacctcagctctaaaaataaagtaaattatcaatttaatttaactgaagaatgtaatggctccgccagggatgaacctccttggtctggtcagccatcatcttgggtggtggatgaagcacttagtgtaaacatggcaaccttaccctcatccttctgtggggtctgaagggtacatccaaggaaggggacaaggcggggctggtttcctaaacctgtctttctgaacataggcccagtgctgagatcccacacacacctagccacccaaatcttgtgactgtcatcctctagctagatctattgcaatgttcttctcaaatctatgatacctttactgtctcacttgagttgttattttactcccttgttcagatgagaaacaggttcagaaaggtgaattcatgtgtgatacagatagagaatggaggggctcaggctgactgtgggaggccaaggggcaagcctgccaagtgacatcttctacaatgacctctctccttttctttttagaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggtgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttcttttgtaa

SEQ ID NO: 555 - DNA, 19485 bp, Homo sapiens
attaggaacttcatagctgcaagctaagggaatgctatccatcctgaaggattgcctattcaacaaaaggcaattggggtttgtcttattgctgcaggccttgcttctcagtcactgactgactgttgagagccaaggtgagaagactgttcatctgctcctcaaatttagacctggacaaacttctggcatgtactgcatgacttaactccttcatttgctcattctccctcaaacttcacccatcaccaaactgctaccaagatcacagccccctttctctcttcccactaccaaatctcacctgggcaattagaaagtaactcttctctttcttttatttttccccccccctccccttccctcccctcccttcccttccctcccctcccttcccttccctcccctcccttcccttccctcccttccttcctttcttcccttccctttctttctttccttcccttcctttctttcctttccttcctttttcttttctttctccttccttccttcctttcttttcttttctttctccttccttcctttttttttttttttttttgagacagggtctcactctgtcactcaggctcaagtgcagtggtgcattctcggctcactgctgcaacctccacctcctaggttcaagcgattctcccacctcagcctcctgagtagctgggaccacaggcacgtgccaccacgcctggctaatttttgtttttttttttttttttgtatagagggggtttcaccatgttgcccaggctggtcccgaacaagtatttcttaattgccttgttttatcaagttattttgctaagtgttatgatgtatctttaacatagtgtgtccttgtttatttacattacagtggatatcctttgcagtgtagaaggaaaacataatttatatctgatactgtagagtatccttgagtactgcatatgaatataccattgatgagctcattatgtgttgaggaaattagataattagtgctttaaatgcttatactgtcatgcattgtttaatgacagacacatttttaaaaatgtgtccttaggtgatttcatagttgtgtgaacatcatagagtatacttacacaaacccagatggtatagcctactatgcacctaggctgcatggtgtagactattgcttctaggctaccaacttgcacagcatgtgactgcattgaatactgtaggcagctgtaacacaatggcaaatatttgtgtatttaagcatagaaagggtacagtaaaaatatagtattataatcttagaaaactgcttgtgattgtgggtgactttgttctttgcttctcatgttttcagtttcctataatgcacacattaacttttaaaaaataatcttaaggaatcactgtcatatattcagtctgttgttgactgaagtatagttatgcagcacattactatattatgaagatatacttgagttgttatataagttaaagagtattgttggtgatatttaggacaactggttagatattttgcatgaatatggaatagattattatttttcctatttaaagaataggaaatagaatataggctaactcttcccaaaattgctgtccaaaatattttcaggaatatctcagattcagataatgatgagtgtaggctctaggtgtaatagtaaagatgctgacatttctagtcttcactcccttatgtcaggagctgcctaaatagggcatctccatctctgggtggcaaatgctttatctcagagtttcccttatgtgcatctgatgctgacaccaaggaggtcatggctatgttcctttcctccacctaaaccttgtcctttgaaacttctctatcttatatttatgttagttataatattatttaacctaatctaatattctaacatacagaaataataggaaaccccatatctataggaataaaatgatagtttttgtttcaataatggccttttgtggaataattagagtccctgttgtatttcaagcactgtgctgtgtgctgtacagacattttctcattatctcattcaatcctttcagccacctacaattatcctgttctatagattaagaaactgtattagaaaggttaggtaatttgcccaaccctatgtattagtaggggatatgagacaatctagtctcaaagattacgtttgggtcaaaattcccatcgctgtgttttcactgtaaactgacaaaattatgggttatttttttccttgtaatactttgtagtccttagtaaaagtgtgtactttacataaagattatattaatttgtgtattttataaagctttctcacatatatgttctttctgatccttataataatccagggaagtaaaggaaaaaaaacaaaaaatctggaacaaaattaaattcatattctccagattatgaatcctccaagggcaagaatcttgtttagttcattttctgtctttatctggcagagtgaattgagtgcaaaaatgaacaaaattcttccctggccccatacccacctttgcaaagtgtctggtggatttgtattatattaagttagctaattcggagctactgtttcctagaattctattccttgcatagacaaaggtcagtgtatctgaagtaaggaagcagcagcgatattcttttttatgcctgaagtcttctgactcccaggccaggtatatgtttagttccatgaagaagaaagacagcttttcctgcagttcacctatcactgaaggttggggcttggaggcagtgaggaatggctgtacttgtggcccattctcacaggctctagtttctctttatttttccacttcacatccgtctttccttcttgactatggtcattatcttcagacttcaggctctagcaccagacacagaagcaacagcctcccacacactgtttaatcagctatataatagacatatatacaaagatatctatgtacttgtttatttatttatttagccttccagtgattctgcttctctagtgaaaccctgacagacataactcttccttatccctggaatctggactgaccttgtgacttctgtgacttctcattaatagaatgagacagaagtgacagggcctagtactgggcctagccctcaaggggcctttcacattctctctcctgaaatcctgggatcatcatatgactaatcccaggctagctcattagaggatgagagactcctacatggagaagagttcagttttcccagccaacaccatcctagaccagcctatagccagttgtcctgccaaaatatgaatgaagccagccaagatcagcaaagctgtctgtccaatccccagtggacctctgaggatgagtgagcccaggtgagaccagacccactcagctgacctgggctctaatgtgcggtaaactatgaatgcagattgttttaagctacaagttttgatgtgtttttctcacaataatgactaactactgatgcatccagtatattaaattttccttcttttgctgtgaaatatacatgcagaaaagtacataaaccatataataataagtaaatataaagtgaccatacatgtaaccaccacctatgtcaagaaaaagagcatcaccagcaccaaggaagccccccactttccccaccctgtgttgcctctcacttattactccatccttccctgctctcctgactattgagataatcattctcttgcttttttgtatagctttaccatgtattagggaaaatgggattgttcagttttgcttgttgtcagcctttatatgctgatttttttctgtcactttcttttgcatcatgcttgtaagattctccaatgttgtgctgtgtaggtataataatgttcactctcattgttatgttatgtcccatttttttaatatacctacatacacctacatttatagatatctggggtatttccagttgagactgttaccaggctttggattttagtagtcttgtatacatattctggtatacctgtgcatgagcttcttgaaagtagtgattctcgtactttttagcctcagaggttttttttgttttgttttgtttttttaaagacaggatctggttttatcactgaggctgaagtgcagtggtatgatcatagctcactacagcctcaaactcctaggctcaggcaatcctcctgccttagacttccaagtagctgggactataggcatatgccaccatgcccagctaatttttaaaaacttattatatagaggaagtatcactatgtttcccgggctggtcttgaatgcctgggctcaagcaatcttcccacctcagcctcctaaagtgctaggattacaggcgtgagccaccatgctcagctgggcctcagaatcgtaaaaattaaagattaaataaaaattttcaaattaaaaaatgtccaataaaggttattgagatctgagatatttaaaaatatttgataattcatttaaaataaacaataaacccattacatattgcattagtttcctgaggatcccgtcacaaattactacaaatgtgatggcttgaaacaacagaaattttttctctcagagctggagagtcaagaagtctgcaagtaaggtattgccaaggttgataccttctggaagctctgaaggagaaggtgttccaagccattctcctagtttcccatagcgatgggcaatccttggtgttccttgacttgtgaacatatcattcattccaatctgtatctttgtcttcagtatgccattcccctcccccaaccctgcccctgtatctttgtgtctgtgcatctcaaatcttccctcctcttataaggtgtgttagtccatgttcatactgctatgaagaaatacccaagacagggtaatttacaaagaataagttaaatgaattgatagttccacatggctggggaggcctcacaatcatggtggagggtgaaggcacagcaaaagcacgtcttacatggcagcaggcaagagagcgtgttcaggggaactgccctttataaaaccatgagatctcatgtagctaactacctgttataaaacatgaacaatgtttataaacatgaataatgcattatacgtgcattatatgtttataaacacaaataatgcattataaacacaatactgctttatgggaaacataaatgaatgggaagaacccgcccccatgattcagttacctcccaccaggtccctcccatgacacatggggattatgggaactacaataaaaccatcagatctcatgagacttattcactatcaccagaacagcatgggaaaaatctgcctccatgattcaattacctcccaccgggtcccttccgtgacatgtggggattatgggaactacaattcaagatgatatttgggtggagacacagccaaaccataccataaggataacagtctttagatttagggcccaccctaagtcccaggatgacctcatcttgagggccttaacttaattacatctgcaaaagccctatttccaaataaaatcatattcacaggggtggaggggttgaaacttggacatgtattttttagggggacacaattcaactcactgcacacatttacataaataacacatcttttaataaaaatattttcgaaataaaaatttagcaagaagagtgaccttatttttgtaaatctttcatatctagatttaaggaagaagctgggtgctcatttcctttgatattcaatctgttatgctgttttggttgaaatatataatgaaaatccagcttcatacagatcattacataccctctgaaagggtttcaggaggcttctggggacttcagagcaacacttgagaaccactgctctaaagcatatactccataaatatatgtaaaatggaatttccaggctgtggctacatattccaggctatatatatatatatatatatacatatatacacacacacacacacacactgtatataggtgtgtgtgttctgtgtgtgtatacatatattctactttattagataatggcacattgttttccaacttgattaaccaatttactttttcactagcagtgtataagaggttttgtggctctataagtcgaccaatatctgttattgttacacttaaaatttttgcctatcttgtggtatgtaatgtattgattgcactgtgacgtttaatttaacaaaagttcatctagtgcttgctatgtaccaaccacttctaggtactttttccaaatattggtactttgtaataattctctatggtaggtgctattatctccattctacagatacacactgaggcagagaatttaagcaagtggccggacgtcacacagccagtacgtggcaaagcagggattaagcactcctgcagtctgctcttagaattcgcgctccttgcccagctgcttcccccaaatatttattattacttatgagaaaactccgcaaattgcaaagcgctctaccaccaacgattagcaccctagggcaaaatgagccctttaccactccctagatgctccccagcgctaagttcccagcggaggttgcagtgagcgcagatcgcgccactgcactccagcctgggtgacagggcgagactcttgtctcaaaaaaaaaaaaaaaaaaacaacaaaaaaagccagtgattggagcgtaattaccctcgccaaccgcctgtaaccacggcggccgccacgccccgtttcctggtctcgcccctctccgcccacgactctggccccgcccctcgtcccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtatcaggggcctagcagtccctgggccccaactcgcggctccaggattgggggtgtaacttgagggatggcactttcctgtccgtgtttccccgttcttaggctaattcaaaaatcgcttctaggtagctgatgcccagcatttgactttcctctaataaaccttgggtgagagatgttaagaccgggtgttaaaatatatgaattccagaaatgctccctttagcatttctttccatctcatttttaaggcctattgaactttcttccttaaaagattcccttaaagaaaatcatttatactctgtagtacccagtgtcaaccctctactctctaatccacacctccaatttaattggatttggagtgctgccaatgtctaacttcattgcttttcagttttaccaatattaggactgttggttaatacggtccttgtcattggaagagctccattacaggttgaacggccatttgccaagggagttgtagaaagaattgctgtgataaatgagaggccccttctgatatttgggattatataaaaaagaaactttaacagaatgtggtttattcggttggttagaacagtctttactgagcttcaattttggttggtaggcgcatttaacatttgagtagctattgaatactaggtgccagtggtacagaagtggtcgaaacagatagggtcactgccatcattcatgattcccctctcaccctgcttttcttaactggtatctgctcattcatcagaactgtgccttaagagcagtaagtaggatccatgaaggaagacttcctttggaaaattattttaagctgaactttaaaggatgagctataaacaccttggtaagggaggagggggaatagcctgtggtagtagtgaacactgagaatttcagggccatagagagaggtccaatatggttgggaataaggagccagagcaagggggtcagcaggggcaggccagatagtgtcttgctgaccatgttaaggatttgtttttcctgaaagtgtaggaagccatcagagggttataagcagttcagtgatatgacgagaatattcttggtagctgcattaataataacttgtgcaggtagagaagtgatggtaagatgttgcagagcggatgtggaaggctgattaggaggttattatggtggtctagacaagaaatgatagtggcttagagtagagtgatagcagtggggtaaatgaaaagtgaaaggattggagagaaggtagtaggtagaatcaacaggacttggtaatgatttggctatagtgggtcagggaggggaggccaaggatgacccttaggcttacttaccttcatggattagcaccaggggacagaaaagaagatagcaggaattgtgataaaaagtataagccgacattttctttgtttgaatttaataaacatttcctggatttttgtgtatgcagactcagtgattagtgctaaggatactactacaatggctaacaaattagcatctgttatgtgtagacagtatgttaagcatttcaggtatgttctcaggaaagcccgatatgaaattgttatagctcttactccttttttactgatgaaactgaggtttagataggctaagaaccaagggcataaaacgtagaagtagctaaatcagtaacgcagtcccaagttaaattcttaaccactttattatactacctcccagagactgactttgatctcagagagcttacacagacatatatagtcataaaatgttaaatgtgacaataaaggtacacactaggtatagtgctggcaggagacagaaggatcatcaggggacatttagctgaggagctgatgttagaggtgagtctgcaagataagtagccgttgctctacaaggcggcagaggagagaagaaggggccccaggcagatatgttcatgacagttccagcaggcctgaaattagcctgagctatattgctaacatttgtgcatggcattgaaaatacactgaataataatagttttgtgactatagttatatttattaatagtcacaaaactattattattagctttaatatgaagctattataatagctttgtgactgtgagtccaagggctttgggggcagtttgtaccagtttgtcaacattatttattggtaacaatgagattgatgatttgctcctggtcttcatgagaccacacccccaacccagagctctgttgttgagactagctgcgtagcaggaatatgcctatgtgaccagcaaaatatttaaaaatgcaatcaggactctattttgggttgcttggttccagggtgttttctttgcacacttgggtggttccagatctgagagagtatatgtctggccacacacctaacaaagggaagccgaaggagcccacacctgaccttttcagatctcttgctgtgaggcagcctttggctgtaatgttttatattcttttccttttggggctcttttcagtcccaagttaaattcttagccactttattatactacctcccagagactgactctgacctcagagagcttacatagacatatatagtcgtataatgttataaactgtagatttataacataacctacagtaataaactgtagatttgcaaacactgtcattttgatccgtgtgattctttagcaaaccctgttgaactgcactgtcagtgcagatgtaaagcaaagacttgttcagagaatttctggtagtctggtattttaggaacatagaacgagtaagggtgtgaataaaagaggttctgaagctacctgggaggaagaacatgtgaatagtataccattgttaagaggtttagatttgtctgcaggccacaggtaattatcaaaaagtttttaagtgattgctcaatggggaatgaggaaagatggggagatgggcaccccttcttcccaggagacattcggcatcattttaggagaagggcagctacctgcatctagtagttagagaccaggtatgctgtttaacgtgtcacagtgcacaggaccatacagcctcctacaacacagaattattcagttcaaaatgggaataatgcgaggttgagaaaccctgagttcgagggagaagatattgggtagtgggaagaccttttaggaagttgtggcaatagtcctgtctggattgtggtttcggaatgcgatgaatttgagaggggcaaaaagattgagagatttgtgtgatcatatggatagatagggacagttagtttgggatgatcctcagtttcaatagtaggtgattggacaggtttaaagggatactgttaagtgagattacttgttttaagtttgatggaagagaagtggggtgatgataagttctggtgctattcggtttgtatgtatgtgtttgattattcagaatacaatggtcaaatacgtataattcagtatagcaaaatgaagttattttcacctggagaaaaagttactgactttttggtgaggatggggattggtaaatccccaattgataagacacttttatatcaaaacattttatctgtatattaacatttacatatttttacagtttcataagtgcataattattttcattagattatcaaaatgatatgtaacatagttcattagtcatcttctctcaagtgagaaaaggtcacacagatccttcttttaaatccaaagtttgacctagaatgtcaggatgctaaccaagagagttcaaggttgaaaataacaatcttgtgctccccaatcacatggtggtttgggaacccttcattcaacccaatgtgtatacgttcactctgttcacctctctgcactccctctttcttcctactcagttctttctcatgtaaggaagcctttctctttaatcctttcccccttttgtctcttacaatacttatccagttaccgcaggaaaaatctctccctcctctgtacaacccaaatggctggaattgtaactgattaagcataagccgtggaaagtagttccacagttctgttcagactcatatcacctacctccaggcttccattcagtatgtttgccattaagtactggctttctagataaacagacttgttgtccttcatgttattttgtttttgctttaatcacaagagtttcaacaatattttatttaatcagttacgtgtctctcctcaaaacaaggttgtaaatgattatatacttttagaatagcccactccgttactcaacttatagtgtagttcaaaacaaaatgtatatcaaattccatataactgactataaaagaacttaataaatgtaatctatttgtaatttggcagtaaaatgagcttaagttctatgatagaagtatgaatggggtgtaatcctaaggattggcctaccttgttacttcactgtgtgtgtgcttggatgatgctaataggaaagtgggttagaaaattttcagaaggaaaatattgcaggcagtaagcttagaggttaagaatatgactttggagttcaagttctgcctttcccacttaatttagatgaacagtcttgaatagttcgcttatttaacatcagtttttcagtctgtcaaatggaaggaaaaaagtatattgtagggttgctgggagaattaagtgatctaatagatctccattaattagcacagttgtctggctagttcaaagtgaataaaagttggagaatacttgttcagtttctgtaaagtttagttgaagtaaaatctcccaagttccatccactggtgaaaatttaaaaagatagtaaaagtcctttgcccatcaccttattgccattttaataggaaatctgattaaatctgattaatttttcacacttttcacagtgatttttcttttttaatctcttacaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccaggtaaataaaaaaatcagcaatataatgttggtatatttaaaaggaggaaaaaagcataatttaatatcatgcactaactgatgagcatggaattttgagactgacagtctttaaaatctatcttaattcttacatgtaggcatttcacagagaacttcagacttttgtagtgaaaaataatgttgaaagattttatgaacttttaattgtaaagagaaagaagcattaaaataaggaggaagatcactaaggtagaaacatcagtggtaaaagaaggttgggaaggctgagcagtgttccaatcttctgaagcattttctttaatccctgaaggaatgttgctgtcatactcaggaggctggtgtaactggaagcaaaatgatgcctaaattagtagataaataataccatatcatagcctttataccattacttagtgttactcaagctgctgtaacagtaacttgtgctgtaactttaggtgaaatattgaagattaatggtaagtcatctcacaaaaatagttacaaaagctaaattcagatttattttggagacatagagaaagcgtaaaaaatttaaacccagtgaacaactattgcttaggtgatgaggactgttttatttctagttcaaatacagcaaaatccaaaatgcttcaaaatccaaaacttttttttagctccaacctgatgacacaagtggaagattgttacatctgatctcatgacacatcattgaaaatatcatatacagttgccttaaggctgcatgtataaggcatatatgaaacataaatgaatttcatgtctagacctgggttccatcacaaagatatctcattatgtatatgtagacattccaaaatcagaaaaaatctgaaattcaaagcacttctggtcccaaacattttggataagggatactcaacctgtatgggcttagatcgtatctaaaagttactcaattaggcatgaaaaagaattatttaccacttattcgttaacatcttaaactggtattttagtgttcccaggttctatttagtctcttggccaaagtcatggtgaaagaaacagctttaagaatgtgtaaaagccttaattcataaacctgttgttagaattagcaagatatattcaaatactcttaattttagaaatgttctctttattttaaggtcttgtgtgaaggacaccttgctttgtaaaatgatatttctttggggccattaccttaacctgtatccattccttcatgaattttaacttgtataaggtggcttgttctaaaaacctaagtgggtaaatataagaaatgaatggtaataaagcagttagtatcatacccgtctttatccatgctacattttttatttttctcagtcttatttttctactttcaaaaagataatgtatcatataatagggatcattataaagcaacttttcatactttaaaattgaaaattaccagctagtaagttcagaacaaaattaccagctagtaagttcagaacaaaattaccagctagtaatgcagaataaatgataaaagttttactctcaccattttttacctgttgataaaatgatggatttagagtaggcaatgatcagcagtcactactaaaaccattaagtaaaaggctgatggggaactttatactgagtggatcagactgaatgatcattcacaaatggagagataactagacattatgtgccttatcataatatgcagtaagaagtacacaacattgactactagacgttcccacccagaacattgcacctgaattccatcaagtctctagctccaaatgccagtttacaagaaatacagaggataaaggaataacatgggaatgcaatcaacaaaatccaggacgtgggaaatgccacaggataggggttgatggcaaggaaaaaaggaaaaacaaggaagaaagcctaaagattaatgaacacttacatcagccaaatgattgtgttaaccttacttggattcttacttgaaaaccaactttgaaacaataggggaaatttgaacactatttcctgactttaaggaactgttttagattatttcatgtgttataatactattggggttatgtttttaaaaagtgttatcttttagaaataaagtataaaagtatttgtagctgaagtgataaaatatctgagatttgctttaaaaataatcggggaatgtagatgaagcaagattagccatgtgttaatctttgttgacatggtgggggttcattgtacttttctcaatacttttgaatatatatggaagttttcactgtaaaagttttttaaaaatcacatctcaggccaggcgtggtggcttacgcctgtaatcccagcactttgggaggccgaggcgggcggatcatgaggtcagtagttagagaccagcctgaccaacatggtaaaaccctgtttctactaaaaatacaaaaattagctggatgtggtggagtgcacctgtaatcccagctactcaggaggctgaggcaggagaatcacttgaacctaggaggtggaagttgcagtgagccaagattgcgccattgcactccagcctgggtgacagagcgagactccatctcaaaaaaagtcacatctcaaaagttgtagaatgcatgtaatttaatttctgtgattttctctaatccagtagttcttaacccataccccatggacaggcttgaaggagttcctaaatattctgcatttgggtcaactccttgcctttatgtgtactttccaggtgaagaatccttgggcaatatgccattttgagaatatagagaaagcaaatcctagaagcacatctctctctagctcctcatcacaaattaggaatcattttagcacagttttgcaaatttttcattcctaggggcctgaacaaagcaaggacaacaaaaatatttgactcttctaataggttaatgcagtttgttggcctcataatttcttacattttttaaaagcacttttaatagaatattttaataattattcctttcatacttactttggcagaacttcattaaacattattttctaatttctatattccttaactaaaattaaaacaaacttagatttgtttttaaaactcttaatacaggcttgttgcataaaataataataaaacatatattttaccactaggattaagtttgcagcagtagaaaaatattaaaccatggtatacaaaaaaactagtcatttaacctttctcaaaacagatggtataataaatgtataaaaaggcaagctgttatcagctaaaggctcacaaattgattacacagtgaaactgaaacttgcatcctgttgggaacatacatattggtttagttgactggcatgagggaaaaggctgatttaacaaatagataaatgtaaaaaaacaaagtcattcctattctgatagatccctttcagatttaaaagttactaacgattttgatgttgtggctgttttaaacatagttcaaagaactttgactaattcagcttttttttgtactgtgctttgtttatttttatagatatttgggctttgacttatattctcattggtgagctcactgccattttcttcctaattcttctttaaagaacttgggctggaaattctgtagtcaccaaccttagctgataagtatttctgctattgttagcttagtgttccatctgcccccttactgatgccatggctgtgacatctcagttggggaaaacagctgcttcatgagatctctagccttaacagttgtcccagtgaaaatgagcaggggggtttcattgcaaagacaactggcataaatgtatgaatgaatgccagattagtagcatgttagtcaaaagaggaattgagatcaaattgaaagaaaagctgaatatgatagatgaagtctacagaaagtatcacacatactgactgaaaatatttctctgcagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacacgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttca

SEQ ID NO: 556 - DNA, 24426 bp, Homo sapiens
gggcgggccgacttgcgacggaggcagcgggtccgggtcgggggacctgagaaggagccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgaggtttggcgggcgcgggaccaatatgggcagggccgaggcgggattctccctctcgctgtgcctagaccgtactcctgctgcagttccggcagagagcgcggggagagcagcggcgggagctgcggcgagcacgccggccctggggtagatgcaacacatgagagggaatccaagttgcttgggtcggccccggcagcgacctgaacccgccgccctgcgggaggggtgtgcggagcgctgggctgtgctccggcaacttcactcctcccgccgccactggggaacgtagtgggggagacgcagaaggctaggcgaggggttctcaatgcgttcttccaagaaaactttttctcccttgaacatgaaggaatacgtgcttaccgtagaaaattgggaaaacatgggaaattattgtgtaaaaatggggggcgacgtgtgggagtctctcccggggcgaggggactgcgatttgctgtgctagccgggggcgagcggcgggcggcgctaccctggcggcccagaggggcggagagccacgcggcgccaagggctgagatttgaggaagtgggagctgcccgggcgggggcgtcccgctgagagtctgccacgcagtgtttgtttcctttcacttcctgcggcagctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggtgagtgcggattgtgactccagactgggatggggggtgtgtctgctgcctgccctctggcggagtccgggctgcgtctttctgcggctcctaaaagcacttttagggaggaagctggttctgcaatcccacttccctctcaagatgtttgcccggccaatcgtcgcctgctttgggacatggttggctaagagccttgaaggctggagtggagaaaagttcagaaagttcggggttgttggaagcccttctggggagtgcgggaaccccctccggaggggaggttgatttagtggttgtacagctgcacctccagcaggagtactgaccctccagagacttcaggtgtgcgcccagagcttcctgagagagccgagaaggggtgcttctgattcctgtttacatagaactcataagggttcattgctgagcagtgaagcagccaagcaaggaaaggggagaggcttgaggtgagggattcttgaatgatggcctccattccaggaagtgatcaaggggtccctgaacctgaacaggctaccatacgttattctaggctttaaaatgtttaacaccttttaaaaaggattaattatgtgatgtcttgggccaacaattgaggagagatctttttctatcgtcagcattaactttctgagtagtttgggcaagatctgcctggtttattttttcatctaaaagtggcattggttggctggtcccagtgcagtggtgttgacaactaattgatcatagcccgttacagatttctttgctccttctccaatctccctgcttcacttgactggcctaaaagaaggaaaaaaaaaaaaaagtggcattggtggtctttgacctctgataaagtgctttcaactctccaaaggtaatgcacgtgtagagtccagagcttccgggatttcttagttttggcaggagccctccagcagataggatagggaagtggtacacctggcagtctggggaatagccctgaatttggaagctaagaggctgccacaggactactttattttttaaactccacgtggattttactttctcttctcaaaatgttttaatatgaaagcgttttaaactcgatctccaggaagatgcaccttgttcatcttgtggctttgtataatcccagcccacagtgctcctggtttgagacgcattcctcctccagtagatgttccatcttaggcaaactttattgaccattatgtacttggccctggggagccaaggaaccctgtcaggtggagaaaaaaaacgtagacaaatgtgatgtggttggatctgtgctacgacagggacatgttagggtacagacaagaactggttgcttttgtatgagaaatttgtccatctgtcccaagaactaagagagtgcctccccagcgtgcttcagcacatagattggggttctgggtgatccagacctttgacctcttttaactcatagctcttgtaattatagaggtagatgacttggtgtaatggacttgtccatttatgcaaacacttagaaatattgatgttttctgaacagcttgggccaaaacgtccaatgatttcagtttcctattgcccatgatccatttgaaacccattcaagaactttattattccaaatgtatcttttattgcgtacttacttactacaagaatatatcacactgggattatttaggaaactttagggcattgtaataatagcttcagctattcagagaaaaaagttaatatatattaattcctgatctctcaaaatttctccctttagctccctctgtgaagttgacagggtgattggacatagataaattctacagaatggagaagggagagagacccctggtctgaggtgggagaaaacatgtatcttataaatggagatgccacatctgagagaggagaggcctccatatgtgttcacagcaaatgaagatttgagggcctgaggagggtaaggcccaggaatggagcctcaatagtgaaagggtaggacacattacagtggagccatttccacagaggcagcaactgctagagcaggatcctggggacactgagaaacccatcccttgctcttgtgtgtgggtgtctgcagcttgctgttttacatgccaggaaacgacacaatagccacttcacagtggaaacttgctgttagtgaactacaagttctgagaacatcgagaaagaataaaagcccagttcctatcctagtctcacaggtggtttcctttgcattttgtaatcttacttgctttatgagaacggacacatatagcctctcaactttaggtgcaagctctaaggcaaagagaactgaagctcaaagagcagagaagagtctagagtatgtttgtgtttcctcagtgccaggcaacatggtgggcattcagctttcccttgtttgatcatcaaattcctttgtgagatgggtgttcttatttctgttatacaactaaggaagtggaaccctcagagacagttacgtgttcagtcatacaagtagtttcctctggtaatgcttcactaactccctttcatgagttgaatagtgaagtcagtaattaggcagtttttgcttctcaaagtgctccagacatctgcatacctgttgccctttcacagaaaataggggttgaagtggtttgccccaagtcgtgaggtgagtgagggataatgaaatctattatagaacaatgactattaatatataactaagttggccttgagcagcaccctcttggggaatccctgaaggaactttttttgcctttatgggtgctgagtgcacatagtgatttcagttactgaaatttgttcaatctttagcatgaaaattgttcattctaagttattcctatttaggaatagctttacagacatagtcatggagagaaaggcaaagtgaaacagttctctattgttccataaatatctaagggatttttttgtctttgaggcagtgtctcactttgtaactcatatcggagtgcagtggcctgaccacggttcactgcagtctcgacctcctgggctcaagcaattcccccacttcagcctcctgagtagctgggactataggcgccttctaccaagcctggctaacttttttttttttttttttttttgagacggagtctcactctgttgcccaggctggagtgcagtggtgcaatctcggctcactgcaagctccgcctcccaggttcatgccattctcctgcctcagcttcccaagcagctgggactacaggcacccaccaccacacctggctaatttttttttgtatttttagttgagatgggggtttcaccgtgttagccaggatggtctcgatctcctgaccttgtgatctgcccgcctcggcctcccaaagtgctgggattacaggcgtgagccaccacgcctggccctttttaatttgttgtagagatggggcttcctgtattgctcaggctggtctcaaactagtggcctcaagcgatcctcccacctcagcctctcaaagttctgagattataagcttgagccatcgtgcctgtcctagggattattgacaagacaaaaaacgaaaggtgttcatcttttgtaagaaacatagacctcattccttgatacctatggaattttcatgttaggttggctatcttatgaatcctagtttgaatgcccagatgctttttacatcttttttgaaccattcccaagttttgtgctatagtacttctctttcaggtgaaaaatatggcacagataccaagatgataagaaatatctgaagtttccaagcctgtgttatggcttagcattttctaaaagagtgctgtccagtagaaatatgatgtgagcagccatatatgtaatttacatttcttagtagccatatgaaaaagtataaagaaacaagtgaaatattaataattttatttaaccccttatttccaaaatattaatactatcatttcaacatataatcaatatttaaaaaaaaattttaaactaggcatggtggctcaggcctgtaatcccagcactttgggaggctgaggtgggagaatcacttgagcccaggattttgaaaccagcctgagcaacaaaatgagatcctgtcacacacacacaaaaaattagctgggcatggtggcacccacctgtggtcccagctgcaggctcgcaccactgaactccagcctgggtgacagaacaagactctatctcaaacagaaaacaaactgagatacttttacaatttttttgtatgaagtctttgaaatccagtatgtattttacattaacagcccatctgaattcacgctagccatgtttcagatgctcagttaccacgtatggctagtacaggcgatgtcccaaatccaaaatccgaaatgctccaaaatccaaaacttcctgagcactgacttgatgctacaagtgggaatttccacacaaaagtacttaacacaaacttcatttcatgcacaaaaattttaaaaatataaaattgtcttccaggctatgtgtgtaaggtgtatatgaaacaaattttgtgcttagacttgtgtcccaccccaagatctcactatgtatatgtaaatattccaaagcccgaaaaaatatctgaaatcagaaacgcttctggtcccaagcattttggataagggatacccaaccatttcagacagcttagttttaaagcagctgaaatgttatggtgattccataaccaagtttgtgaaacatttttctttgttgtgggactttggaagctttaatatgccaattttcattgtgactatagttggtgagggtggatgagtagcactttataaactgtttaggtggtgtggcctttttagccctagcacaacgccttactcaattcttaactccagctccctagagcattcactagatacgtttctgcagaatatactttgggaaacatggttcaatgaatcgccttcctctgcttttccctcccatcctgccccctagggtaaactaaaacctgaaaatgtcctcccctcttctgcccacaactacctttaaaagttttctttagtacaagctttagtacacagtttggacagtctttcccactgtcttgtgttagaagagcactaaattattctcagggcttgcgagtcagtcttgatctcaacttattagctggctgtggtatcatctgaagtcagtttcagtccatctagactggtgaaactaggaggagagggagagaatggttttctcgagaaagcaaagcagcatcccatagctagggcaaatgggaaaagaaggaacactctccacttggtgccatgtagtgcaaacgagtttctaaatcagcccactctgtgggtggtcactgatcacaaaataagtgactcatcctctaagaagggtggtgacagttcttgctcctttattccttcttggatgtgatatataaagtcaatgatttggggagaaggtacatacactgaattcctcagtagataccatagtgagagggaggccctctgtggagggggcaagtgtagtgggctctgaggctcagatctttggttccaaagacaaaagtatcttcctttatccccatccccccaataaaaaaaaaaagaagaaaacaaagacggtgaaaagcaagggctttttatgattagtgttagtcaagcaattcaaacttggagcatttggcctctgcaaataatcatgtaagattagagttgctacttcatgccatttttgttgtcgcttatttaagaacaaggatcagtagggatggtaataaaataatttttaaaaatgcaaagaagagaaaaagaataaagctatgattaagatagctgggtctgtgccagcagccccttcctctgtcttagagctaccaatgctattctctgaggagtgcaggctttagtttatttcctctagatagagcttctaggtgatcaagcacagctatttctctcaaaggagggttagtcacccaaaggtgaaacagttctctcctctcctctcattcagcctgccaaaacaactttgcctttttttgtgtgtgctagaaaagtaattaagaaaaataaatgccatcactttttctttagtactctaagttttctctcttccacccctagatcagtggactgtaatctctgggtgtggggcctaggcactggtatttctggaaggtcctcaggggatgctggtgcataggaagggttgagatgcactggccttactcttgctgtgtgtaagcccagtccaggctaatacctctccatggaccccttcttttagctgcctctttgctcttcataaatgtcgttctcctttctgctgtgtcctctcttctctaaatatctgaattctgctcagtctgattccctactttagaaccttccctgtaatccagtctcttctcactttccttctgtgagcctggctgtcaaagatgtgccctggcacttactccttgtgctgtgagggacttgtgtaggtcttgcctcctaactatagaataagctcttctttaatggtaggtgccagtttcctcatttttgtagcctttttagccctagggacaatgacttaccaagttcttgatttcatgtatattaagttttaagcaaagtgagaatttagcgttatcaaaaagtaacctacattcttgggacattctgagctcacagtagaaggcagggactgtttagaaacctggatatgctagatatcaaaacaggaaatggtgcttcaagctctcatgcaattaaaatcatttttctctttttctttctgctaagttgtatgtagcagaggccagtagtaaataaaatattgtattaaaaaaaacttaaactgaggtctggtctctcagaagctgatggtctactgagttttctctggatgtgatttttgctggtctttggtaatatcctttgcttactgaattgagtcacttttttcttatagttggctcataggctatgtatgggtatagtgaccatattttctgagttgctgaagggacatatgggtggataaacctcagtgtccctgtgagaatggtggaatgcatttgaaattggagctgccatagaaattggggccagggtgtgaagccagctcagctctctcagctctgaggagcctgatctctcattggtaagattcccccttagacatggtataaatagtgcaaataccatattagctgccatttactgaccctctactgaatgtcagatactctcttgtaggggctttctatgtattctcttctaatccttattacgacttcacatggtagacattgtacaaatatgaaaactaaggcttaaaagttgtaacttttaaaatacaggtccacatgtagcagtggaggtcatgtgtttgggagagaatcgagtgtaaaagttgtaaagggtgggtgtgcccaaattctcataaatgctttctcttgcacatcccgtgctctcggcactgttcaaagtctggtgttgctttgggaagtctcagagcagtagtacctatgggtcataattcgcggcgtcctagagttagccagtgagacagaatgtctccttgctttccacctgtgtggctgctatacctccggttgtctctagtgacagtgcaaggggaagctcctgtacagtcagagccatgctgctctgagggacccatattaaatccctggacacagggcctgaggtttctttattcagctgggctcaaaataaaccttctcccacattttgcatcctctcgttatgctttttcctggccccttaggcttctgactgggccacttacacagctttcatggtgagaagttgtgatttggaagaagagaagcaaagtcatttctgagaatcaaacttttatttatggtattgggacccttaagtttgcttgagaaatgcagaactttggaggcaaaattgtaggatgtggctcaagggtctgaatcactcagtccaggtaaacaatggtaggaagtagcaccctttgggcatttaatacctgctcaatgtgttgccttgctctttccccatcccaggagaagacaatcactgtcttcagtggcctgaggaactcgtgggtagggagggtaagggatgagtataaaatgggattgagccttttataaaaggaagaacaaagtgcctggaggtattgttcctagaccaaactgagggtcaggctgctatttctggtggcccaataatgagatgcagttgaggagctgaatgttaataggtaagacaatggggaaaatgtccccagggaatttcagagagcttcacagcagcccccacactacaggccctgaggcctgtcaaggaaaaatggttttgtggatcaggtcctggactccagtgccctgtgtcacagctgctccagctccagctgtggctaaaaggggccaagatatagcttgagctgttgcttaagagggtccaagccccaaaccttggtggcttccacgtgctgttgggtctgtgggtgcacagaaggcaagagtttgggagcctccgcctagatttcagaggatgtatggaaatgcttggatgtccagaagtctgctgcaagggggagccgttatggattgcattgtatgcctggaaaagccacagacactcagcgccagcctgtgaaagcagctgtgggggctgtaccctgcagaaccacagggccatgtggagttgctcaaggccttaggagcccactccttgcattagtgtggcctagatgtgaaacatagagccaaaggaggttattttggagctttaagacttaatgactgccctgctgggttttagacttgcatggggcctgtagccccttcattttggctgatttctcccttttggaatgggtctgtttacccaatgcctgtaacccccattgtatcttggaagtaactaacttgtttttgattttacaggctcataggtggaagggacttgccttgtctcagatgagactttggacttggacttttgagttaatgctggaatgagttaagacttcggggggactgttgggaaggcatgattggttttgaaatgtgagaaggacatgaggtttcggagggcccaggggctgaatgacatggtttggctgtgtccttacccaaatctcatgtcaaattgtaatctccacatgttgaggggcagggagggacgtgatcaggtcatgggggcagtttctaatggtttagcaccatcccccagtgctgtctcatgaacgagttctcatgacatcagatggtttaaatgcatgtggcagttccccgctcccacacgcttccccgctcccgccctccccatctgtccccccttcccctcctctgtctctctgtcacctcctccccctcctctctctctgtcccccctccctctcctctgtctctctctctgtcccccctccccctcctctgtctctctgtccccctcctgtttctctctcactgtcctctctctctgtctctcactctctcactgtctctcacgctctcactgtctcttgctctctctctctctcgctctcactgtctctctctcactgtctctcgctctctcactgtctctcgctctgtctcgctctcactgtctcgctctgtctcgctctcactgtctcgctctgtgtctcgctctcactgtgtctcgctctcactgtgtctcgctctcactgtgtctcgctctctcgctgtgtctcgctctcgctctctctcgctctgtctctcactgtctctctcgctctctatctcagtctctctctctgtctctctctctctcactgtctcactgtctctctcactgtctctctctcattgtctctctcattgtctctcactttctctctcactctctctctcactgtctttctcactctctctctctctctctcactatctcactctctgtctcactctgtctgtctcactgtctcaatctctgtctcactctctttcactctcgctctctcattcactatgtctttgtctctctcccacctctctctcttcccctcttcttcccccctctcaacctcttctccccagtctccctcattcccaccctttcccaccccctcatgctgccatgtaatatgtagcttgcttccccttcacattccaccatgattgtaagtttcctgaggtctccccagccatgtggaactgttattcagttaaacctcttttctttataaattacccagtctcaggtagttctttctagtagtgtgagaatggatgtaaaggcttcaagggtaggactgggaacctgaggaaagctggagcttcaaaccacttcccagagagaagcaggggcagtccacccaaaataagaggccatggaaatacagtgaaggcccaggtgaggatagaaaacatgagtttgtagtaagcccagttagtgtgttatttcaactaatattgattatctctcctgctagccatcgtggttggcagagggatatggccagggccatcacccagccatacggtggcacctttgtacaatcgttagagtatttacaccctgggtagtgggagccctcaaaaacatgtggcttggctttgtctgaattagaaaaatgtgctgttgcctctgggtagatgcaggctgatgccaggctgcaaaacttggaaagtgcaacattgggctgaacttcagctatatagccatatacggtggcccaaaattcaacagtgaacaaggaagacatggtccttaccttcccagaccttccaaggtagaggaagagacagaggagtaaactgacatttgtagttaggatagcttaaagacttcagagcaaggcctattgctggtatctagaagtggttggaggtttgggggtgacctggagctgggttttcaaagaaagtatcagaattgtaccctgaaaagcacaggggcagagccgcccaaaaccatgggaacctacctcttgcatcagcatgacctggatatgagacattggagctttaaaaattgactgccctgctggtttttggatttgcatggggcctgtagcccctttgttttggccagtttttctgattttggaatgtgtgtatttacccaatgcctatactcccattgtatctaggaagtaactaacttgcttttgattttacagactcataggtggacttgtctcagatgagacttcagactgtggacttttgagttaatgctgaaataagttaagactttagggactgctgcaaaggcatgattggttttgaaatgtgaggacatgagatttgggaggggccagggatgaaattatatggtttggctgtgtctctacccaaatctcctcctgaattgtagctcccataattcccatgtgttgtgggagggacccggtgggagatgattgaatcatggggttggtttcccccatactgttctcgtggtggtaaataagtctcatgagctctggctgagtacacaggggcatgagctctgttaggatgcagtttgctcatgtggaacagcttcccaggggtaggatgtctgacagaggaggacacttgaaggtgtgaggtctaacctggaaatcggattgagcacctggtaagggatgtgggtctataggactccctgcgatgctgtctgaggagaaagacttttgtagaatcacatagaaagtttagaagtaacaccaaaaatggagttctcaatcttcctccaccctctaccctgccttctccctcaagaatgtagtagggaatgtcttcatggcattgtccatccaggcttttgcttttctttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgccaccacgcccggctaatttttttgtatttttagtagagacggggtttcaccgtgttagccaggatggtctcgaactcctgacctcgtgatccgcccgcctcggcctcccaaagtgctgggattacaagcgtgagccaccgcgcccggccggcttttgcttttctgcaaagacttttctctgttttgccttgcccctctctgggagtgttggggagcattgccgaaggattgatttgtcagctggagttcagagctgtgatgccttataaatcagtccttggtcctgccctagcagaaagtaactgggcttctactcaggaaaacgtggacctcagagatccccattgtttaccattgatatttctttgggaacaacagagcctagcctgggaggtatctgttagggtgttgcacctttgtggctggcagaccgtgacctgttggtctgcaggatcaggccacagcttctgtggtgccattgcatgcctgccctgcagcagtgaggcacattatgttcctattgataggccaggccctaagtggtaagatgagatgaatggtctctactggtgagaggcattctaaagaaaataccgttggccatttctgctttgagtctttcatttaacgaacattcattgagtgcttacagtgtgccacactgtcaagaaggaaaacaagtgtagtagttcccactaattcacagcttcacttttctaggcttcagttacctgtggtcagccatggtccaaaaatattaaatggaaaacttcagaaataatttgtaagttttaaactgtgcactgttctatgtaatatgattaactctcactctgtcctgctcctgctggggatgtgaatcatccctttgtccagtagatgctacctgcctgttagtcacttagtagccatctctgttatctgattgaaaaaacagtatgtatagggtttggtactatttgtggtttcaggcatccactggtggtcttggagtgtatcccctgccggtaagggggactacttgtagactgtctttcccatcattaaatgccagtgtgggacacaagcaatacattttgatgcagttaagtgtaaagactgagcaaagtgatgtgggtgctctgaggggaggtgcccagggtggtgtccagaaaggatttacagtgaagttgatagtgttgagttctgaaggatgatgatatggtttgcctgtgtcctcacccaaatgtcatcttgaattttagctcccataattcccacgtgttgtgggagggacccggtgggagataattgaatcatgggggcagtttcccccatactgttcttgtggtagtgaataagtctcatgagatctgatgattttataaggggaagccccttttgcttggctctcattttctctcttgcctgccaccatgtaagacgttatcttttgccttctgccacttgaaactgtgagtccattaaatctctttttctttataaattacccagtctcaggtatgtctttatcagcagtgtgaaaacgggctaatacataaattggtaccaggagtggggtgctgctgtaaagatacccgagaatgtggaagcaactttggaactgggtaacaggcaggttggaacagtttggagggctcagaagaagataggaaaagtttggcacttcctagagacttggagggctcacaagacaggaagatgtgggaaagtttccttcctagagacttgttgattggttttgaccaaatgctgatagtgatatggacaataaggttcacgctgaggtggtctcagatggagatgaagaacttgttgggaactggagtaaaggtgactcttgttatgttttagcaaagagactggtggcactttgccccagccctagagatttgtggaactttgaacttgagggagatgagttagggtatctggcagaagaaatttctaagcagcaaagcattcaagaggtgacttaggtgctgttaaaagcattaagttttaaaagggaaacacagcataaaagtttggaaaatttgcagcctgacagtacaatagaacaaaaaaaattcctaaggagaaaacttgcagcctgacaatgcaatagaaaaaaaaaaaaaatcctgaggagaaatctaagtcagctgtggaaatttgcacaagtaagaggagccaaatgttaatccccaagacaatggggaaaatgtctccaggccatgtcagagacctttgaggcagcccctcccatcacaggcctagaggcctaggaggataaaatggttttgtgggctgggcccaggcccccctctgctgtatgccgcttagggacttggtgctctgtgtcccagcagctctagccatggctaaaaggggccaaggtacagctcagggcatgacttcagagctgcacatggcaacttctatgtggtgctgggtccgcaggtgcgcagaagtcaagaattgaggtttgggaacctttgcctagattttagaggacatacagaaacacctggatgtccaggcagaggttgctgcagggccagggccctcatggagaacctctgctagggcagcaaggaagggaaatgtggggttgaagctcccatacagagtccccatggggcattgcctagtggagctgtgagaaggccaccatcctccagatgccagaatggtagattcaccgaaacttgctccatgtgcctggaaaagccacagacactcaaggccagcctgtaaaagcagctgggagggaggctgtaccctgcaaagccacaggggcagagccacccaagaccatgggaacctacctcttgcatcagcatgacctggatgtgagacattggagctttaaaaattgactgccctgctggtttttggatttgcatggggcctgtagcccctttattttggccagtttttctgatttggaatgtgtgtatttactcaatgcccgtacccccattttatctaggaagtaactaacatgcttttgattttacagactcataggtggacttgtctcagatgagacttcagactgtggacttttgagttaatgctgaaatgagttaagactttgggggactgttgcaaaggcatgattggttttgaaatgtgaggacatgagatttgggaggggccagggatgaaattgtgtggtttggccgtgtctccacccaaatctcctcctgaattgtagctcccataattcccatgtgttgtgggagggacctggtgggagatgactgaatcatggggacggtttcccccatactgttctcgtagtagtgaatgagtctcacaagatctgatgattttataaggggtttccccttttgcttggctctcattttctctcttgcctgccatcatgtaagacgtgcctatcactgtatgccatgattgtgaggctacctcagctatgtggaactgtgagtccattaaatctctttttctttacaaactacctggttttgggtatgtctttatcagcagtgtggaaactaatacagatgagtagtcaaaattgggagtagcattttaaccatgccagagcttgcttttttgggaaatgagttgacattatgcctttgggatttttttatggaccaatataagaaatgattgtgtatgaattatctatattttctgtgtacctagatttgttctgacccatgggacaaattctttttagagccaggagaattttgactctatccagtatgcttacttttattattagttagaacttaaaattctgttgtacttcccacttggctgtcagaaatcttcatacaaacatttgcgtttaaatgagaaatgttttttaagacaatttttttttttttttttaagattctcattctgtccaggctggagtgcagtggcgtgatccttgctcactgcactcttgacctcctggactcaagtgatcctcccacctcagcctcccaagtagctgagactacaggcacatgtcatcaaacccagataatttttatattttttttgtagatacaaggtctcagtatttttctcaggttagtcttgaatccctgaactcaagtgatcctcccaccttggcctcccaaagtgctgggattacaggtgtgagccaccatgcctggcctttgtagattctttagctttttttcccccccattccaccattccccaaagccttttcgaaattttgtcttggtctttttattgttggttagttaggttagggttttattatagtagcacatgcccttgaaattcattttggaagtaggcaaaacattgccatggaaatggaaggctgaatacaatgtcgcttgtaagcattccaaactgtttagaaccaggatatttccagggagctgaggagctgagggcagagctagcttttggttatttgggatgttattgccagtttcctcccagggccattgttaccacctgatcatttgagttttagtttctctagcagatgctggctaatgactgaccaggcaagtataggggttctctggcttttaatcactaggggattagtccttctctggcccaagtgcagtctggtgattcagaaccataaagtgtaagaactgaaagggaccaggtatcatttagcccagtcttctcatttgatagagtcaaatgggttaaggaatccttttgaggttacgaagctagctagtggcagaatgagatgagaaccttggtttctagaccgtgttaaggtctgtatttattagttttaggactgttagaccttttgaactgttcattacacttgtcttttgtgaacagcattggataggagattttttgccattacctagccgtgtgacctttggcaagtcagtcttctggaacctagttacccattggtaaatagagataacactccttacttgctttccaccattccagatacaaaccagttgcatatatctccatctttttctccttcctcattctaaaggaagacaaagacatgaatccgtcaggcccaggctcttcactgtgcattgcattccagctcttttcctctcagctctcatgaaacttggtcaacaatctccatttgtcccattgattttttgtaacagcaatgcttttgttctcccatgggtctttgtggaattcctttcatgaaccatctttcctttccttttcatctgctagtcttcctcagggttttgacttctctggtagtctctccttgactgtccaagatagctcactttctgtcttcttagtgccctcctgaactctggatagtgtaaacttctggaaggtagagatgtttttattcacttttgtatttgcatctgaattatagtagataatgtttaaatgcataaatatatgacttacaagatgatataggtgaaatctcaactatatatatacatgtatgtatgcacacaacgtctgtctttatgttcatgtatatatgaattcagactatctctaaacctgttgcagaatattttgtctctgggaaggaaatcctaaatctgtatcctgtcctctcagcaggcaaggatccaggctaattgccatcctttgtcctgtcaagcttccttgtggagtgaaaataagccacagtacaaggtttaaaattctggtaggagagacaagttatggtaggtagaactagagtgaaaataaaactggggaggagacagagctagtttctgtgagaaataattgagttaatagagactagctgtagaagtagaaataatgagtttcaatttactccataaacagcaaagtttaaatgtattactcacttttctccatgtactctagctccaatttggagcatattattccccaaactgtcctttgaagtgttaattaactagctatttaattattctctattatcctctttggagattgggagctagaagagctgctaaaaccctgaaaaataatctctaggcccagggaaggagctgtaccctgtgatttgaacttaatatttaaaaatggcttattttagactaaactttagagcacagcctctccattttaaatgtgcacataaattaccagatcctgttaaaacgcagattctgattcagttggtctcagtgaggcctaagattctgcatttcttgcagttctctcaggtgaggccgatgtgctggttcatagactacactttgagtagcaagtttaaaacagagagcattagaagtaggagggcttctgaagttaactctgcatacctgaattcatggttgatagaaggccttggcttggagaaagaaaatattctgagaaacacttctgccatgtccgaaatagttcatcccatcttgggaatcccagaggggaccactacattataacaataactgatattcatgaaaatctgttggaattctgttcagtgactatctaaaaggtaggcaggaaagtattcattaaagtttagatatattttcatcaggatgattaaaatcagttatatggagaaatccaaaaatgtggaacaaagtcacccatgaggaaatcattcttgaaaggtaagcacagtgtagtactttgctaataggctttttgaggtgtcatctgccacttgacatctttgtctagaccagcactagcactctaggttgttctttgggtgagaagcataaatagggaaaggaggcctggcactgaatcttgtctttatcacttaatggtattgagatcttgggaaagttctcagtttccctgagcctgttttgctacctgtgaaacagtcatattaccatttcatcctagaatttttaaagagaggattggtgaatgtgcttggcatagttaatatccttttaccattatttttctcctactttgatcctggtaggcaacttgctgtgtgtcatttggcaattagtgatatattggcttgacttctattggtgggagctgttatgaggtatgcagtgcttcattttggaaatccctggcgctcagagagcagcagatattcttgcttctcaaaaatagtggggctcccatggattttgtctctctacacattttatgttgtcccatgtgggaagaagttaaagtgagtggtgacttgtccctgggtccctttcctaacaaagtggtcctaagttcaggctcctgtgtgctgtgtaggcttctctagctgaggtcgtggtaagatctcttctgagtcctctggagttagggtgtggctggagtccagtatcttttgttctgtaacctttcagttgcagtggccttggtctggagagttgtgatttgtccttggttagatcacacacatccaatacttggctttcttactctttccctcccaattttgcctgactcttaacttctgtgggttcttatccttaaaaggcgactacttggaaatgagaattcggttgctgctctgtgattgttcctgtgtccttcccatctctgaggttttgtttattggcggcatgttccatatcctgccattctctgctcagaccattatcaaaacaacatttaagacgactgattcgttaaagactcagctttgacttctcagaaataagactgcatgtcactatcatactttacctttttagtagtacctgaaactacttctaaccagtgacctggatttaggaatctctggtttcaaaattgcttctaacttgttatgactcttagaaaataatttaaccacactgggcctaaatttagtttaacctgtaaaattaggattggatcagtttttcaaacattctttgttggttggggtgggatgggaatgacaagaaagctcagtaggtaggttcttcattcaaccaatattttgtttatatactaaagcccttcactattaaataacttggaaaaactactggactggatggtctcttaagattgcaagtgccaagccttggcactctaggacccatcccttttaacagtagcatctatttttagactagacaaggatacctaagctgtattacaaatatagttccagacacatcatggtactctacatctagtccggttcctgatacctttaaccaatgctctggcctggccattcctgcagtgcctgtccttctcctttggcttatgctatcctcagcagcacatgcattatttgtaagcctcccttacccatttgatactacccaatcaagactctagtataaatgttctgtcccttcaagaaaccttccccagttggccattttcccaaagtacattttccactcttatggttcagtacactttgctttgtctggtagttttatgtgtaaagctcagaggactggatcttgggtttctttatagtaaaccatccaaatgccttgcattgtactatactgaaggtaacatggatccaagtcatatggcttaaaaattcttttctctttcaggatcgaatcatcaatttagttgttggcagcttaacatccttattgattctagtaagtatcctcattttgtgcctcacccaggctcttagccagttttgaaaactttatcaattatggttaactttccaaaaaaagctaaataagtgcttttaattttattaccacaaaattgcagttgctaattggagtagctaatttaattctgccccacccccaggttgaatatgtgaaatggtacaagtcagacaacttcgttttaagataattgagtttaccatgttttgcctagtaaatttgtaaaaatgtcagtggctagtagccacttccttctgtcatctaccataattccccatttctattttgttcctgaagaacatatccattaccctttggtcaagttttaaaagatttggtcacagtgtatagtagttgtactgtatacatcctgtatacagtatacatctgggagctattacaataaaatttttaaaagctgtattttccatagtttgacatttttctggcacattaaatttaagagaatttttttccatggcttcttaatgaaaagattgcatataatgctgcatctgttagaaacagaactatacaacattagaagtctttcagtgtgtttcataatgttatagcaaaaccagctttgattatattcattttgctagaaatatttaaaataacaaaatggctagaacttttaccagcagaatcattaatcctgggagtgaggtttagttaatgaagttattttggcatcagctagtattactgatgttttctctcctttcataagtaagggaaagtttagaaaagaagtactaaaataactcgaacatatttataattactgtattaacattctagaaagcaaacttggtggcagatgtaattttataacatgaagcattttgtagtactgttgcctagactccagttggtaattaccaagtcttggaattactgttaaggccttacataatttctcttcatacaggtaacgctgataagtgcttttgttttccctcaactacctccaaaaccgttgaatatattctttgctgtctgcatctctttgagtagtattactgcctgcatacttgtaagtactgttgagaatttaaacagtgttcttgagggtttaagttgcaatgcacaggacaaaaattttcagccttgggtctatacaaaagggtatctcttaattatatcctcatcctccccctaaaagtatgttagaattctcaataaaatctgagtcttctccttttctcctaaatcccaaagttgtaaccccaaagagaaattccactcccttgatagcttaaaaaaaaaaaaaaaaaaaaaaaaaaaattagtggaaagacgtaggtggccaaagattttaatttacttaattcatcttcactcaaggactacgtaagggccaacagtctttgggaaatgccagttactgctaagggaagagatagagcactctggatttaattctaattattacaaaattagtttaatctacatgtttgtttcccaaaatggaggtattaacaccaaaacctcctgggaaatctaaagctgcagttgttgtaaaaatgtttgatttactgcaaatgtttcttttatggtgaagaaacaaagatggtggtggctcctcagtgttcattcattagttggctacattgtttcatgttcctttagaggcagaatcaaaagaaaaaacaatagtaatttgcttatctgagttaaaattaattaaaccaggagacacctccaagtgttctcattcactgatcctgctatatactcccatgacccgaagaagaactagcccatcccactttgggagctttcctgttcccctagcttgaagcctaaagtgactaacagacaatgaactagtttaatccaaatatattatggaagccctattttacggtctgaaccaactgtatgaatcatgagtctaaatgttgtcttcctttcctgttaagtagtatgcccaggtatatgttcttggatagcttgccagatgactggtggagtatacaggtgtgaatatagaggaaagtaaactgagaaagtaggaataagtatgatcttggatgtggaaactcagagtaagaattaaattctggctgtactgatctcaggaatgtagagacctcagaatatggagaatgtctgtctcatttaggggaataaacaaatactaatgaaatttgaaattggtagagaaaatgttatatttcaaattttaatttataaactttaattcttcttttagatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatttatacaa

SEQ ID NO: 557 - DNA, 8496 bp, Homo sapiens
ggccaatcaagagcttggcgtattttacaaactgagaaagtagctccagcagcacccgagagggtcaggagaaaagcggaggaagctgggtaggccctgaggggcctcggtaaggtaaggcacgggggtcttgaagggaacgaaggctgctgggttcatagggaggagggcagtttggggcccgagggcgaaagagtaggctcggggtgtctggagatagcacccataagagcggtcttgcaggcgccgggggcttgtgggcgcgtggattagggcggaggtatcagggatggcaggacaggtgccccgagaactggttgatctttgatcttagattctgcctgccttcttccccgtctcaattgtagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaagggtaagaggggcctaatgggggaagacagtagtcacaccagtaatgcaccccaacactaaacctcacctttttgtccccgctccctcccctagagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagccttttccagttccccatgtcacaatcagttgctctgtgttctcctaatactttgcagcacttcttttataacatgtatataccttggcttgagtctgttacctgtctatagtttgatgatagcctcttgaggataggggctttgtcttattcttatgggaccccagtgcttagaatagtgtcttatgtaacattctatgaacatttggtgaccaggtgtggtggctcacgcctgtaattccaacactcctccgaggcaggaggatcatttgagctcaggagtttgagaccagcctaggcaacatagtgagaccccatctctttttctctttttttttttcttttcttttttttttgtggagacagagtcttactctatccctcaggctagagtacagtggcatgatctcggctcactgcaacatccacctcccaggttcaagcgattctcatgcctcaccccgagtacctgggattaccagcacctgccaccacacccagctaatttttgttttctttcttttttttttttttttttttgagacagagtctcactctgtcactaagctggagtgcagtggcacgatcttggctcattgcaacctccacctcccaggttcaagtgattctccagcctcagcctcctgagtagctggtactacaggcgcgcgccaccaggtccagctaatttttttttgtttttgttttttgtagagatggggttttaccatgttggccaggctggtctcaaactcctgacctcaggtgatccacctgcctcagcctcccaaagtgctgggattacaggagtgagctaccgcacccagccaatttttgtatttttttagtggagacagggttttgctatgttggccgggttggtctcaaactcctgaccacaggtgatccacccgcctcggcctcccaaagtgctgggattacaggcatgagccactgcacccagccatctatttcttaaaaaaaaaaaaaaaaataagccaaattcaattgaatgagtctcttgctcaccttgtacctcaaagttcctatgctaggggccctatccccctcagccttcccccttccttttccttctcctctttccttgcagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccaggtaatgaaacaggatgtgaggagaccaggctagggggcactgaggggggcatcctgagcagtgctgacagcctctgttggtgtcccagggtgttcgggcctctgcatatttggcccccagaacccccacccaccgactggaccctgccagggcttcctgcttctctaggctggagggaccaggacctcgaggccggacattgtgcccccagaggctacaggctctggtgagtgcccttgaggggctgatagtcggtgcttctgggagctccttccagggacaaagctgggctctgggagaagaggtacctcatgatgaggcaagggatcctactgggggagatggggttggtggtgaggcctgagggtttggggtccacctctgattccgttttcatctcttgctcctgtggatcagatttcaccttcaggaccttcctttcacccttccactcgccccagtttccaggagctaagaagggagacagctggcagcagccggtgagaaaggagagggtgtgggagaaggtcatctggaaaagaatgaaccagtgtctgatacaggagtcccccagagttggggccttccaggagctttaggactccccaccaactcaggaggggaagcaagaaacctgtgattacccgggatgagcccttgggatagggttcaggctttcacagccaggcctcagtgtgacatcagtttactcaagtcatggggggacagggaggacagaaatgtgctatctcttttgtttagtggctagagtatagactgtggcaataagtgggatttgggtttatatcctaactcttaacacttactatttgtgcaagcttgccttcacctctctgagctttggtttctttgtcaagtgagaataacatttgtaccatcattagttgtcatgagaatgaaatgagatgatgtttgtaaagcacttagcacatgtccagctcatacttggtattcagtgactgctggctaatgtccttattgtcatcaggacttcagtgagccaggcctcaggattgctcctggagaccccagtccagcctggtaagtgtttctggcgtggggagagaacaggggcagttgggctgcctgaagcagggaacaagaccagagaaaactcagcaggctgggagggagcatgaggaagtgggaggccgggaggctaggtcagaaggagaaggagaagagaccttctagataggccagcgattggcacagttgcacttttgtctaaggagatggtctccatttcggccctctctctgccacttcctgcaagatttatcttccactcactgtttatccccagcccctaagtgccatcaccacatccccagcctactcagacgttcagattaataagtgtttactgagatagtgttgggtgttgaggggctgctggatgggttcctgtccctaatagtgcaatggggcctattaaactaatataccctcttcagaagttgcagaacactgtgccaaactttggtgggtgttctagagtctacaacaaatgtcctgtttcttcctagctttctctcttcctaaaggagaacgcgaggttgtcactcactcagatgaaggaggtgtggcctctcttggtctggcccagcgagtaccattaagagaaaaccgagaaatgtcacataccagggtgagatgcgactctcctgggatggtgggtgggaggtgcaggagttgcttggaagaattttgctgcagcagccaacactgagaattgtaggtagagccaggaagtcctgggcctcaggatgttactgggtaggtttaccccagatgcacccagtccctctccaatgtgagactgacctctctttatcagatgtctggggcctagggtgagaggtcatatttgtatcaccatcagatcagtgctaagggtgagacagatctgacacttgtcagccaaaagcattcatcccttggctccacaaatatttactgagtagcaccagcctactgagtgccaggctctgttctaggctctggacatatagcagtaaacaagttcatattctagaagggggagacaagaaataaacacaggtataaaataaatagtgtctcagatgatggtaagttctctctaaaataataataataataataataaggcactaaaggagaattgggagcaggggagttggtattgcaatttaaaatagatttgtcagggaactcttactgagaagatgatgtttaagtgaagaccaggggttggaggaggagtgagatatgttgatatctgggggaaggaacattccaggccaagagaactgaagaggtaaaggccctggggagggaatgtgcctggtgtgtttgaggatcagcaaaaaggagaggccagtgagattgaagcagagtaagaagaacagtaggagatagggttttagcgataacacgatcagattgggtaaggaattgtacaccagtgtaagtctttggcttgtcttggaatgagtggaaagccatggggagaggggttgatcaagaaagtgacatgatttgacttaggtctttttttttttttttttttttttttttgagatggagtttcactcttgttgcccaggctggagtgcaatggcacgatctccgctcattgcaacctctgcctcctgggttcaagtgattctcctgcctcagcctccgagtagctgggaatacaggcatgcaccaccacgcctggctaattttgtatttttagtagagacaggatttctccatgttggtcaagctggtctcaaactcctgacctcaggtgctccaccctcctcggcttcccgaagtgctgggattacaggcctgagccaccatgcccggcttgacttaggtcttaaaagaatcacactggctgctgtagtgagaacacgatataggaagacagccaggcgtggtggcttactcctgtaatcccagcactttgggaggccgaggcgggcagatcacgaggtcaggagatcgagaccatcctggctaacatggtgaaaccccatctctactaaatatacaaaaaattagccgggcatggtggcgggcacctgtagtcccagctactcgggaggctgaggcaggagaatggtgtgaacccgggatgcggagcttgcagtgagccaagatcgcgccactggactccatcctgggtgacagagcgagactccgtatcaaaaaaaaaaataggaagacaaagggggcggggatcactcttccacctttttcttcttcacaggacagccatgactcccacctgatgccctcccctgcccctgtggcccagcccttgcctggccatgtggtgccatgtccatcaccctttggacgggctcagcgtgtaccctccccaggccctccaactctggtttgtgtcaacaactgggggctgggcaggggcagaacagtctggccggagatccttgctatgtctgggttttgtccctgctcagccacccacatctctccccagacctcatattcagtgttgcggcgtctcaccgttcaacctaaaacccggttcacacccatgccatcaacccccagagttcagcaggtaagagagggcatggagaggtggctggcataagtcacagctaggggagaaaggagatggatgggtacaggagagagaagacagaagcaaggggaggctgagtgccatctgtgggtgtcagcccttgctgacatctcacttctgtgccaggcccagtggctgcgtggtgtctcccctcagtcctgctctgaagatcctgccctgccctgggtaagtatcagaagcttccccctactgagatcccttgccctgtgctgccagcctggaggcccaggagtttgaggcacacgtgctttctgggccaggcatggtggctcacacctgtaatcccagcactttgggaggctgaggtaggaggattgcttgagctcagatctttgagaccagcctgggcaacatagtgagaccctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaagtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacagcgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 558 - DNA, 25345 bp, Homo sapiens
ggttacattttggatcctcgcggagtactggtcaggcggttaagtcctgtacctaggaaagagggcgagctctggggcggtaaggccggaagggactcgtgagcgtgggtacgtgctgaagtgaaggggatccccagcgctgacgcgaggagaggcgtgggtggctcctggagggagtgtcgggaggccttgggactgccccgggccgctgaagggctgggccgaggcctctggggtagcgcggcgagtggtgtggtagtgcggtcggggatctgcccggaggaaggaagagcggaatcgtccttttataacgggagcacggcgtcctggcgtgggttttctccccgatgaaatttctgatgtgattctttgcctccttccacgaccttcagccctcttcccttcctccagttagcttcattaacaatcttctctaattggtctccttttccctagctctccggtgtcatgaggagcttcaaaagagtcaactttgggactctgctaagcagccagaaggaggctgaagagttgctgcccgccttgaaggtgggggtgctgcctggctcgggatacacctggctttccaaactgagctgttttgtgtttgccttttgaagagatggataagtaggcgaccctctctgagtaaccctatttctagttactttctctacctctttcctgcctttgctagccccattcatatctttctctactcctaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgagttaaggacctggaggtagggtggggacgtggtctgtggactcactaccagcctagggtatttggcaagatctggaggtcctggctccctccttgttaagctgctctctggacagtgcctagcgagccagcaaacagcctagtctatcctgagagggcagtggcccttctggatgtccttcctcgtgctccctgggctctgtcagctctccaggactccgggtcagtcttcagcttggagccctctttatctctactcctcataccaaccttccgcttccttcctcaggtgtatgggggctcctccaagcaacagcagtcttttcttcagatgtactttcagggacttcacctctacactgtggtggtttatgactttgcccaaggctgtcaggtactgtctgggaatcaaggtacctggactaggctcatagggtttggggttgctccactgccctcaaacagctttggggttgctccactgccctcaaacagctttggggttgcttggctttgggtgtggagtgcggtggaggtcatcttggacccagcatgactcctcactctcaaacccttcttgtcccttcagatagttgatttggctgacctgacccaactagtggacagttgtaaatctaccgttgtctggatgctggaggccttagagggcctgtcgggccaagagctgacggaccacatggggatgaccggttagtgccctgggtcccaggcacagagtttgtgggagggtcatcacccattaggcaggtgaatagtacttgctgcgtggttctgaccactgtgagggttccttatggttcaaggaggcagtgagagaaatgtttataagtaccagctactctgtgtttaacaccagtagagaagtgatgaagctaacttacaacagcagacactatttcctcgactggaatctaacttggcattaacagttgcacctaatatgcaaccttatgacctttcaacatatttttttatttctatattttttaatgtttttttttccttttcttcacttatcagaatccagaaatcattacaaatgacctttctgtatatttaagtgtttttttttttttttttttgagacaaggtcttgctctgtcacctaggctggagtgcactggcacaatcacggctcaacacagtctcaacctcccaggctcaagcgatcctcccacctcagccccgcaacgagctcaccttgcaggttcaagcgactctcctgcctcagcctcccaagtagctgggactgcaggcgcgcaccactatgcctggctaatttttgtattttttgtagagatgatgtctggccatattgtccaggctggtcttgaactcctggactcgagtgatctgcccaccttggcttccctgaaaccctgtctctactaaaaatagaaaactagccaggcaaggtggtgcatgcctgtaatcccagctacttggtaggctgaggcaggagagtcgcttgaacctgcaaggtggaggttgcagtgagccaagattgcaccactgcactccagcctgggcaagagggcactccagcctgggcaacaagagcgaaactccatctcaaaaaaaaaggagaattcttcccacagagtactgaagactgactttattttctcccagtcatctatgttgatggccaagaagctgcataaataagttattatcatttattcagcaaatatttgttgccgggcgcagtggctcacgcctgtaatcccagcactttgggaggccgaggcgggcggataacgaggtcaggagatcgagaccatcctggctaacagtgaaaccccgtctctactaaaaatacaaaaaattagccgggcgtggtggcaggcgcctgtactcccagctactcaggaggctgaggcaggagaatggtgtgaacccgggaggtggagcttgcagtgagccaagatcgtgccactgctctccagtctgagcgacagagcaagactctgtctcaaaaaaaaaaaaaaaaaatttgttgagtactcactgtgtgcaacgcactatttggagtacttggatgtgtcggtaagcaaaacaaagtttccttccctcatggagccacgttctagtttggggggaaaagataaacagattcagtaaataagtgaattatcaacatattagaacgtgataagaaatgtgggggaaaggaaaagtagagcaggataagaaagggaattgggagtctaaggtgcatgacggggggcaagttaccaccttaaatcaggtggtcagggtagacctcattgagagggtgacatgagcaaaggcttggaggatgtgagggagtcagccatgtgggttcctggaaaagaacatccctggcagaagaaacagccagtgctgaggcaggagggggtctcgtttgtaaaatgagtgcagatgggctgagtggtgtgaagggcatgggcctatttggggcaggaaggggagagccgccccttccccattcctagcagtaggggttcctgtctgatctggaagctgctgaactgaccacagatccagctgatctctgctgcctctccaggaggagagggtggtgggagcctttcctatggtcaattgtgccttttctcccctgcagcttcttacaccagtaatttggcctacagcttctatagtcacaagctctatgccgaggcctgtgccatctctgagccgctctgtcagcacctgggtttggtgaagccaggcacttatcccgaggtgcctcctgagaaggtacaagggaatgagagatgcaggaaaggagcttatgtggttggggagcggggggagcggggaagggcctcaccagcaccctgccttggagtgggaggttaatagcagcatgttgacaccagtatctggagcagtgtttcccaaacctcactgtactgttacttactgttgactcatttttttttttttttttttttgagacgagtctcgctctgtcgcccaggctggagtgcagtggcacaatcttggctcactgcaacctttgcctcagcaaaggttcaagcaattctcctgcctcagcctcccaagtagctgggattacaggtgcccaccaccacgcccagctaatttttgtattttttgtagagacggggtttcaccattttggttggccaggctggtctcaaactccagacctcaggtgatccgcctgcctcagcctcccaaagtgctgggattacaggtgtgagccaccgcagccggcctgactcactttttatatttagcctggtcctaagctactggtttccagccaagctgcacattagaatcacctgagtgacctttaagaaaattctaatgtctgccccgagttaattgcatcagaatctctagtgtttgccgggcgtgatggctcacgcctataattccagcactttgggaggctgaggcaggtggatcacctgaggtctggagtttgagaccagcctgtccaacatggtgaaaccccgtctctactgaaaatacaaacattagccaggcgtggtggcatgtgcctgtaatcccagctactttggaggctgaggcaggagaattgcctgaacccaggaggtggagtttgcagtgagccgagattgtgctactgtactccagcctgggctacagagcaagactccatctcacatctgaatattttcaaagatcccccaggtggtcctttgagcaaggagagtgagaacctgggttcttggttttttggttttttttttttttttttttttttttttttggagactgagtcttgctcttgctttgtcacccaggctggagtgcagtggcacgatctcggctcactgcaacctccacctcctgggttcaagcaattctctgcctcagcctcctgagtagctgggattataggcatgcgccaccatgcctggctaatttttgtatttttagtagagacgggggtttcatcatcttggccgggctggtcttgaactcctgacctcatgatccacccgcctcggcctcccaaagtgctgggattaccggcgcaagccaccgcgctgggcaagaaccagtgttcttaagcaagaatacctgtgaactgatgcattggcgggattggcaagcaagatgagtcatagaggggcttgggtttcatcttaactgagatgataagcctctaaaggatttaagtggaggcatgacagcagacaggcattttggatttccctgacttcgctgtgatgaatggagtgcaggagaaaagaccgggtaatcaggctgctatagtattctaggcagggaagggtgggctgaactgaagcagctgcacgagggatggaatgcagtggatcggtgcgagaagccaaggattaacctggtaggtgactggcgggagggagagcgagagaagggaacatcagagatggccccacatttcttactcaggagaaggcagtgccatttgctgagaaggattacaggagaagcaggttttcaagggtgtggatgatgaacataggggtggagtggattgcagcctctgagttgaaggcactcagagtatttcattcttaggtgtctcctgccttgggtgggtgtggctcaggaggcccacctgccaaccccgccccctcatgtggtgtatgtacctattgcatgcatatccccttccaccatacacactcactggttcctctccagtttggtctgttccctttctctggtcagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagtgagttgagggccagacgcagtggctcatgcttgtaatcccagcactttgggaagccgaggcgggtggatcacttgaggtcaggagtttgagaccatggccaacatggtgaaaccccgtctctactacaaatacaaaaattagctgggcattggccgtgcacagtggctcacacatgtaatcccagcacacatgtaatcccagcactttgggaggccgaggcgggcagatcatgaggtcaggagatcgagaccatcctggctaatacggtgaaaccccatctctactaaaaatacaaaaattagctgggcgtggtggcgggtgcctgtagtcccagctactcgggaggctgaggcaggagaatggcgtgaacccgggaggcggaggttgcagtgagccgagatcgtgccactgcactccagcctgggtgacagagggagactccatctcaaaaaaaaagtgagttggggagggggtcaaccatgtttctcccatggatagggtggcttttggtactcatggtcatgtcctttcatctttatgtctgaaaaatactaattccttcattcattagttattcattgagtgcccactgtatgctagccactgtgctacttggggggtatagtggtgacagtggtcttgctttcatggagcttatattctacttggggagatatttttaaaaagtacattttgcattttgtgtctgttcctttttttttttttttttttaatagagacaaggtctcactatgttgcctaggctggtcttgaactcctgagctcaagtgatccttccaccttggcctcccaaagtgctaggattacaggcatgagccagtgcgcccagccttcacgtatgctctatgaagacaattaaactgatttgctaaaagagggagcaacttgaggtgggttatttaggaaaaccctttttgaagaagtgatagatgagacctgaggatgtgaaggaatctactttgtaaagatctcagggagcctgggcaacaaagcgagaccttgactctacttaaaaaatattagccgaatgtggtggcatgaacctatagtctatttacacttggttaggaggctgaagtgggaggatcacatgagcctggaagatcaaggctgtagtgaaccgtgatcacgctattgcactccagcctgggcaacagagtgagactgtctaaaaaaaaacaaacaaaaaactcagggaagagaattccttgcagagagagtagtaaatacaaaggttgcaaagtgggaacaaacttgggaccatgcttgagaaagccggcatgctgggggtagtagaatagcggtataggatggggaaccatatggaatgaaggtggtcaaagtgggaagcggccagatcacacagggccttataggccatggtcagggctttggaaatgattcctagtgggagcccactgccgtttgttaaacagaggagcaatgcaatctgatttaaatttttaaagccatgactggaaacctactgagcaagccaaggctggggctcctcagcatgggagcaggtagcagaggctttatgcctcctgggttccaccctggtgctgagcatgccctctctcaggactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactggtaaggagtagtagctgcagaggccactcttgctccttgccctaggtcctctcaccctcttgagaaccagtttccctctccacagccctgagctctcccttcatcttgtggccatgggagcacatgcaaagggcgaggccagctgttctgcagctagcccttcccagggcgctatggcagatactcatagtaggcccagcttaagcacatcttctccctgcagctctgctctggatgctatccgggaagccctgcagcttctggactctgtgaggcctgaggcccaggccagagatcagcttctggacgataaagcacaggccttgctgtggctttacatctgtactctggaagccaaaatgcaggaagtgagtgtggctgctgtggggctcaccagaactgggtgtaggaattactgtccctgggcccccaacaagttggtatcagcccttttttttgttcgttatttttagagatggggtctctctgttgcccaggctggtcttgaactcctgggctccaacaatcctcccacctcagcctgccgagtagccaggacgataggcccacaccactgtgccctgttttataccccgatcttcccatccagggtatcgagcgggatcggagagcccaggcccctggtaacttggaggaatttgaagtcaatgacctgaactatgaagataaactccaggaagatcgtttcctatacagtaacattgccttcaacctggctgcagatgctggtgaggggtaaatggagtgtggcatgggcatctccatggcttcctaagagtggaacagggacccctggtgagggaaaccctgaccttgtagggtaggaggttgtggaagcagtgggaggttggcgtaaagggcagaggatgttatggaggaagggaagttctctccagatggcccatgctgagacagcagtcattttcttctggcttaacagctcagtccaaatgcctggaccaagccctggccctgtggaaggagctgcttacaaaggggcaggccccagctgtacggtgtctccagcagacagcagcctcactgcagatcctagcagccctctaccagctggtggcaaaggtaatggggtggggcattgagggggacccatataaacaaggactagaccagaaacagctccctcgccttctttggcctgtgatcctcctgagaagccatgaaagccagtgatggaagcgcagggctgtatcaccagtcttattttaaatccaagctccctcattcattagtgtatggccttgggcaagttgcttaacctaagcccaagtttccttatctctaaaataggggccatgctactgcctcgtggcgttattattcagtgcagcagtgcatggaagaggtattgtgtaaatggtatgctcaaatgttagctttagtctgggcaacacggcgaaaccccgtctctacaagaaataaaaaaaatatagcccggtgcggtggcatgtgcctgtaatcccagctactcaggtggctgaggcaggagaatcccttgagccaggaggtagaggttgcagtgagccaagatcgcgccactgcactccatcctgggggacagagcaagatgctgtttcacgctatttcattaaaaaaaaaaaagttagctttaattattagatgatttgttacctatcagaaaaatacatagatgcctttagacacaattttacattcttacattcttatgtgtgccttctttttttttttcaagatggagtctcactctgtcgcccaggctggagtgcagtggcgcaatctgggctcactgcaacttccgccatctgggttcaagtgattctcctgcctcagcctcctgagtagctgggactacaggcacgcaaccacgcctggctacttttttgtatttttagtatagacagggtttcaccatattggccaggccggtctcgatctcctcaggtgatccacccgcctcagcctcccaaagtgctgggattacaggcgtgagccaccgcacccagctttccgccccgcccccccgccgagatagagtcttgctctgttacccaggctggagtgcagtggcgtgatctcagctcactgcaacctccacctcctgggttcaagcgattctcctggctcactcagcctcctgagtagctgggactacaggcgcataccaccacaccctgctaattttgtattattggtagagatggggtttcactatgttggccaggctgatctcgaactcctgatctcaggtgacccgtctgcctcagcctttcaaagtgctggggttacaggcatgagccactgtgcctggcctataaggccatgtacattcttatttcagggagtttcacaaaattcctgaagctctaccctagactccacattaggaaacaaacaaacaaacaaaaagcctttatacatgctgttaactatgagctattaaaccatatttctagcaggggaagctacctcagccctagatttgagacttggttctgccacatacctgttatatgaacttagacaagcaacttaacccatgtgagtcttagcttcctgtactgtaaaattgggattagacttgttatgaaggttaaatgcactgatgcatgtaagcctgggcacagtgcctggcacatagtaagaactcagaaaatcctggctattgatgatgaatggcatctaggctttaaaacagtaggggtggggtgatgattgcttcatctgggtaactacattccacccaggccctgaggtcaaactacagtccaaggtcccaaagggctggggagcagagggtagaaatagaggcttgagcaggggtggagtaaacttggctgcttctgctgaccagcccatgcaggctctggaggtcctcctgctgctacggattgtctctgagagactgaaggaccactcgaaggcagctggctcctcctgccacatcacccagctcctcctgaccctcggctgtcccagctatgcccaggtgagtgcccaaccagcctagtctggggactgcagggggcccgtagctttagaggcccacctctgagaagacaggatatcaaaggggcagcttctcggccttttaccaccacaactggctggagaattgtggagtgtggagcagttggaggcagctgtaagaaggggagtcatctttgtccttcctgcaaaaccagttgttcattaagtttacagactgctgcaggaacctaccgccagtcttgtatttcctaactggttctgttgccctagttgatgcttcattgctcatgtaaagctatcacagtgtctcctggttggtctccttgcctccagtttctcccttttctacttcgtcttcttaacgaccactggtaggcacaggtgtgatgtaatctctttcctgcttaaccctgttcccttttgccccaataatacttgccagcgcttacggctgcagtgtttacccctggataactttgccacaaaatatctcactcttactatttttgcatcactctagtatattgactttggaaacagaagacatcattctgtttatagcattctgtttttagtggtgtcatttccatttccatttccatttccacttccacgtcaccctcccgagtaactgggactacaggtacatgccaccacacctggctaatttttaaatgttttgtagagacagagtctcactatgttgcccaggctggtcttgaactcctgggctcaagtgatctcccacctcagcctcccaaagtactgataatacaggcatgagccaccgtgcccagctactgcttactctgtatatagctttaatctaaaagtggttaaccaggctgagcgcagtggctcacacgtgtaatcccagcattttgggaggctgaggtgggcagatcacctgaggtcaggagttggagaccagcctgaccaacatggagaaaccccgtctctactaaaaatacaaaattagccaggtatggtggcgcatgcccgtaatcccagctacctgggaggctgagacaggagagcacttgatcccgggaggcggaggttgcggtgagctgagatcacaccattgcactccagcctgggcaacaagagcgaaactccgtcctaaaaaaaaaaaagtggttaaccaagtgttaaatggacattttagagagtgaatcaataactcctatgcagattataatatctgaaataatgtaatatttattggacatgttgaacattttgcttgtaaatactttactccactttttttttttttttttttttgagacggagtctcactctgttgcccaggctggagtgcagtggcgcgatctccattcactgcaacctctgcctctcgggttcaagtgattctcatgcctcagcctcccgagtagctgggattacaggcgcgtgccaccacacctggctaatttttgtatttttagtagagatgggggtgtcaccatgttggccaggctggtcttgaactcctgacctcaggtgatccgcccaccttggcctcccaaagtgctgggattacaggtgtgagccacatggccacccttatttactccagttttgtttgaagagcctggctgcctttcctcatgtgccctctgattgcttccttagttacacctggaagaggcagcatcgagcctgaagcatctcgatcagactactgacacatacctgctcctttccctgacctgtgatctgcttcgaagtcaactctactggactcaccagaaggtatttctcactttcttaaactccgaaggccctgggtattagaaagaatttaggattttcttgatatttgcctggcttttgagatttccctggagctaggcagtatgttcctgaccctgagaggcaggcatatttcctagccttgccctcgccagcgatttgctcaccagtcctcctctggtagagatacagtccttttccttcttcaggggcaagggggaaagtctgtcctgtgacgaaaagctgggacaatggtgatcctgggaaggcatgggagctctggactagaaatccaggggatggcaaagacttgagttttctcccaaactagttgtgtgacttgggcacgtcttctaccttctcatgctctagtttcttctctacgtttttatcattcctaaattggcggacaagtcactggtgagggcaaagctaggaactgttactgcttctcagggtcaggaacattctgcctaggtccagggagatctcgaaagccaggcaaatattcagaaaattctaaaatctttctaatacccagggccttcagggatggggccacgtaatctccagggcctctcaagctctggagtgcctgactgccttactgcctcctctggctccttctctccttcaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggtgaaagaatagggtggatggccccccttggatgacatgtatggtctgtctgctgtcagctcttctcaaacctcatcccctctgctggctaactatgtggcccagcctacctagaacctgcacagagtaggcctgggatagcagatgggtttcagtttgcctgctgactctaaacaattggtgactgcctggaatactaggctgaaaggatttttttttcttttcttttttttctaagacggagtttcgctgttgtcacccaggctggagtgcaatggtgcaatctcagctcactgcaacctctgcctcctgggttcaaacgattctcctgcctcaacctcctgagtagctgggattactggcatgcgccactacgcccgactaatttttgtattattagtagaggtggggtttcaccatgttggccaggctggtctcaaactcctgacctcgggtgatccgtctgcctcagcctcccaaaatgctgggattacaggcttgggccactgcgcccagccagctgaaaggattctgagaccccaggggatctcagagggaaggagttatgagattgattagctctgcctgccttaatgcagaaggaagcatgggaagcaggctttgctgccttagtagctaaaagtggtgaagttctggctgcatcttctccctttttcaccccacccaccacaggctggcagacacctgagatagctctcatagactcccataagctcctccgaagcatcatcctcctgctgatgggcagtgacattctctcaactcagaaagcagctgtggagacatcgtttttggactatggtgagtctggggaggacagcagggccctcttggaatggacaggctatgtgagagggctgcggttttttctccagaggatccacactgtggctgagtgatggtggtcttgtctcttttgctacaggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtaagtacagggccagaggatatggcaatgatggcaccaaagtgccatgcacccttgaacatggattccaaactgttccacagattacatgctatgtttagatacattcgtggaaaaaggcattccacagctaaataagtgggaaatgctgagttaatcaaggttagatgtttttatttcctgtaggactctcgtgtccttcagtatgcggatgtgccttgcaaatctccaaaagggagatctagtgtacagtgtttccctaagaatgttttcccacaggattcttttattgaggaatgcagtttgggaaatcctgtcccaaggcacaaggagagttgggattagagagaagtgtagagggttttccccagggagcctttaagtcagcttaagggagtgaatgccttttggaggcagggaaggactcaggtagcttggcctgggaaagaggcaaagagaaagactctccaggaaaacaaaggattcctctgattggttctcctctcctctctcaacaaggtgtgccctgttcctggtgctgaagggcgagctggagctggcccgcaatgacattgatctctgtcagtcggacctgcagcaggttctgttcttgcttgagtcttgcacaggtgagcagccatgtccccatgaccataggcggtgctgaaatgacacacactacagcacatctttctatgtaaaggtttcgttgcctttttttatttttgagacagagtctcactttattacccaggctggagtgcagtggcgtgatcttggctcactgcaacccctgcctcctgcctcctaggttcaggtgattctcctgcttcagcctcccaagtagctgggactacaggcatgcgccaccacacccggataattttttttatttgtagtagagatgaggtttcactatgttggccaggctggtctcgaactcctgacctcaggtgatccacccgcctcggcctcctaaagtgctgggattacaggcatgagccaccgctcccggcctttgttccctttttaatcagatactgacttctggtcccagggcaacattcccttgactttagtccaaccattggtctccctctttcagagagcctgtcccagacttaccctagttctagttttcagtgcttcctaatacattttggctatttaaatttgatttagataatatttagggccgggctcggtggctcatgcctgtaatcctagcactttgggaggctgaggcaggcggatcatggggtcaggagttcaagaccagcctggccaacaaagtgaaaccccatctctactaataatacaaaaattagccaggcatggtggcgggcacctgtaatcccagctactcagaaggctgaggcaggagaatagcttgaacctgggaggcggaggttgcagtgaggaagattgcaccattgcactccagcccgggtgacagtgcgagactctgactcaaaaaaaaaaaaaaaaagaagaaagaaagaaagaaagataatatttagaattcagtcctcagtcacactagccacacttcatgtgctcaatagccacatggctagtggctaccgtattgagtagcacaaacatatcctcaggagggctgaagctaataataaaacattgcattgatggcacattttgtctccccaatcacatatacttctagtacttcatttgccccacactagacctcataaagctgagtgggagcatagattattttcatttgttaaatgagaaagttgagaagtctatgtttggggccagcatcacagggtaggaggcaggattcaggtgtgggcctgctggggccagcctgcttttctcagccatgtggcccctgagctgcaggtgtgggggctttgtggcctgcatttgatccattgttggttggaaagaaaacaaaaattttacctccaaggcgggcggatcacaaggtcaggagatcgagaccattctggctaacacggtgaaaccccgtctccactaaaaaatacaaaaaattagccgggcgtggtggtgggcgcctgtagtcccagctactcgggaggctgaggcaggagaatggcatgaacccgggaggcggagcttgcagtgagctgagattgtgccactgcactccagcctgggcgacagagagagactccatctcaaaaaaaaaagaaaaaaagaaaaagattttacctaaaaaataataagccatactaatatttgatatgttatacagtaatacatatatatacacacatatatatacacgtacgtatataaaacacatatattagagaattgggccccaaggtcgctcaggaagtgcttgatgccatttctccccgttttgtaattcttgttctgccttctccccagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaggtgggactgttgctaggtggtggtgatggtgttggatggggttagtcctggaggagagtgttttatagagcaggtgtccctgtggaatagctccccagggcctagtggaactttaatctcctgctatctgcagtaccccaatatcttgcttttttgttttttgttgtttttttgagaaggagtctcgctctgtcgcccaggctggagtgcagtggcgcaatctcagctcactgcaagctccgcctcttgggttcacgccattctcctgcctcagcttcccgagtagctgggactacaagcgcctgccaccatgcccagctaattttttgtattttcagtagagacggggtttcactgtgttaaccaggatggtcttgatctcctgacttcgtgatccacccgcctcggcctcccaaagtgctggggattaccggcgtgagccaccatgctcagcctctttttttttttgagacggactctcactctgtcgcccaggctggagtacaatggtgcgatctcggcttactgcaacctccacctcccgggttcaagcaattttgcctcagcctcccgagtagctgggattacaggcgggtgccaccacacccagcttatttatgtatttttagtaaagacggggttttaccatgatggccaggctggtctcaaactcctgacctcaggtgatccgcctgcctcagcctcccaaagtgctgggattacagacgtgagccactgtgccaggccaacatctttcacagcaagacctatttccaagtctccctttgtttcagacagagacattttccttaactctaatgtttcttttaccttttcatcccaccttctgttccctcattttctccctccttccacacccaagagtcgctgcccctgatctagagtgttggctgtcatgtgagaagttagttctgaaatcttccagggtcctgtgtgatggtgcctgatggtgcctccactacgccacctgctgtcacaaggtgtcttgtcactgaagacctcttagcccttcaccctttcactctgatctcaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtaggacagcaagggtgaggtggaaggtgcatgttttgggggtttgttctggggcaaagcacaagcagtaagtgctgccaaggaagtacaggaagaatgttcttttgctgactctaagggagtggattacagaaggaagaacaaagagaatggcagggggagggagcactgtgaaaaaggcctgctctctccccaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtgaatatgcgacccctgatgttggtcacttggagagggctgagcctctagggcttttgacccctctgtctttccaggctgggttcggatctggatccagtagcctctgaacctgtgtttgaaccccagcactctgtctatgagctgtgtgcaggtcacttaacctctccaagcttctattccttctgtaaaaatggggtttagggagcatggtggaataagttgatgcctgttagttgcatggcaccccacttggcacattgcccttcataaatggtagttgctgtttgccatgtgggagatgagatagggactgttccttcttggaaagttcctatcaactatgaaataaggaattcagctgtaccaagtgtcctgacgttcttctaggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcaggtgggtgctgaccatccccaagactcctgctggggcagactagagagaaggtccagactttgaaggaatgggacctcacccctccccgtgttgcttgcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggtatgcgggcagccttctggccggctcctctgtcctcttctgcatcttcttacttgggagctgggtgaaggagttttaggcattggttagtttacatagatttatgacccttatgtcataccttttcacctgttagcatcttacatcaggaaggtttgttgttttttttaaacctcaactttgaattaccagcaaattcagtgtctttcctcagaggtgagttcagatgactggggtcttctgtgctaacatgaaacatattcacatgatttgagtgcctcactttgttagttgctgtgagggacacaaagtacaagtcatggtctctgtgcacagggagctattagagcaagggagagcaccttgacctctagtgaccagggaaggcttcttgatgctggcttgagtgatggataggaattgagtgcccaagacagggaagggaattcctttaacagctgaatgagtctggctgtatcctgtgtgtcaggggtgactgtgtgtgtgttggccctggccaccctccagcccggaaccgtgggcaacaccctcctgctgacccggctggaaaaggacagtcccccagtcagtgtgcagattcccactggccagaacaaggtaggattcctgggccatggagcaaagttgggctggattgggcttcgggtcaagctgctcacattctgtgttgagggagggagagatggtgatcacgtggacaagcagagctctcacagccccatctcccaaagcttcatctgcgttcagtcctgaatgagtttgatgccatccagaaggcacagaaagagaacagcagctgtactgacaagcgagaatggtggacagggcggctggcactggaccacaggatggaggtgtgtgcttctggggtggggtcaggcctgctctaggaatgacccggggggtcccagtgacttctctaccagacggcctgggtcagtgctaaagccacttcaaatcccttctggaagtgtagacctaaatttaaaaatatgtcacctggggagaacttcagagcccagaacttgaagaatatatgggaatggatatttaaagatacgcagaaaaaaaacgacttaaacccaactatcagcttcccagcagaaagatacgtaagacagacatgcacattggaaaacgcattttctcatctccaaaatgtcagtgcctgtgagaaagaagcttggtttcctctctgactgaagggtctgccctctgcattcaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaagtgagtgaggaaagcagggaagggggccaggcccagtggcttgcacctgtaatcccagcactttgggaggccaaggcagatggattgcttgagctcaggagctcgagaccagcctggccaacatggtgaaaccctgtctctacgaaaatacaaaaattagctgggcatggtggcaggcacctgtaattccagcttctcgggaggctgtagcaggagaattgcttgaacctgggaggcggaggttgcagtgagctgagatcgccgcactccagcctgggtgacagagtgagactccatctcaaaaaaaaaaaaaaggataggccccttggcttacgcctataatcccagcactttgggaggccgaggcaggtgggtcacaaggtcaagaggtgaagaccatcctggccaacagggtgaaaccccatctctactaaaaatacaaaaattagctgggcttggtggcacatgcctgtagtccgagctactcaggaggctgaggcaggagaatcgcttgaacctgggaggtggaggttgcagtgagctgagattgcgccactgcactccagcctgggcgacagagcaagactctgtcaaaaaaaaaagaaaacagggaaagggaagaaactggacttaatcctttcccagcagctatcatgaatgaagatggtgctcaccaccactgtttccctgcagatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggtaaggagctggggcagaggggcagtgtctagtggggagtgaataccaactcatccccatgccccttctgacttctgcatatacctggctggggacagtaacctcttagtgctttttgcccaggacttgcagaagctgccgtgggaaagcatgcccagcctccaagcactgcctgtcacccggctgccctccttccgcttcctactcagctactccatcatcaaagaggtggggttcagggcgtagtgtctggggatgactggcgactggggaagacgtcaacaaagaagggcagagaaacctgagaagataggagagggtcctaggaatggctcagacatggaaaggggctgagattgttagagcttgggcctcttggtgagacaagcatcctaatcgccagtgtctcctcctcagtatggggcctcgccagtgctgagtcaaggggtggatccacgaagtaccttctatgtcctgaaccctcacaataacctgtcaagcacagaggagcaatttcgagccaatttcagcaggtcaggggcgcgaagacaagaagacgtgtggggaagggtagacaacatacaggggcaacaagccttttctccagaaacagctgttgcagcccaccttctatctaatgatccctctgctgtctttgccacctgacccctgccatgcatttccctattctcacacctgccttttccctgcagtgaagctggctggagaggagtggttggggaggtgccaagacctgaacaggtgcaggaagccctgacaaagcatgatttgtatatgtgagtgcttaaggcagggatgtggggagaggggcagtcctgaggatggtatcaccatgggttgctttgggacttgagagcctctgaagacacaggcagaggccaggtattactagctcaagactcatctcacctccttctgccttagctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttggtgagtctccaagggcaagacccatcctagggcattaggactcctgccctcaccccaggttctttcccaggtctgaatcttgcctctcttgtgccccattttcctcctatcctagttagttccctggcatgcctggaccattaacccttagctcccttctgttcttctcttgtaaccaagggccaaaggagtttctcattggttcaatcctctccactcacccacccccaccaccaatggtgttttcctatgtattctgttttagagcccttactttgtatttcctccttttcttttcccagccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcatttaaaccctg

SEQ ID NO: 559 - DNA, 247233 bp, Homo sapiens
gaggcctgggataggctgaggcgaagggaagcctcacccactgtgcagcccaggcgccgggcgctgcctctacagctgtgtgtaggcctgggggcgagggtcttcggaacgtagcgctggctgcggccccgcccgcctacccacccgcccgtccggcagccggctcccgccgcctccgcgctctgtctggggccagccacctggcgggccgctccggtgcgcctgcccgcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggtaagcaaggaggcgcgcggggccgggcggagaggggccagggcaggcgtcaggcgacccggttcctcagagacagccggacacgtagggcagggcttggtcaccccgggctctggctgccctcagctcgggtcaccggggtcctcagccttggaaggacgtgtccgtcttccccagatctttactcctgcttcaacttttctagtcccagccccagtgacaggctggacggcgccactagcctagggtggcgatgccttctctctgctccggcgttctggggaagagccttccccctccagctgtgctggaggaagaacgaagagtggtgtgggtagacttttttttttttttaatttaacacctaccttttgccttcctgtccccctgaatgtgagaaagagcagccgcttctcaccctaaactgtcatcttccaccgatacttacctcatccttattcttatttcagctgcctcccctcctcttcccttctgggaaagtaggaatgcactgtggccagtgtctgtgttgcaaaagtttttcttactttgtacttcgtcatctttttagcctgttaggtagatgtttgtttcgctttcgcagtttagaaatctggaggaatttgaagcgtctaaccaggttggaggtgttaagttttttgagcagcaaaggacttgggatgcgattggaagagaagcccccggtcagtaatgtaggaatgggtttttttttccccttttccttttgtttcatttcgttttcttctatagcttaagacattaacttgtaaaatccatttgttgctttttagttctaccattgagggtggttgagtgagggtagatatccagtctctacctgaagccttgtgcgaaggagaagataacatttcgctgatttcaggcttatggggtgaaaaatgtacacttcacacgatctgattgagcccttcgtacaatgctttgaatagttatgggagtaaaaaattaatgtttacgatagttgccattcaaggcacacttcacatgactagatatgaaatgcacatccccttcccccataggttatcataaatgtgggtgaactattgaacttttactgaattttaattttcagacattgcattttcattccatcagtgaatataaaattgctgggttgccagggtaccatgagtgaaacaattttttatttttgtaagagttataaagtataggcatttcacacttcagattcatatgtgcaagcaactttgtaataactatatttatgatctgttgcctggtgcccctccctgcttatagatacactatatatctcattttcaaagcaaatgatggagtatgtgtaaaaataattagtgaagctctgatgacttttaagaactactttaatactgggaataattagaatttatcattgattacattctgtacgtaaagagagtcttaaacataatctatccagaaatcttgaagatccagttattcatgaaaaattaagtgcctttaagagaacagaaatttagtagcagtttaaaatttagatcatgtaatctagctttgcatgtgaacactcatagaattttcatttataatttcatgtaacttgatttgcatagttaattaggcagtgtgaacaaccagagcacttgactctctgggcaaagatgagaaaataaagaagcatagataatcaagaagattctttgtcaaggtagaatccgaaaagaaggatccagaaaattgttttaacctgtgtttctctatccagctgtattaaaattggaaagaatgccaggaggaattttattctgtccaagcagagaaactgaatggaacaagtttttttctttacattgaatcttaactttgttagatgactttcagggaccagaaatttggtggagacaaatgcaacctgtccagggtctttcatgtgtagttttcaagccagagccatttggtgactagccaaacatgagggaccagaacaaagtaggtaggctgctgaaagtggtgacctggctctgtgcactaatctcttcttgttcacgcaacagagatttgtttggtgcctattggattttaagcattgggagttgacctttatataaaacaaaacccctaagcttataattcagtagggagaaacagacagtaaacagccaagtaagtaaatataaatgttatatggtcagagcaggcctctgagagaagttagggagtaagccatgtgggtaattgttgtgttgtaggccatttgggctgccatagcaaaatgccatgaactggacagcttttcaacaggagaacttgatttctcacaattctggaggctgggaaatccaagattaaggcaccggcagattctgtgtctggtgagggccttctggtcatagatggcaccttcttgctgtgtcctcacatggtggtacgggcagggcagctctctggggcttcttttataaggacactaatctcatccattaggactccaccttcgtgatataatcacctcacagaggccccaccttgtattactgtcacaatggggattagatttcaacataagaatttcgaaggacaaaaacattcagaccatagcatggtagaaggacattcaaggaagagcagacagtaagcacaaaggccaggaggcaagagcttgcttagcgtttgaggaatagcaaggcaggcagtgtggctggagcagagtgatcaaggaaaacagtaatgggagaacagcaataggagacaagatctgagtcataggtggtaagggaagaccatgtagggctttgtaggccattgtaaggacttcggcttttacttataagtaagttgggggaggtggtgtttgaacagaaaagatacatgatttgacttgaatttcaaaatgatctctttagtgtactgagtatagtctgtgaggcattagttacttagagggataattgtggtatagattggacctgggtggtagcagtggaggtggtgcaaaatggtcagattctggattgaatttcaacatggagcaaacagaattttactgatggcttgaatgtggtatgcgagagaaaaagagaaactgaagataattctaaagatttttggcttcagtaactggaaggatgcaattgccatttgttgagatggagaaacctggactaggagcctggtttggagaacatcaggaatttggtttacggacatgctaaatttggggtgtctgttaaacgttgaagttgagctggtatgtaggcaattggttattcaggtgtagagttacaagaagaaagtttagggctgtagataggaatttgggagtccgaggcacttagagagtaacttgaagccacaaaactggatgagttcaccaagggagtgaacgtaaaagagaagagaagagatctgggagctaataagccttggggattccagactttaagagtcaaggagccgggtgtggtggctcacgcctgtaatcccagcactttgggaggctgaggcgggtggatcacgaggtcaggagttcaagaccagcctggccaacatggtaaaaccccgtttctactaaaaagataaaaattagccaggcgtggtggcaggcgcctggaatcccagctactcgggaggctgaggtagagaactgcttgaacccgggaggcggaggttgcagtgagccaagattgtgccactgcactccagcctgggcgacagagcgagactccgtctcaaaaaaaaaaaaaaaaaaaaaagagtcaagaagatggaggggaatcaacaaagaagatagagcaggaacgaccagtaaggtaggaggcaaaccaatacaaggttctcttcagtcaagtgaaaaaagtgtttcaaagacaaagggatcagctgggttaaatgatgatgatgattcaaataagatgagctttgagacttcaccgttggaattaaccgtatggcggtcacaggctacctcagtaagaactgttttggtgaagtggtgagttcagtagtctgggtagattgggttcaggagagaatgaaagggaagaattggagacaattaatatagaacattcttttgagatatccatatcctaaactagaaggcagagatggtagtgactgtctgtggcatcttctttatccccttatccaccaggtataagataactcagttactctctaagctctataatctgaataacagatgacttagaacttggaccagaccaccttatgaccttggacaagttagttgcctcatttttaggacagatggtagctttttattttcttcatagtaaggcacatagtaaacacctaaatatttattgaatcaaacattataaacattgtaactaaatgcaaactgtaattccccaaacaagtagttgcttgacagtttttactcaacagattttacttctatgtaatctttcacagccttcaggcagcagaagaatcttcttccatgtatccttagatttcacgtccattctagaagtctagaaaggggttgcagaagtctttgttggggggtatatacagatgatttattagtcattcataccatgtttagaatgactttaataatagggcactccaatttggatattgcatcttttcagaggagatggggggaagatgagagaggagtgtaggaaaaaagatgtgctattgaaagatctttcgttaccatcttaaattataggttcctgcacagtatttatattttgtgtaacagcacctgcttctcagacacctgtacttcttgtggggtcagtggcaattctgtatttcttttttttttttttttttttgagatggagtcttgctctgtcgcccaggctggagtgcagtggcgcgatcttggctcattgcaacctctgcctcctgggttcacgcgattctcctgcctcagcctcccgagtagctgggattacaggcacctgccaccatgcctggctaattttgtatttttagtagagatggggtttcgccatgttggtcaggccgatcttgcactcctgacctcaggtgatccacccacctcggcctcccaaagtgttgggattacaggcgtgaaccactgcgcccagcctctatatttcttttaattgtcttttgggaccatgactttccttatcctttgtatacagtaattctagccaacagtaaacacttcatattcatttaaaaaaatctgtgaattgaaataatgacaagctaaattatcttaaattttgtagtatttactttatgctgaagtcaagatttgtcttcatggtgccagtcagtcattacagacttctatttatgtagctagaaaatgtgcttcattctctttctctcgtgttttataactaaatccttatattcaaatgaatgctgaaacttggttaacagaagaaaagcagaagaacagggatgtgcttataaaatatttggattttaatttttagataggaattaataaaccttttaagctcattcggcctgtattttcaaatgtacagattagctagcctgtttagaggagggacaattattgcccattcatccgtgccccatggttgggaggaacttccctaaaaaaacaccactgatcactagacccatctctaacatcttaccatggcggtgtgagttaccttactggagggtgattgcctttgctctgttttgcttgattaggaagagctgatcagtcagaaagctatgagtagtgggaatcagtctctttgcacctctctgcccagaccagtaaggcaattatcctaaccagacttacccttgagcatactgtctcaaagtctagaatgtagaggagagggcacaaattgctagcaagcccatttggccatcacatttaacctgtattcttcaatagctgtatcagttataaaggttcatctcttgtctgcccgactcctgtgtccactcagttttttggatgggaaaaaccagttaatggggcctccctaaagcccatcacagtcctttttagaaatgaagatgatgatttcattcatgaatgatggtgaatttgtactgtgattatcaattttgtccagtgattcttgcagtggaatccactgagcttgtggtgttgagtgtagttcagtctttctctgtggagtctattcctttgtacatgtgtgttgtgtaataatagcttccccatttttattgtagaatccaattttttttaatttggagaaagagatacacagaatctagaatggtagataacctttcagtcatttatatttctgatgtaggcatgcatagcgttagagctgaataagtacttgtttaattgtatacatctttgcatcagatagaattatcataaaattagttttcttatgtacacactctttttgtgatatgtatagtttagtggaagatgcctgagccaattttatgggataaagcaagtctattgtgaaaattttgccacatataatctagagctgatggaacagagactttcttttagttttaagtttcctttttccttttatgctattctcagttttttctttacactaattatgagaacactcttagaatattgtatcttttgttattcatagacaatagcctaagttgaactgggaaagtggaatggcttctgctattacaattattcctagaaatatattctaaaacgttatatgggttaccagtttacctagtgattggtttaatgtggttaatttcacaatcatattttgttcaatgttgagaataaaacagaggttgaggttatttgacttgattgctgagaggagaatttatatggcagttgtaagtaatgccaataaaagttgtttgataaaatgcctagtgtctgtaataaaccttttctcagctttgttatgctctctctcagtgaactgcttattccataaatggtactatgtgactttcagaactgttttccactgtgggcattattgggtctgtttagacagtaatgataccagttaattccacctagttgaaaacaattccaaagcctttcttacagagttatacaaaaataaaggaaaggaattgcagtggaaagagagatttctgattggatgaagcaggaccctagatcattttataatgaagtcacagtcatattttcaaaaatctttattttcatcaaaacacttaattgtaaaagatgggccctatactaatgaatgtaaaaatatgattacatgttttaaataacagcatagtatttcattttaagaactgaatagttgatatttgagtattacttatatttactgaaattttttgtctaagcgtgtcataaggacctaattagaaatttaatctagaatttatgtttcatttcccatcttatgtaatactaaattaagcaaggtgaggattcattcaccatatttgataagtgtttctgattacatcatccagcaactgaaatctcacatgtaaccaggcatattgcaaaagcaagggcatgccacgttctacatttttgttagaatatgtgtataaaacagtatacttcattatcagatggatgcctgttttattgctactgaggcagtaggcattaagctctgtgcagctacacagttaactaatatatttgagttgcttaatattaaagctaataatctaagatcaagaattaaaggacatgccatagtatatgcagcagtgttaaaatggagaagagcaacgttaagatgccactaagagcaaatactagaattctaaaatgacgtaatttccttggttaaacacattctggaatacatacaactcctggttatagaaggaaatagaattttaaactgttacatgaaactcaactgtggcctgtatagtgagcagtagtcaaaatgagttatgaccagaaagaaaaagatcattgttgccatttactgggaaagtatgaatagaccatgaagaaatcttagggtccgtacacatgaggaaggtagaaacttcttatttctagtcaatacttaaggactttatttataccattaaaacaggtcaggttaaggaatctattccatgaccaactgaatttatactttaaaaagaaacctctgacttttagaaaattttttttaattgcaaatcttattggcagttattttcaattaccacacttttcgttaacagataagattactatttaggttcttttctgacttaaagtggtgctttgtattgatagttggtgattaagtttgatttgcggaagttaacatgtataaatatatataatatattaatatataagtatatataatataaatatatataaagtaggaagtctggaaattgtgttttaattatatcatacaatatttctttatggatcttttatatgtagtaggaaatagacttcttgtgtgtttttttgtttgtttgttttgagacagagtctcgctttgtcacccaggctggagtgcagtggcgcgatctcggcttactgcaagctctgcctcccggattcatgccattctcctgcctcagcctccccagtagctgggactacaggcgcccgccaccatgcctgtctaatttttttttgtatttttagtggagacggggtttcaccgtgttagccagaatggtcttgatctcctgacctcgtgatccacctgtctcggcctcccaaagtgctgggattacaggtgtgagccaccgcgcctggccaacttcttatgtttaaagcattttagtttagacatttgataaagttcaaatgacagccatgttgtgcagttctatagtagttttacacaatcaatgagtgactttttatatcacacgtttggaagtatataagatttaacttaaagtaaattagattgattttgcaagtgtttattgtggaaagcttcacagtttttcaacatgctgctgtctcttaaaacatcactgaagcttcttgttttgaattgccttcaaagcttgctgcatattcttcacattagcctcattagtagtaaatcttaaagttgggtttgatttttggctatagctaacagtcatttggagctaaatttggtgactaaattaggttagcaagctcggataaatactttgtattgataaaaagatctgaatatacatttcatgtaatgctgatagactgccttgaggactgttctcaaagaaaagtcccagagaagttttgagtgatattgacacaaagtaataaatctgtagctttacaaggtagtagaaagtattagagcaaatgactcttggactacttattacttcgtgggtagcaatttttttaaaaaaagtttgcccgcaggataaaaatgggtaaaaaaaaagtgatcttaattttagagaagtgggaaaatatagagctagaagaaaatatttcaattatctgcctgcttttaatattaaaaacaaagatcatgatagtattcattatatatttctataataaagcaagttaaaaccgagtggcagaggaattagaataatgttagagatagaggtagtagctgagaataccactgaggaagaaagcaggatacacatagaaacgtatacagaaaaaatgcataaatacaaatataaatgaaaatggagtaatatctccatcttgtggccttctttggatattgctattaaaaatgttgaggggttgtattttcacaactgtaggcataagtaagaataaaatatgagacagacgaaaacaaaatacgagtcagagagttcttgcagtattttgcagggccttttaagaccgagcttcccaattggtgtgctgcaagcatgctgagatagtgatgccctgccttgagcagccttaacagtttcctccagtgtgtcttacaaatacaattttctgtaacgtgccatggtatgaaagaggttgggaaagcactgctaaggcatgcagttctgatgcttttcttccaggggaaaatttatgagcgagagggtgcaggtgtgtgtgcgtatgcatttatatacttatgtgtgtatagtaaatatatttataaatttatgagtgtataggctgagtatataaatttatgagtataaaatgttcagcttgtaaagtatatatatatggtaaatataaaagtatatatgtaaacataaaattgttttataaaatgattcttatcaaaatgtttcctatactaaagatccttgtttagctctcgtagaaacaaaagtattgttaaagtatggccgagggaatttagatagagacgaaatcaataagtctttgattaattagcattctttacttgattacttagcctggatgtcagaatggccattaaatgttaccaaagtttacaataactccagagtaatactttaatgatctgtaacgatccactgtatgaagaggatacagatgactttgaaatgtataaatattcaaattctgggtagcctaaagaaatattttgtgacactaagggataagataatattttacatataaatcatgactgacagatatttcagatttttgacagctgacacactttttcaagccattgatcccttagagcagcactgtgcaatagatatgtgatacaaaacacagaggtgatgttaaattttctaaaagtcacatttaagaatgtaaaaaacagatgaacttaatttttttttttttgaaatggagtcttgctctgttgctcaggctggagtgcagtggcacaatctctgctcactgcaacctcgttctcctgggttcaagcgattctcctgcctcagcctccctagtagctaggattacaggagtgcaccaccatgcccagcctgaaattaattttgataatgtattttatttaacccaatatactaaaatattattccaacatggagtcacattttcaaaaattactattattttttgagacagagtctcgttctgtcgcccaggctggtgtgcgatggcacgatctcagatcactgcaacctccgcctcccggattcaagcaattctcctgtctcagcctcccaagtaactgggactacgggcacatgccaccacacccagctaatttttgcatttttagtagagacggggtttcaccatattggtcaggctggtctcgaactcctgatgtcaggcgatccgccaaccttggcctcccagagtgctgggattacaggcgtgagccaccatgtccagccaaaaattattaatgaagtatttcacattttaattttttgtactaagtcagcaaaatccgtgtatgttttacatttatacttctagcacaccttaatttggaagccaaattttgattgaaaatacttgatctgtattgagatttcataaggcatatagctaacaggtacattcacgtacccaaatcgttataagcaaaactttccagtaactcagtagaatatcagtttttcaatttaaatataaattaattaaaattttggtttctcatttgtactggcacattttaagtgcttaaatatgcctaatgcttattggatagcatacattggatagccttagggaattaacatttctgtattgtgtagatatagctaaatgtttttggataaaatcactgattattgtttttcactgactattgtttccattttgttagggacatagtttgtagttttcgtatttttttaaacccagtgtagcttttgttgttttgtttttaggttgttccaattgtgctagctatcatattcctagttacttatctatagtatacattttgaccatgctttgttctgtaaaggctattggtataaagttcatgctgttctaggaacattggttgtctgaacttccatgcataggcttgtctgctaagggtggtttcaggtaatcactttaattaaagttggtcatttacttttgctagctcatctattatattttataattctttaagtgttatttattaacagtatattaggtcgttagtgatattttgaccaggaaatcactggagttcctattttgtagttttagctttcagggtgcccattctccctattctgaaactcatacatcttatatattgctagctatgaaatattcactatattctttcctgtcatctattttgattattatagtatctttaattaaatgatttagaatagagattgctaggtgcatttctatttgtgtgccaatctgttggctctttataataccaatcagggattctaacatcacccttttttactagctgcctctgctaccttttcataactcctaatgagtacacctttactttgaactgaatgattaattaacgatctttttgcctttaccttttgtaatttcataaatagctgagaaaaagaagtagattttactgttgacagttcttacacatacttagctcctgttatttcaaatggacttggtacatccaggaaattgtactggtgtccaagatcttaaacattctatgctgagggaaaaacaacaacaaaacaaaaattttaaaactgacaatagagtcctgaagttggtggagacctcacgagtttctctttccttatataggagtctcttctgtagcactcccagcagatggtcttctagcctgtttgatggtgtctaaccatagggattatgaaacaacctgttaagtttttgtataatactactcagtggaaattttattcttaaagcccaaatcataattcttatctactttcaacatgctcactgtcttctggagtacccctgaacatatacttcttctaaataatttttctttgtgccttaaaataaaatgcacaagggaaataattatttgttgattttctccacacagtaaggcctttttttaaaaaaaatacatccaaactgagggggctacttgttttcattgtctttagatatgtaccaaggccaccctaaagaagatgcaagccaccatagttacagttgtcttggcactgtattaggcatgatttgtggttactatatacaattcccagggtttatcaaagtcagcaataggaaatttatggaagattgaaaaataagatgatttcttgtatgccatctttgataatagaggccacagaataaacttaattaaaaatgtagccagaaattgctatagactcttgaagcagcaccccgtgtatagttgtgcagtttgtgtatctgcttcaaacctgtcattgtgttataaaaatgttttagactttggcattgttaagaattgcacataggtggttaaactgtgaagtaaataatttctctttgataattgaaatattatgtttctgcgagtggaattttaattttcaggcccatcttgagtgtgagtttctctctcctctctcttcacctctccctagtggctttatagatgtttttactcttttctctgagacacctaggcaagaactaggtcttatataggtggcttagggctccctcctgaggttacattggggccattgcagatccagataccaagcctgcaggtcccttggcctggtctggactgtggggctaaaaccattgcctcttaacatctcagatacataatgttttgtaagttgtagcctcaggcagtgtccttctcactttcgcatttttttttccccacaggcggtggattgccactgcatcccctgatttcaagcagcaagcctggctgtgatcccaggccttggtagagtactttcagtcctcatcactctatgggagtcagacttctggtttcgtctgcctacttgtagtcatggagcccaggaggcttatagcttaacctctgtttatggctacaggttttcttttgtttttgtctacagagatgcttaacaagtttttgatcatggctatatgtttataattttctctctttaaattttaacattggtatatgtttggaatggggtttcggaggaagtccctcaaatacttagagtgcagttttcatgttggaacatttttaaaagctacatttattttataatattattttttaatgttcattttcttattatctgagaaccttttgccacttatcatccagaactatggtcaggttgtttattcacagtaatttaagaggctattaggcattgaaagagacagtctaccattccatccctgttcctttctagcaactgttcccagactttattcaagtctgggggtaaaacagtcaagtagcatttctaaaataatcaaatcccacgaggttttgaatatagtgataaataagtccattatctcagaatgacatatatgtccctgttattggagatacccagaggagagtcctgaactgtcgtgaaactatttagaaaaatttgccaggtgggaaaagagatattgaatcttaggtgcgtgtcagaaaaacatgggctagagaaaattaatcctcctaaagttaaattatatgcagataatttcatgttgaccctttataaatatatttcactcacaaacctctgaagaagactttctggggtaaataacatttgttttcttataatcagtcttcagagattcacaaaagaaaacataggacaatgaggctaaccctcactaaagactgttttaataatcaacttaatggacaatactaaaattttagaattcattggatattagcttcatagaattaagcgtgatccttaattgaagctttaagcagtttatagagtacacatttggaacatactttaaatgatatatttttaaggaaagaaatatgtaattcaaatttataagagaagataaagggccctttcattttggaatcgtaggatttagtcagtttttgtataatttgaggagcacatcgattttttaattattattatatgcctttaatattgagttgttaatctaagaggtcttttgagggtaacaacatggaaaagaacagtagtgtaatgatcttttaaaaagacatttttacttataggcagctgatgcctttctaacatggataacaatactctgtaccagtcctctgtgtttttgtgacacaatagaatatgcacagctacttagattatgttaagaaattttgataataaagcctgcttttcatgtttgttaattcattagttctttttacagtattactgtaaaatagtaaagaatgagaaataaattctaataataaggagtgtatttgagtaaattatgacacattcttggtgtgctgtgaaatcagtagtaatatatgtgaaaactacatagcaacatggaaaatacatacaatgttagtgaaaaaaagccaaatatcaagttgtattcagattttattgtaattttgcaggattatatgtgcacaagggcaagtcagaaacatgggctaatgagaagagtttgaattgtgggactggtggaattctatttaggggcaaatatttcacttagagttctgctaatattactaacatatatccgtgtagattatattactttggaaagaagagtgttgtacaattaaaacacattggataaattaacaaatgttttcatgtttatgagataaatcatatggatattttgaaggctttaacctataatctattgaaggttataaatgggaaattaaatgaggtaattttttttcaaacagcctgggttaaatgaagtagatttgttgtctatgatcaataaaagtgcttgcaaatatacttacagtaagctgtgggtataattctacattctggtaaacaccatgttatcctgaccaagaaagctaaccttgaggatgagaccacagtttagtgcctctaatctttgtattacacttctgaaagcttttgtatatactgtctctctttaattcaaatattgtagatactaatgaacaaccaactatattattgtatttactctttaaatcctcatagtgcttaaaggtttagagctgtactgtccagcactatagccacatgtggctatagagcacttgaaatgtggctagactaagaacattaaattttatattgtatttgattttaactcacttaaaatttgaaaagctgagggagtataaaatgttttcccattaaacataattttattgtttggataagactatatttcatttatttcactttaactatcagaaatttggcttccgaattgatatgtattgttaaaaactatacattgggctgggcgtggtggctcacacctaatcccagcactttgggtggccaaggagggtggatcacttgaggtcaggagtttgagaccagcctggccaacatggtgaaaccccgtctctactaaaaatacaaaaaattgttgggtgtggtggcagctgtctataagcccaactactcgggaggctgaggcaggagaatcgcttgaacctgggaggcggagtttgcagtgagctgagatcgcgccattgcactccagcctgggtgacaagagcaagattctgtctcaagaaaaaaaacaaaaaaaacaaaaaatttcccagccaaagtgttagcaagctgaatctagcaacatataaaatggattaaacaccatgatcaagtggaatttatcccaggaatgcaaggttggtttagtacctaaaaattgattaatataatattacatatttatagaataaagaacgaaaaatatgatcatcccagatagagaataaaacttttgaaagactcaaacattcattaatgatgaaaactctcaacaaactaggaatagaaggtaatttcctcaacctaataaagagaatccaaaaacctatctgaatagacaccttacccaagaagatatacaaatgctaataagcacatgaaaaggtactcaatagtagtagttattaaagaaatgcaaattaaatccataaggagataacatattatgcccactagcatagctgtaattaacatgaaggacagtaaaaagcactggtgaggatgtggaaaacctggaatacttatgcatcgatggtggcaaggtaaaatgcaactactttggaaaacagtgtggcagttgtttttttgagatggagtctcgctttgtcacccaggctggagtgcagtggctcactgcaagctccgcctcccgggttcacgccattctcctgcctcagcctcccgagtagctgggactacaggcacccgccaccacacccggctaattttttgtatttttagtagagacagcgtttcaccctgttagctaggatggtctccatctcctgacctggtgatctgcccgcctcggcttcccagagtgctgggattacaggcgtgagccaccgtgcccggccgtggcagttttttttttaataaaaaagttaaacttaacattcatctcagttcctcctaggtatccacagaagagaagtgaaaatatttgtccacacaaagacttgtacatgagtgttcattgcagcattattcataatgttagccaaaaattggaaacaattccaaatgcctagccacccttgaatggatgaacaaaatgtggtgtatccattcagtgcaatgctatttaatatttggtagaaaaagaaagaacttctgggataaaccacaacatggatgaattccaagaacattatgttaagtgaaaggattcagactcaaaacaactacatgtatgatttcggttatttgaactgtccagaaaaggcaaataatatatagagatggaaagcaggtggctgggcacggtggcacacgcctgtaatcccagcactttgggaggctgaggtgggtggatcacttgatgtcaggagttcgggatcagcctggccaacatggtgaaaccccacctctgctaaaaatacgaaattagctgagtgctgtggtgcatgcctgtgatcccagttactcgggaggctgaggcaggagaatcgtttgaacctgggaggcagaggttgcagtgagccaagatcgtgcccctgcactccagcctgggcaacagagtgagactccatttcaaaaaaaaaaaaaaaaaaagcagggtagtggtttgtctggggatggggattgattgcacacggatgggagagatctctgtaggatgatagaaatattctaaggtgggattttggtgatggttgcacaactctataaatttattaaaatgaattatactcttataatgggtggattttatgttatgtaaatgtacctcaaccaagctgttggaaaaataagacgttattttatgggaaattttcagaattttctaaattgagtcttatttgatagattagtctgtaaaagaacttaaattgtgaattatgatatatctgagcatttaaacattttcactctttggcctcttcatacatacacatgcacacacagacacaactgtgtgtaaactgagtacacaaggttatttctactgttgcatctatgctgtcagaacttggtctcactatgtttttagttttgatattcattaaaatgtaatttctttagtgtacagtgtcttaaagacttgttaatatgtttatgtcttttgattagattttatactttctagaaaagttcccaaataataatgctgaaagctgaaatttcagaagaaaaaatgattttaaatatatatggcagactaatcacctatccattctccttttagtagaactcctatgttattggatattggggtttaaaaagtacatttttctgccttctttacaggtagtggtggcagatgagcagaagacatgggttgggcttctggtaaagctcttaaagggtgacacaccattttacccttgtttattccttcttttctgttcactgggattggatgagatgtatgtagctactgtaccagatatcttgcaacttgaagtgaccttcagaagctaagaggagagacatagtagtggcctgggtccttgtgaccataactgcccctggaactgctttacttctattcttcttgtatgtaagagaaaaatagacttctatcattttttaagctgttatttggggtctctgtttataagcagccagtttctgatataccgttcttacctacctgtatgaggggttgttctttaagtaatttttctattaaaattttttatgtaaaagcaaagaaaaagtaaatttaaaaacattagaagaaaaccacttttgatatttttgtctatagaatttcaggtttttaatcttcatatatcttttttattggcctcagtaactgctcatactgttaactgcacctaaaatttcttttgactccttatgtgagttgtgagtacagtatgtaaactgcttttttgttttttattgtagtaaaatatacataatgtaaaatttaccattttaactgctttaaagtataaaaaccagtgacactaagtacattcacaacattgtgcaaccatcttcattattcatttctaatacttttccgtcatcccaaacagaaactctgcaccgattaaacaacttaccgttctttcctccccaccagctcctggtaacctctcatctactttccttttttttttttttttttgagacagaatctcgctctgttgccccggctggaatgtagtggtgcaatctctgctcactgcagcctctgcctcccaggttcaagtcattcttgtgcctcagcctccccagtagctgggatttacaggcgagtgccaccacacccggctaatttttgtatttttagtggagacaggtcttcgtttgacaggctggtctcgaactcctggcctcaagtgatctgcctgccttggcttcccaaagtgctggtattacaggtgtgagccactgcatccagcccctctaatctacttgcttactcttgaatttgcctgttataagcactagatataaatggagtcatataatatttgcccttttgtgtctggcttatttcacttgtcttcataatgtcttcaggtttcattcatgttgtagtatatctcaaattttcattcttttttaaggctgaataatattccattgcgtgtatataccacttttatttatccgtttatctatttttggacatttaggttttcagctttggctattgtgaataatgctgctatgaccattggtatacaagtatctgtttgagcccctgctttcaattcttttaggtatatacctagaggaagaattgctggatcatatagtaattctatatttaacttcctttgtttttgagacagagtcttcctctcttgcccaggctggagttgagtggcatgatcataacttgctgcagccccaaactcccaggctcaagcagtcctcctgcctcagactcccaagtagctgggattatagatgtgcgccatcatgcctggctaattttttaaaaaaatttttgtagagaaagggtcacaatttgttgcccaggcagtatttaactttttgaggaaccaccaaattgtttttcatagctgctgtgccattttacattcctaccagcaatgtacaagagttctaatttctccacatcctcgtcagtacttagtttttactttttttttttttttatgatagctatcctaataggtgagaggtagtaactgttgtggttttgatttgcatttccctagtgactactgttattgagcatcttttcatgtgggttattggtcatttgtcttctttggtgaaatgtctgttgaagtcctttgtccacttttaattggatttttttgttgttggttgtaggagttattcatatattctggatattaatctatcagatatataattagcaaatattttctcccattctgtgggttgtttatttactctcttactagtgtcctttgatgcacaaaaggttttcattttgatgaggtccaatttattatttttttcttttttttgcctgtacctctgtcatatcaaaaaatcatcaccaaatctaatatcatgaagttttttcccatatattttcttctaagagttgtatagttttaactcctatgttagtccttgatctatttttaagtcaatttatatatatgatgtgaggcgtcaaagaaaagtagagcctgacagtagttaaagcagtaaaagcaaattttaatcaggaacagttgcagtaggagaaaagagacttcgttacagaatgaagcttaattctgaatacaacatggaaagtggagatttatagccaaggaacagggtcagtggatggaagattagaggaaacatcagagttaagggggtctctggtgaaaccaatttgacaaggtttttgccaaaggcaggccaaggtaatcaggtatcgcctgggggttggtggggaatgaggaatttggtcagatatattgagggtgatcggatatcaatggtagggtttctggcttaactctcttagcagaattcttgctaaaattggacgatgcaaaggaggagatagaagttcaaaggttgaggcctagctgtgaagatggtttagaggagcctgactagagtttagtcaaggagacagtctttgttaaaggtaagggttcaattttattcttttgcatgcagatatccagttttcctggcaccgtctgctgaaaaggctgtttttgaatacacatattatctcatgtaatctttaaaacagccctacttagtaaggcattttttccccattttacaaatgaggaaattgaatttcagagacttgcccagtctcagaaaactaacaacttgtggagcttatctgttaggctcaaagatcataactgttattttgtaattgtttcttactatttaaatgttacctattcttaaaggcccagcccaaatttaatcccattattaaagattttctccattgcttgctcttccaatcagatatgactgctctcaattccatggcaaatttttaatagattcttaatttatagtacaccgcaaatggtatgtgctgaatacatgccaagtgagtaaatgatagaattatcattcagaataatctaactggtctccataccatcgtaaactatgagttgaaaggatggaagtaatcagggaaaaatgtaattctacattttgcttgagaaaatcatttgcacaaatataaaacggggagatctggtttgacttcagtaaagatgaacactcaggttttagttgtttacatgctgaattaggccaacagcattatgcatctgcttttaaaattcaactctaatttgcattaataaacatagaaacagagagtgacttgatcacagaaaatgagaaatttaatgcaatctccatcaatgtattataaacactcctggtaccacacttaaggaggaatattaacaaactgaatttttttttaaggggagctacaaatacagtagggtttctgggaatcttgcccaaaaagaagaacacatttagtctgaaaaggaaaggctaaggaaatatgtgatcactgacttcaaatattagacttaagaaatatattttaaaactttttatgtataatttttcattttgaaataattttaggcttaacaaaaggtggcaaaaataatacagttctcatatacctttcacctggctttctcagatgtaaccttaataaattgataaaaaccaggacattaacactgttacagtgttatctacagatgttattcagattttccagctgtcccattaacatccttttcctggtgcagaatcacacatttagttgttttatctcatttatgtccactctgggacagttcctcagtctttcttgaccttgacacttttggagaatattggacagttatattttaaagtgtcccacagtttgggtttgtctaatatttcctcatgattaaattcaaactatgcatgtttgttataaatactatggaagtggtgtgcccttttcagtgtattgtatcaggaggcacatgatatccatatatctcatcacagatgatgttaactttgatcatttggttaagtgtctgccaggtttctccaccgtaaaattactattttctctttgttaatttctttgtaggaaattacttcttaatggacagaactaggaaatatatgtgtgtatatgtgtatatagtttgttcaatatctggattttgtgcctgtttttgttcactgccatttctagcacttgtttagccctgtggtcagtagatatttgtagctaataatatagaatagtgtaaagttagactagataacctaaggactttccagccccgcaactctgttaatgttttgattctggaaaaataagctggggaacaagacaaaaataaactctgaacaggattcataataagcagaatgcaaaagtcataggacttttgactgcaaaagtcataggagcagacatatgcagttttgacatatgactgcaaaagtcataggagcagaaagctttgattattatcaaaaacaatgaaggtgtcaaaggcctggaacaaagtttgctgtgggtaggtaagaaagagaagcttgataatcgttttatccattgtaccttagccggattgacttgcagaaggtaaagccatggtgaaaaaaaaaaaaagaaaaattataaataaggatatctcctttacaggtattctgtctttagtttactttccattatttcttactttatccaggtagaccagatccaagtacatgtattcccactgtaaaaccatatatggcttcatattctgcaaagtcacaccctaaaaataacagtacctatgggaaaaatagggttgaggtacagcgttcaaaatctgtggaaccttataagcactcatgaaaataataatactttaaaaaatcaattaaatctcctctagcattttaacctggcatcatagttcttaaaatcctttaaacccttgttctcatgcttccttatttgggatatagattctttagatcagttgaataaaaatacatatgattcagataagagcccttttgaaaatgaaggaaatgtctttgcagcttcttgagctgcactcagagattgatcagatagctttacatagtagaaaccatagaagttcttgaagccacaaaaccagctactacttatattaatagaaggcacgtctaatagatttctagctggttttttttaaaagatcttcatattttactaaggttttgtctttaattgcaagaaaacttatcttggatcattaaaaaaaaatgaatgtgccaggggaaaaaaaaatcaagtcgaacttacatacctaactctgcattataagaatatcattccgctgtttactaattgtatataagatcattcaaattaaaaaagtcatagaggtaattaatctgtaataatctgagtaaccgattacacctcagtgacagtgtgtttagccagagtcggtatttcctatatatgtattttttatagccttagatgtttctgataacattgtataaacatatcacttactgaatttacagactctgaataaatggtggcttcatgatacagtttttaaaagtatttttaccttaggattcttgggtcttgtatcagctcttgtgggaagtttgtgtatgtttccagtcttttccctctttttcctgtgactcattctacttcttcatctactttagtagtcactagcactgccaggttttgtggaatctttgacagaaatgtaggattcctgccttttacatacaggaaataatttgatagtattggaagacaaaatgtaatcaactgatagactgccacatgttgtctgtaaatactaggcctgtgtgtgctattccctagcattgtctggctttactgaaagcacttcaagcttaagaaattgctgacccctgtcttactaggttctgagccaatcttttcacttgctaatcgactttcccactttactgaaaggagaggctttcaaattctatactttatcagtgtattagttctacaaaatgttgcttcaagaaataatggaaattcttaaagagtttgcatgttgttgcatgtttctctctccctctgttcaaatttccctcttgatggagatgtgcttctgggtgactggttgccaggaacttttatgttcataagtactttttgaatattgtattacctatttaaaaagttaagaaaaatctatatatatttggatgatgaggaatgagatagatggaagaacttgtgaggagtgaaagagctttaggaagagaaactattgaagcttatctaaattacaaaataagtcaaatgctcctatataaaaaacagacattcttattgttaaaaaactttttgctgttaaatatcatctaaatattggtttgatgtacaaatgtagaaaaatatcttgggcatagattttttttcccttgtcactttgaaaagaaatttacttattatttttctgtaggtttttcaaagaatttttatattagacaatcacatcagctttccaaaagagagaaaacactgattaggaaccctcactatccaggtggggaagtggggatttaaaataatataatgttcatatgcagggttgcactataacataagcctcctgactcttaacttaaatatgtattggatgtgttaagatgtttttcttttatttaatgtgaaaaaagcttaataattgactgttggcgcctgggcatgtatattttggtcccctgcactgggaatcaattctaaactcaagttcaaaattggcttctggaattagggtgttcagcctataaatagagagatatctgtacttctttaagccacacaagtcttttcttgggtttagttagtaattactactttgggaaattatttctcctttagagttgttattttgattcatattttagttcacgtggatgtctacaaaataaggagtaaattcttgaagaaaacctgctaatagttgttttatagaaactgagctttgtagattaattagactatctaaattgcagcttttagctacataataaaagtttacttgcatagtcattttgtgtgtgtgtgtgtgtttttttcatttcttaagtgtggtagttttctttttaaaaaattgctaagataaggtcttgaatgttgttctggtatttaagtactgagtcctaggattctacttttgtgtttgtgagaattgccgggagagtaagaggccagcagtgtgagtgtccaccatgttctctacctacgtacaaagaagccttagtatgctctgactcattgatgagagcaaattggagactgtcactgctttttgcttctgttgcttaccattggccccattgcccctttactgatgctacttgttttgattggttgcttttgcaatgtttgtgctgttgttgttacggaagaaaagagaaataggggagcctagtgggtgggccggcggcattcaagaagacttagagaaaggcagaagctgcagtgtttgtctcttcctccactgattttaacatggccacaggagtcattaaacatagcctctgtagcataaggaaggcagaattctctagctcgtttgcgttttgttgcttagtgggaagagctgagaaaaaaaacagaactggaaaacatcgcttactcctaaaatgcaagggtaaccttttcagacttctgttgatttttgatgggttaagaaatacagtatgtacatattccttttaactctcccccactaatatggtctgttggcattttcctattatttgactagcgtcttaggaattattactacaaagattcagtgacaaataactggccagaagaagatgtggcatgtaatttcagatgacagtgggatgatgttggtactttcaggacctgtgggtagtagggaaaagacagtgtaacagttaataaatgtttgtatggattgccttagtttacgactgaacaatcacatgcttttattattggccctacctcatagaatcaaagccttttacatatgccaacattttacaatatgttcattaccaaatgttgcatgcctggttggtatatacttttctagattttgtaggctatgtaaaaatttgatcctggttctcaaatatggataaagaagatacatgactgtattttggaatcaggaagatgaatacagtttccagcaataaatctattactgtcttttgaaaaaaaatcttattgtatggtccttcaagattcaaagtttctcttaaaagtaataaactgtaatatagataaagctgcttatgcagcagctaatttatggacctcttcagtgcattttaagatttccctattatatttttgcccatctaaatatgttactctttccctaattttcccataatttatctagaagaaacttgaggtgaatctaactttttaaaaaaacctttaggccaaaaaagttgaatagtaatcaattcatagtttaatgaaggacatgtgtagtttgagtttctggataacctctcttcctttgaaagtgtttcttaattaaaaccagatgagagcagcaaagaaggtattcagaacactaagtaaaattaatgtgcttcatggaatttgcagaattcatcaatacatgtaacaatgatttataattgcatttggtcctaacacttatcagtgtagatctaacagagggacagtaagtaagatagctagtatgaaacactaaggtgaaagggttaattggccttgcacagttcaatttgccactctagtggcactttctattgtctgtgtaaacagagttgctaagtactttcccgctaagctgccacccttttatttatacagttgaaccaccaatgaggaatggatcagtttaccagttgttaggccttttcttcctgccttttcagcccacttcatgttttttcccccagctattgctatatacctccctaataattccttagtctgtgattttggtctctctctctcactctctttctcatttatttatttatttatttattgcagcttatttttttctcatattcattgatttgagcattgggatattaataacctggttctactcctttatacctcatttcttctcgcctctactcccattttaccaagtaaattctcagaacttgctgcaactctttcaaataactattttaaagtaacatttaaatagctcttcaaaaatgaaaacattacatatataatgctgaagtcctctttaaccagcctatactgtatgagtacccctagtccactgtgagttaatatattaaaatatatacttccataccattttcataattttatatctgtgtatatatattcataaacataatatgatattgttagaaatttacataaatgatattctgggaacattttttcttgtttttttcaccctgcattgtatttttaagatgtatacatattacataagaagtatacatattacattacatagagaaatctactttaaaccattaattacttcataatattacattgtattttgcagttatctacctattaatgaatatgtaagtaacatcgttttttctccattttaaacaatatcacagtgaacaaccttataaatgttgtcttgtatatattgctacaggtttttagagcagtgttttccaaacagcaggtaacgaaggcagtgtagtaagttggagtctgtacttttcagaatagaatgcagtacaaagtgtcagggtaaaaggtacttactttttcatgaaatatatgtaattgtgttctgagttgtgatataaaatgtatttcctactgtaggtttcaataaaaaagtttatggtgtgatacaaaataaattttgtgctgtgtatcttaatcataaattttgtgctgtgcatcttaatcggctctggattatgtacccagaatgggttagctgcatcacgggttacatagtattttgaatcttcctagacatagcaaaattactttccaaaatggccgtactgatttcactccccataccctaatcggtatttgacattctagtcagacttctacatttcctatgttcttgagggtgaaaattccattttgtttaaattttcattttaactggttaggttgagcctaacttcctcattactgaaaagaaaagtgttaagacctatctggttggtaggttactattgaaaatcatatttcttttcctttttttcttttttcttttttttttttttgagacgggtctcactcgattgcccaggctggagtacagtggcgtgatctcggctcactgcaacctctgcctcccaagttcaagtgattctcctgcctcagcctcccaagtagctgggattgcaggcacgcacctccaggtccggccgattttgtatttttagtagagatggggttacaccatgttgcccagtctggtctcgaactcctgacctcaggcgatccaccctcctcggcctcccagagtgctaggattacaggtgtgagccaccgcacctggccaaaaatcatatttcaagctagagaaactttcatctccagatcttttctaacacttcttttttctttttttcttttttttttttaagtagtgagcataaaactatgcagccttagtaaataattaccaaaaataattttgttaactatgcacattcaggtttttcacacatttgttttgaaacacagttcttttacccaatatgattaacttcaggtacaactgcatatttgaggaatactgatacagctcatttcagcaatttagattcatttcagcaaaaagttatcattttcatctgttgtataagagaagatgggttctagccaagtgctaggaaatatttatccctttgctaggatcacaatagaacaatagagtcttggtatttaatagaacatttgaaaataattttaatctaatcattggttatgtaccttcagctggattttctctggtaatagaaatataggactttcttcatagacggccattttcattgttagtgtggttattaaaacttaacctaataactgtcagtttcattcattggtgctacatttgccttcaggagtcacataggaaagactgctgctgtaattatgacagttcaaatattggaagtaacaagttttcttctttggtcatagaaattttgatttttacagaattgataaaccagaatacacatcccataacagccctgttatttaggtaatgtaaatataaatatgtatttattaatttcatttctggatttattgcttccttaaggcttattcacaaattatcagtttttagtatttctttacttcagttaactatgtgatttataaagttgtaaacaaagctggaagctgatttgaaaaatggtgtcatattttgaagggcctttcagctttctattcttttgaatcaaagacattttattggaaaatattattgtatttaggttctctggttctattttcaacctgaaataccctattttcagtttcttggtgtagaacaggaaatatatcagcaactcctccagtagtagttagggcagaaatagttctgttttaaaaccagtgggtgatcatcagttcattttatgtgaatcatggctgtaacctcctaatcactcatttagaacaagtaatgttttatactggacaaataggaattatttataggaccgatttaacaaccagtgttactcttaagggaaaagtattagattaatttaacttgtagagtttattttatcttcaaggccaaatttttttcttatttaaattaattgcatgttcaaatatccttcaaactctgtttgtcttcaaatgtgataaagctgctgctaattttgagaagaaagttatattgttgcatttattttagatttaaatacatactcaagtagaaaatttatagattatatatcacttaaagctttaactatgaattcctcattaatattttttgtgtaatgtctttcttgatccctacctgaggcagtgctactcaaaatatggtctgtggactcatgctggtttgcagattgtttgttacttgtttgcaataaaataagtatggaaattgagaataaacatttagaaaattttatagcaattttacatggtaattgcatgcctatggaatctaataacaatatttggagttatattttatatgtctttgttttgtaatttcattcttttagtaatttatgttatattttacaaaagtccccttgaaagcaaaacaaagactaggtcacactccatatcagtaaaccactacagtagaatgtagtttttaattttatgcagatatatacaaaataaagaggataaaggaaaagtggggtgagagagggtgagcttaaattatagagtccaatttttgagtttttctgagaattggaaatttcttacatatttgaaatctgtttacatgacacattcaatcatgttttctcttaatatcctccagttattccatcagttgtaataccatgaaggctgagctaaaagtcttaagtttagaaaatgatttagttatctttaatgtcatatattcatatttgtaccatttgctctttagttttaatgacagttttagcagaagtaatttgaattatgatgtcaaacttctcatttcagaatattttcaaaataagttttagaagagtttctgacatgagcagaaatttgttgtgacaaattattatttttttaaagtacagcatattttatgtttctcaaaggaaggagcttaaaaaattgtccctgtttttcatgtatcatttattctaagcaagtatttcttactaaaagattcttcaaattctgttttcagttgcttttttgatttctcataggacttaaaacttctcttaagttggtcattataaatacataacaaagagaagaataagatatgtctctttgtaatgattttaacttctaaaggtaaaatatgttaagataaacaattcgttacttgacataaatagaagatatctaaataattatttatttcattgccagctattactgaattgttgatcagccaaatctaatgttaaaagggaactattcactagcagtcattggtttcctaaatatctctagagaaattataagttcaaaggtgttatgctacatgtaagattagatagttattatatatactcatatatacttatgtgtccagtgtcatatcaggaaaaactaaaatactattttattcagtatggtataaaagtttagaaaccaaaaaaaaatgttaaaagatacttatgtaaggtgattgatgtattaattagcttgattgcggtgactatttcatagtgtatacatatatcagatcatcaagtagtataacttaaatatatgcagtatttaactgtcaactagacctcaataaggagggggaaagtttagaaggtatatttcaaaactatcagatggaataaaaggcatgtaagagattagaaatatagaaaaattagggtatgattaaagaactctttggctaacaatttgatcttttttttcataccataatcagagaacatactaactatgcctgagaaaataatttcaggaatatttttgtgggagtagcacagcatgcatcaagtcaactctgtattccattatggtccatgtctgaaaataaatctttggtctatcacctttagatagagatgctgacctgggaaagagtttgtcaaggtctacaaaggaaaacattcattatagaaggacagtaacaaatatttgaacaggattgcaagtattttctcccctcttgataaatttcaaatccttaatttaaaaatgtttattagcctgtcttgtaactgagaatttcctgcttctatttggtttctggttccagtgctatttttaaattttttggtttttttaaagtcatattttaatacctgttaagaaatgtggaatctttgttgttttctactgttgacctcctttaacaacttaggacaagatgaaaatgagagtattaatttattagataattcagctttcagaatgatacaatttggaaggacacagagaatttaccaaatgtatagtgttcgttccacttttattagatagtacaaaattatgttaatataaatctgaattacattatttttaactttgtgtttgtaataattttttccagtcaagaaaacttagaaacaccaaaatgctgagtagtgagaaatgctaatacaaataaattgttaaaaggttaatttaagaaagtaacttaaatacttgaaacatttttagttctcagtcttacaaactatatgtaggttaaggtgtaaagaaaatcaggaactgaataaattggaaactcagcagataaatatactttatgaatctgaaaaaattgggaaagtgccaagtgacaaaatgggttaatcaccacatttccatcctacataatgcataaactcatggtcagaagatggggttgggggtgggaatatgatttcattgatgttatattcttgagatataataccaatcataaggtgctgtatagtgaatcatagagtaatcactgttcctgctattcatagttggctgaaccattattttatgtactacttaaaaagaaaacatactgccaatgctttttaaaatttagaatttttatatttgttaaaataaccctatcggaattactaagacatagattatattatttataacgcttgtacatacctgaaaatgaaaatacattgtgaaatcaactggctaaggaattgctaacattctttacactcagagtccgactcatttgaatcactttttgactcagtcattggtgttcagtttttctacatgcagtctttctctatgcagtatttctgaagagaatcaagaaccactggtgctgaattcgtaagccactttgcaattatgatgagttaatttattttttatacctattttggaaatgttgctaaatatgtctgatatcccccgccctcatcctctcttcacagtcgtttggattttaggagttaaaggattattccaactctttgtccctaggattttcctccttttttttttttttttttttgaaatggagtctcgctctattgcccaggttggcgtacagtggtgcaatcttggttcactgcaacctctgcctcccgggttcaagcaattatcctgcctcagcctcctgagtagctgggattacaggcatgtgctgcaacacccacctaatttttaaatttttagtagatacggggtttcaccatgttggccaggctggtctcgaattcctgacctcaagtgatccgtccacctcagcctggcccaaagtgctgggattacaggcatgagccactgtgcccaggctcctaggattttcttccaactcaaatactacaggttttgtgcacaaacagggaatgacagctgccttgttattgccacttattattgctgcagcagcgtttgtaatatgccatcaatttcaagatatgttggctgggtgtggtggctcacccctgtaatcccagcactttgcagggcctaggtgggcagatcacgaggtcaggagattgagaccatcctggctaacacggtgaaaccctgtctctactaaaaatacaaaaaattagccgggcgtggtggcggatgcttgtagtctcagctacttgggaggctgaggcaggagaatggcgtgaacctgggaggcagagcttgcagtgagccgagatcgtcgtgccactgcactccagcctgggtgacagagtgagactccgtctcaaaaaagaaaaaaaaaaaaaagatatgtcatgaatttagagaatttaaagtatggagaaaatactcacttttaaagcatagtggctaggaactcaaagttgggttgccgtaataccaattttacgatcttgggtaacataaggtctctaatccttagttttctcacctatgagataagaagcccttatcttataaggtgattgtgaggtttcaatgaaattatatatgtaaaatacactgcttaacaaatgttagctaatagtttatattaggctttatagcagtgtacttttattgttgaactccttatgtattcttttacttgtttaatccttttactttgagaaagtggtaacttgtagagaggaaaagatactgataaatgtaaataatccattgcaaatggctgagtgaaaatcctggaaaatgttttaattgaactttattgatgtaatataaaactattcaaatatctgtcaataaagggtaggattgtatgaaggctcattttagaaacttgagactaagtgactgatctattattttagaagttaataagttgtatagatatatggctgtcaagctggaaacaacatgtactaactttccttgaacgttggtatggcctctgaggttttggcagtggattgtgaatagaagtcatgtgtgacacctttgtgttttgccttaaaaagcaatacatgagtactgccccctacctgtgtcctcttcttgtgtactgataattgatgaaaactcgagtccgcagaatttggacccagagattgaagtatgtgttgacctgcctcaccagctctacacagcttatttctagactattacttgagaaggaaatcattttctatcatatttaagccatgtattttaggatctctttgttacagggtcttagcctatatcctaactgataccttttaaagaacagccaaacagatttaaaaggaaccaaatagtacttctaaatatgaaaaagggaattgaaataaaaactcaatgggtaaatagggatgcctagagaaatggttggttggttccaggtctgggacaggaaaaacagaggatgatcctagaacactgtggtgcaagaaagtaaggaagtgcttaaaagaatattgcttggcaatttaaaaaaagggaagaactgatacatgtgatggtatggatgaacctcaaaaacattgtgctaaatgaaacagccagacacataagactgcatattgtatgaaatttctagaaaaggtaaaactaaagacacagaaagtaaatcaatgtttgcctgcagttgggtattggaaccgggattgactgcagatagacattatagaacttttggagtgatgaaagtattctaaaactggattgtgatgaacgttgcacagctaaatacatttgttaaaagttgtacacttaaaataggtgaattgtgtgtaaattatatttcagtaagactgtaaaaaattttgagagatactgtaaaaaaaaaaaaaaaagaagaagaagaagaaaaaggtgggcaaggccgggtgcagtggctcacaacctataatcccagcactttgggaggccgaggcaggtggatcacctaaggtcaggagttcgagaccagcctgggcaacgtggtgaaatgctgtatctacccaaaatacaaaatatgagctgggtgtggtggcacgtgcctgtaatcccagctactcgggaggctgaggcaggagaattgtttgaatccaggaggcggaagttgcagtgagccaagatcgcgccattgcactccagcctgggcaacaagtgtaaaactccacctcaaaaaaaaaaaaaaagaagaagaagaaagaggtgggcaaaagaactcagtagttagcttggaggatctctcagtggccaaatctgggacaacttagataacagaatgacgatagtaagggattttaacctgtaggataaaataaatatccatgaatttatacctacataaataaataaccaaacaagtaggggagaaggcacagctttttttttaacagtagaatcccagttaacaaaggttaagactgatgatgataaaaaaaaaaatcaccactagataaacaccccagcatttactgttacagacaagaattatcaatggatgctcaaattagttggtaaaagtatgcccagaatacttagtaagtattcccacagaataagtattaattatatagggaaaaatggtaacttcatagggaagaaacttggcaaataccactttaaccaagtgaacagtgttagtattaccagtaagaacatatatcagcatatttacccccaataggatgcacagagatgggtacaatataacttacatggttgtcttgaccccaaaaaagcgtaacctaaatttaatcatgagaaaatgtcaggcaaacccaaactatgggacatttcacaactaactcactggtactctttagaagtgtcaagatcaagaaacacaagaaagactgaagaactgtcacaaattggaagtatccacagagatctgaaaaccaaatgcagtgatcttagacaaagtctctagataatagtgttacaggaaaggggtacctgatccagaccccatgagagggttcttggatcttgtgcaagaaagaattcagggcgagtctgcagtgcaaagttaaagcaagtttattaacaaagtaaagtggtgaaagtacagctactacataaacagagtaggacatttccaaaaataggaggaacgcgtccaccctaggtatatactcgtatatatggggaggtgtgttctgctacaagggtttgtgttaaagggttaattgtcttaattactatattttgcaaaattgatattattatctttaaagcaaaattaggaatgactttgttctccagatatcaggatatctggacactcccaagtctgagtttgtttagtaaacattgttaatttgttcccttaaatgtaaacatctagaggctaggaatgcctaattttctgggaatgcagcccagcaagtcccagcttcattttcctagccctcacttaaaatggagtcactctggttagaatgcctctgacagtagtattgcatcaatgtgagtttcctggttttagtacttgtagtatggttaagtttcaggaaagctgaggtaaggatatatggaaactgtactatattcacaatttttctgtaagtctaaaattatttcaaagtaagaagttttataaaatacaaaatagactagacagcagattagactcagctgaaaagagagttagtgaactgaaagagaaaacagaaaaaattatcttgaattatcttgagataacaaagagatgcagacatgagggactgagatatagaaaatgtgagagataaaagatatatctaattggagttatggaagttgtataatattaatagtaagaactaagaagtggcaagattgaaagatagtgactgagatatttttgagaattgttatacaatacagtattttcaagaagctaaatgaaccatcaacagaaacataataaaaatgcagaagagagggagaaatttttgaaaacagtcaaagagaaaagacagattatctacaaagaaattatagattgatgacttttccatagcagcagtgaagaaaaagagtgtattgtcttcagggcattgaggaaaataacctcaatactggaattctagaattctatgccaagtgaagctgcctttcaagaaaaagaacacaatgaagacagttcctgaaaaacaacaaaaacagaattaaaaaaaaaaaaaaaccaacagactttttctgaagcaaataccaaagactaaacttcagggagaaggaaaatgattagcagatgcaaagtttgagatgtaacgttgaatagtgaataaatataataatatatagataaatcctaagcaaacattgtatgagagaaatacttaatttgtaaagatggtaaataggataaaattaaaattttgaatctgggcatggtggctcatgcctgtaatcccagcactgtgggagaccaaggctggcagatggcttgtacccaggagttcaagaccagcctggacaacatggcaaaaccccttctaaaaatacaaaaaaattagccaggcatggtggcgtgtgcctgtagccccagctactggggaggctaaggtgggaggattgcttcagcccgggaggtggaggttgcagtgggccgagatcgtgccactgcactccatcctgagtgtcagagtgagaccctgtctaaaaaaaataaaataataaaataaaatttggggtagcaatggtatatgtttgatgagagtcatcagagttcaaatattctaaggtttttatatttttcagaaatataccatgtcttttcaaaaattttcttttcaaaaatttaccattaattaactttagacaactttgttaaatttaatatgcatttcaaattaactagagtagccactaaatagagcatatgacttccaaaaatgtgtggggagtaggggtggggaaagaatgccctaaggcctgtggtccctaagagtttaggaaaacaaataaacagaaaacactcattctaaaataaataaaggcagtaaataaataaagtcaagaaaggaaaggaaagaaatagaaacaaaaaagcaaaaagaccctgataaaataaataggtagaaaaaattcatgtatatcaataaacacattaaatggaaatgaataaaattatctaaagacaaaaattgagccaatgaaaaaataaatgacaaaattaatgtacgctgtttataagagacatacttaaaatacaaagacgcaaaaagatcagaagtcaagatatggaaataaattaatatggttggacccagtgagtacttagaagtaaggcatagactgcactactcagtagcacttccttttatgcataagtgttcataattatgtaaagcagatttttacataatagttttctttgtaaaccttccacaacttgttcaaaccttcagctttattctatctaacttaaaacaatcttttaaccctttaatctaggcaagaaaaatccacattttcatgcctttttataatcttttaccaaaagtatattctattttccttacacaccttgcatgtaaaactgttcttcagttatctcaagtaggtgttacagtgttaacgcttagcagcttttacttttggtgaaaaccttggtaagtttgggattcaaattatgtactgagcgtggagctaattctaaatagctgtactaattataaatagctgtagttagtgagacatatgcatatttctgtgtacttgtttttataaagtgtatttgattaaattgacttttacctgctatatgatattattctctttctttatggttatcaggaagaaccacaaagaaacgggttcttaggagcaagtaggatgttctttggtcacttgaacaaaactgaatgtctttcaaccaactgattgttcttcatgaaatactgaattaaatgagggaactgcttattctaattcttatatcagtttaaaccatattattttaaaacaagaaaacagaggataagttcctacagagaaaattacattagaaattagaaacctggttttcccgtttaattgttatatgatctttttcaatattttactttttctcatctgttaaaatgaatagggaaattttaaataatgtgcagggacagtaggaatgattttcaatgctaaatgcaacataacacacgaaaaaagtcaggccaggcatggtggagttcaagacccgcctgggcaacacggcaataacctgtctctacaaaaaaaaaaaaaaagaaaaagaaaaaaaattagctgagcgtggtggcatgcacctgtggtcccggctactcaggaggctgaggtggaaggatcatttgagcccaggaggtcagggctgcagtgaaccatgtgttggtgccactgcactccagcctgggtgacagagtgagataactgtctcaaaaaaaaaaaaaaaaaaaaaaagcaataaaatagcaagttttaattgcatcctagatggatagaatagaatttagagtttagagtaaaaatagagccatctccaattttgaagaagctttaagaagtggcaagtcttaataattggtcaaaagtcttatgttggaattttgaataaattactatacattaattcacaattatttattggttgcttactatgtgcctggcactgttttaggggcacagcattaaacaaaacagacaaaatgtctgcccttattgtgtttacattctagtggaagagaataagtgtaaataaaaaatatgtattatgtactagttacaattctatggagaaaaatacagcagagaagagggataggaagtgtggtgcaagagactgcagttttagataagggtagacaaaggactcctcactgagagggcaatatttgagcaaagacctgaaggagggaggatgtgagtaatgaagataagggggaggaccatttcaggcagaaggatcagcaaatgcagaggccatgatgatatgcccaaagtgttcagggaacatgagggaggcctgagtgtggagaaagttagaggaaaagtgatgggatatgagttcagagagataatgaggcgtcaggtcccagtgacttcagatgccatttaaaagactttggaggatgtgatgtgattgtaagaactttggctttaaaaaacaaaagtaaaatgtgtataacaaaaatttaccattttacccattttaagtatacaattcagtgctattaagtacaattataatgctgtgcaactattacctatccaaaatttccaaaattttctcatcactccaaacagaaactgtaccctttaagcaataaccacccttttccccttcccccacaccaacccctggtaacctccaatccactttctgtctctatggatttgcctattctagatatttcttataagtggaatcataacaatatttgtccttttgtatctggcttatttcacttagtataatgttttcaaggttcatctttgctgtagtgtgtgtcagtacctcaatcctttttatagataaatcatagccattgtatgtatatactgcattttgtttatccatttatctgttgatgaacatttgggttgctttcacctttggctattgtgaataatgctgctgtgaacgatgatgtacgagtatctgtttcagtttatgccttcagttcttttgggtatatacctagaaatggaattgccagatcatatggtaattcagtgtttaactttttgaggaactatcttactgtttttcacaagcagttgcactgttggagcccactaccaatgtataaaggctcaaatttctccacatcctcaaaaacacattattttcctttttaaaaattataatgattgtagttgtgaagtggtatatattgtggctttgatttgcatttccttaatggctaatgatggcatattttcatatacttcatggctattgtattatcttctgtggagaaatatctattaaaatcctttgcccatttttttgaaattttactttaagttctggaatgcatgtgcagaacgtgcaggtttcttacatatgtatacatgtgccacggtgcctttgcctattttttaattggattgtttgtctttttgttgttgagttgtaggagttctttatgtattctggatattaactccttaccagacatatgatttgcaaatatttttctccttctgtagttttcactgtttgtttggaggcagggtcttccctctgtcctctgggctggagtgcagcagtgcaactttggcttactgcagcctcaacctccagggctcaagtgatcctcccacttcagcctccaagtaccatgcttggctaatatctgtaatttttttgtcgggacaaggtctcactatgtgggccaggctggtctttaactcctgggctcaagtaatgctcctatctcagtctcctaaagtgctgtgataataggcacccggccttagttgtcactttcttgattgtttcctttaatgctgtttgttttctatatcttacatgtttttattcccgaattcttcaattactgcctgtttttgtatttagttgattttttaaatggtgtactattttgattctgttctttcctgttattttcttagtggttatctagattaaattaaactaggttgttacaagtttaagatgttaattgtaattcctaagataaccactaaggagtttggcttttgatctgagtaaaatggaaaaccattggaggcttttaactgcatctgttttttgttttaatctctatgctgtgctgaaaatagactgttaagagaaggtgccaggcaggggctgaagttgggagatacgttagattttgtaataatccaggcaaaaaatcatagtggcttggcccattgtggtaatggtaagggtgttagtattcagattctgagtatgcttttgatagtagacccaacaagacttattaatgaattgaatgtggactgtgagagaaagaggagtcaaaagtgacaccaaaatttttgggagatggagttacatttggagataacattacagattttaggagatctgtataaaatggatttctctcttcttttttttttttttgtttttgttttttttgagatggagtctccctctgtcgcctaggctgaagtgaagcggcactatcccggctcactgcaacctctgcctcccaggtccaagtgattctcctgccttggcctcccgggtagctgggactacaggcacctgccaccaagctcagctcatttttgtattttcagtagagacagagtttcaccattttggccaggctggtctcaaactcctgacctcaggtgatctgcatggcttcccaaagtgctgggatcacaggcatgagccacagtgcttggccggatttctcatcagtgttttaaaaatgtattccacattcaggagaaactaaaacatctcgaggatataatatgttcagtgtggctgggcgcagtagctcatacctgtactcctagcactttgggaggctgaggcaggcagatcacttgaggtcaggagttcaaaaccagcctggccaacatggtgaaaccccgtctctattaaaaatacaaaaaaaattagccgggcctggtggcagacacctgtaatcccagctactcaggaggctaaggcaagagaattgcttgaacccggaaggcagaggttgcagcaagccaaggtctcaccactgcatcctagcctaggtaaccgagcgagactccatctcagaaaaaaagaaaaaagttcagtatgttggatttcttggtgttttgttttcctgttaaactatcaggatatttagtggagttgaactagaaaggccaattcctcataccttccatgcattctgtactgagaaaccgggctgttgagagtaaagattgttaaatattaaaagagcataaactggtaaaaggaagagaaggaagggtaggaagtaaagaaggagaaggagctctgttatattcaaaatgttcttaccaaatgaacaaagcatgttaataacttttagaaagaagttcaacagcaaaatttttctgcaaaaaaaatagtgatttttttttctgccaaatctgacgtttaaatatatcagaaaaacctcatcccttccatttatatgaaatgcctagaaaaggcaaatctgggccaggcgcggtggctcactcctgtaatcccagcactttgggaggccgaggcaggtggatcacgaggtgaggagatcgagactgtcctggctaacacggtgaaaccccgtctctactaaaaatacgaaaaattagctgggcgtggtggcacgcactgtagtcctagctactgagaaggctgaggaaggagaatcgcttgagcccaggaggcggaggttgcagtgaccgagatcgcgccactgcactccagcctgggcaacagaacgagactccgtctcaaaaaaaaaaaaaaagacaaatctgtggagacaggtacaaggaatctttttgggttgatggaaatattctaaaactagattatcgtgatgttgcagaactatataaatgtactaaaaatcactaaacacttaaaacaggtgactcttatggtttgtaaattatacttaaataaagctgttaaaaatacataaataccagaaagaaagaaaaaaaccttcatttctcaatcatttggattaaaattttattagtattatatggagaaattttggttgaactttttaactccattatagttttagtttcaggtttctacttatatgtttctgttttaaaatagtatatatttaatacaatggtattctcaattatatgcttctaataaaaagccaaatccttggtaaaaccagtgttaggtagcatatcttatatgaaactgaatattacagtaaagcccagtagagaaatatgtgaatggacagaagcaggtattatgagcctgttttaatataagaaaggtattttgcttaataatagtacattaagtttgccgtcacttaatgtaccatcacttaaagaaagtggaacatttctacatgtacacatatatgaaagtaagcacatttttaaaaaaatattgagaagtatatgtaccaaactgatgataattacttctgttgagagaatgaggctttgaagaagaatgtatgtatttatttattcatgtgttacttgtgtaattgacagaaagcaaagtataaagagactaaataactgaaaaggaaaaaagatgagtaaagcctaaataatggccgtggtgatagagaagaaagtaaacacatgaaaaatgtttagttgccaatttgatatagtacagaactattgcaaagatcaaatatgaatgggtaagtagattatactaaattaactcagtggagctataacattacttgaccataaacataaacattactttattaaatttatgaagtaaaatggaaacttttatatatactgacaaaaggaaggtacaatataatatgtacaatttatttacagcagtaaaaacaaataggataatagaggaaaagaattaagatgacaatgaaagtattaatgataaagttaagtgaatagaggaggctttattcttccatgctttctttaaagggtttctgaataatcagaaataagaaacagtgctataatcagggattggcaaaatacatatggttaaagttattacaaagaattctggtcaggcgcagtggctcacacctgtaatcccagcactttgggaggccgaggcgggtggatcacgaggtcaggagttcaagaccagcctggccaagatggtgaaaccctgtctctactaaaaatacaaaaattagtcaggtgcggtggcgggtacctgtaatcccagttccttggggggctgaggcaggagaatcacttgaacccgggaggcggaggttgcagcgagccgagatcgctgcactgtagcctgggcgacagagcaaaactctgtctcaaaaaaaaaaaaaaaaatctagaaataagaattgtctgaaaagaaaaatttacacctacttgtgtgtgtgtgtgtgtgtgtgtgtgtgtgtgtgttatgtataaactgttggaggcttttaactgcatctgttttttgttttaatctggctgctgtgctgaaaatagactgttgaggcaaggtgccaggtagggtctgaagctgggagatatgttagattttgtaatgatccaggcaaaaaattatagtggcttggcccattgtggtaatgggagaggtgttttatatataaataaaaattatatttatataatttatatacatatgtttatatatgtacataaatatgtatttatatatgtatgtgtatttatgtgtatgtacataaatttatatgtgtatatataagcagcactcttgaaaataatacctctagtgtcctcttatttaatctattaactttcaaacctatggttaattaataatttttttctaattagacacagttatttttgtcatgatagtatgatgtaaatgtatttccgaaagtttatgtgttggaaacttaatccctaatgcaacagtgttgaggtgagacttttaaaaggtgattaggtcatgaaggctctaccctcatgaaagtgttagtgcagttatggtgggagatggttagttattggggtgggttcctggtaaaaggataagttcagccctcttcccttctttgtccctcgtgctctcttgccctctgtgttctgccatgggatgatgcagcgaaaggctcttgccagaagtgggccctttgactttggactcctcaacctccagagctgtaagaaataaatctctgttctttataaattacgcagtctcgggtattgttagagcatcacaatacaaagataatgagattggcctgtatatactgacatgaaaagaattcgaaggtaaaataagttttttctttaaattttttaaagtagtttttaagaatcaaggtattacatctacatattctgttacaacaatgcaaaacagatggacaaagacacatgaatttgttattttctatgttagcatgtgggagagaacataacacaatatgtgaaaatagcttactttataagcgtaagcatatggagatgctaatgtcaaaaagaaaatgcttttcctaaaatttggtttttaaaaaacttagtaaaaaacaaaatattgtttgataaaattttaataaaatacgatagattttaagtgttctcattacaagaaaagtatatgaggtaatgaaaatgttaattagctctatttagccatcctacaatgtatgcctgtttcaaaacatcatgtttataaatatatataatttttgttattagaaaaatgaatcaaaaggaaaaaatttaatataatacagaaatatgtaaagtaaaaggtgatattttcatcctttggccctcagtcccatttgtcagaggtaatactttaaaaaattttgatgaaatttctgtatacactgtatctccattatttccaagtttgcttacataaattttacctgaagaggtttgcccctcatataatttttaccttaaatagtaagatgtagagtgttactattctaaatcatctgtagatttaagaatttctatgttccagtaagtaagttaaaattggggaaaactaatttcaggtaaattgtttatcatttgttcctgcaatgttataacggattaaatttttattttatatcagtgattctgaactgggggctgttcccccctgcccagggacatttgacaatgtctggagacatttttggttattagaactggggggctgggagtgggtaatgctactggcatctggtggggtgctgccaaacatcctataatgcacagaacagcctcctacagcaaggaattacctggttcagaaatgtcaatagtgccaaggttgagaaaacctgacttaaaggaaaatggttaagagtgaggactaccctggcacactgctcgggttttgtatcatagccacactactaactgtgtgactgtgggtggttatttaacctctttgtgcccagtttcctcattatattataataatagtagtacctatcttacagggttgttgagaggctgtttaatacatttattatgtgataagcttagatttgtacctggtacatagtaggaatgttggctgctattgttttattgtttctcagtaaaaactaaaatctaaccaattatataacatcaaaaggatggccaattaataaagatatcttagtaatttgggggagtttctaaacatggttgttgagagttactaagttaactctatatttcagcctactatttcctatacaaactgtttttttaatatttgaaaaattacgtttggggcgatgctgcctctttgtagagcagtagcccttcgactgagatattatttcattggccttttctcctagattctgtagttgtagtttttgcctctttgaaagtttcagctcctgcaacatagtgttagatgcttattctgatctttcttcacttctaggctagtgaagacatttttgggaagtatcattatgactacatcctgagagtacaatgagagtgtctgatttatgaaatctaggttatttttagaggcaagagaaaatacttaatttagtcacatcataattttatttcctctttttataaagtattatagtgtactgtaaaattcattaatcccgagtaagtatttgtgtttctcatcgctattcctctcagtggagtaattcatgaactgtacttacattaaaacacataatttaactaaaggtttaattcaaaatatttttatatgccttgcaaatataaaaatgcccagaaaaaattttagattgagagacagtgtacagtgctattttctagaaacatatggcaacttttttatataatttgatttaaacaataaatagcaaaggttaaacagacaaacccatttattaaactaacaaaggaaagtgtgtaagtggtgaagaatacatagttggttttttttttcctcttcttttttttttttttttttttttttaaagttcagttttagttttttaccacttgatggcagtgatggagctagagctctaccctgagaaggttagggcaagaactcattatgaataacaaaagcgtaggtacaaaggaaatccctgacattttaatattattcacatttctaggtgatattacttatattgcaagtgacagtaatagggggaaaagcctctagatggagcttcagtactttctaagggaaaacatttcctgtatctttccaaatgcatattttatattattttacataatatattaaatccagaatggatttttacaaaataatatttaagggtgaatttatttcagatgtaattatggaaattaattcaccaaattacctaataatttgaaaaaatggctatttaagtatcttacatttttaaatcattattaatatttgttgaaaagtatgttaaactttgagtcaaacatttctatctagtataaatgatttgcatatctaacaagttagtaaaagatatttaataagaagtcaggtgcttaaaatcaatattgcactataattaaatctgaccatctatattattatgcctagtatcattcaacatttgagttcccaagagaacataactattactccaactcaattgcccaactaaaaaaattaaaaactaggaattttaatgtaaaataattttttaaagaatatatatgttctttagtaaatattcttactttcttcagtaatgttttccttttacagtcaagagagtctgttatcactatatattgaagggaagttgtcattattagtagaaatatgatgttaatgttcttagtgcactgttgattttagtgtctacttcttgaataataagaaaacttgaaacaagaacaataagttttctgagaatgaccctgtatggtgaatttaaaaaaagaaagaatagtgatttttcccagctggccttctcaggaggctgaggtgggaggattgcttgaacctaggagtttgagaccagcctgggcaatatgcgagaccctgtctttattatcgattgattgattgattgattgagacggagtcttgctctgtcacccaggctgaagtgcagtggcgcaatctcagctcactgcaagctctgcctcccagtttcaagtgattctcccacctcagcctaccgagtaactggaattacaggcgcacgccactatgcctggataatttttgtatttttttagtagagataggttttcaccatgttggctaggctagtcacgaactcccgaccccaggtgatcgcctgcgtctgcttcccaaagtgttgggattacaggcatgagccaccacgcctgcctgaccctgtctttaaaaaaacaaaaagaataggaagctttcttacttttctactagtacacaattacctaggttaattttgatgtctcataaagcattcagtgaagaaaaaaaagctattgttttaagttgtctgtttttatggactcaaaatattggaagccttgtaatctttggtttgaaattgacatgagataataattgttttatgttgaaaaaaggtataactgaaaaattatatgagaagcatgaaaagtagtttttgggggttttacttattttcagtttcatgaatgaatgttttatttattctctattgagacaaaaaccttactaaaacagagtagttgccagtaattttttataattacacttaacaataatgttggcaacagttgattttctatttggctaagcaaatatggtctaaattcatttcaggatgtatagtcagctaaatttgcagcataatttgcttgctaatcacctcagtagtaacagtctcccagaaagccatgtgttgctttatttgttccttatctaattaaattttttgggactttattaacaaagggacacatttcaagaacatcacataaatgttcaagcattcttttattaatactttctaaacttatataattgcattaaattagcttttaattgtgtaacaaagtgaacttgtaaaagtatggcctgtttctcaggggtaggaaaactccacattaaggaactattatgccactacaaatatttattagtggttaccttgtagtagtagttactaatgaaataaatttatttaaaatagttatgggtaagtttcgacttaatttgtaacttgagtctctctggacaaagggaaactgatattttccatttctgtgaagcacttgcactatgaaggaatggtttatatatcaagttaattttacattgttaaactttttttttttaagggaaaacgaataaagcacaaagctgttgtttgctatagaaacagtttaaactgtctttaatttggtaggagaaaaatttctctattttataatcatttaggttgccagattaagttttctgcttttttaaccagtatattggcattgtgtagtgtcatctgtagtattttaggcttgtctagattactttttttttttttgagatggatctcgctctgtcacccaggctggagtgcagtggcatgatctcagctcactgcaacctctgcctcccaggttcaagtgattctcctgcctcagcctccttagtagctgggattacaggtgcgtaccacaacgccctgctaatttttgcatttttagtagagacgtggtttcaccatgttggtcaggctggtctcgaactcctgactttgtgatccgcctgccttggcctcccaaagtgccacctcgcctggccatctagattacttttttttttaatctatctggcagcaatgccaagtctgaattaaagcatttctgcagcttctccatcggaactttctgctgtttctagcacttttatgttgtggagatggctgctttccttaagcctcgtgatccaacttctgctagcttccaacttttcttctgcagcttcctcaccctcttgtccttctcagaaatgaagagagttaggaccttgccctggattaggctctggctcaagggaatgttgtggttggttttatcttgtatccacaccactcacactttctccgtatgagcattaaggctttttcactttcttatcattcatgtgttcactggagtagcacttaatttccttcaagaacttttcctttacattcatacttgcctgtttggtgcaagaggcctagctgttggcctgtcctggctttcaacatgccttcctcactaaacttaatcatttctagcttttgacttaaagtgtgagatatgtgactcttccattcacttgagtacttagagatcactgtagggttattaattggcctaatttcaatattgttgtgtctcggagagcagggaggcccaaagagaaagagagagatgggggtacagctggtcgtcggatcagtcagaacacatacaacatttattgattaaatttaccaatttatatagacatggttcgtgactccccaaaataattacaatggtaatatcaaagatcactgatcataggtcactataacagaggtaataataatgaaaatgtttgaaatgttgcgagagttaccaaaatgtgatacagaaacaggaagggaatacatgctgttggaaaaatggcacccatacacttgattggctcaggattgccacaaaccttcaatttggaaaaagatacaatagccgcaacatgtagtaaagcacaataaagtgaggtggattgtgccactgcactccagcctgggcaacagagtgagaccctgtctcaaaaaaaaaaaagattctgtggatgactacatatttttgcatttgtagactaccacaggagaaaattatatgacatggaaaatttgactaagaacatttttagtacaggacactaatttaagcaaaaactgaagcaaatttgaatgaaatcaacccagttctaaacactggtcatcacgcaaaatgacacgccaataaatacgcaactagattaaaagtgtgctgtgattatattccatgaaatatcagtcctccttaactctcccaattaccaagttaactccaaaggtttcgaggactggtttacctagtttgtcaatagagggcaatcgcttattggccgggtgcggtggctcacacctgtaatcccaacatttcaggaggccaaggcgggcagatcacttgaggtcaagagttcgaaaccagcctgggcaacatggagaaaccctgtctctactaaaaatacaaaaattagccgggcatggtggcaggtgcctgtaatcccagctacttgggaggctgaaacacaagaatcacttgaactctggaggcagaggttgcagtgagccgagatcacaccactgcactctagcctgggcaacaaagcgagagactccatctcaaaaaaaaaaaaaaaaaaaaagaagaagggggtggggggagggggaagggcaagggagcaatcacttattgaagcatggatacttccaaatagaataggacataactctagttctggaaatgactcaaaatcatccaattggttaaaagcagagaacgataaactatacccaaatatatccaaaaattatttcaacaatttatttctggttctcataggtatgtaatgcgaaggaagaaaattgaaccctcattttaaaactggttaggtacagttatttcatttcctttcctggaatcttactttttttcctgtttttgtttgtttgttttgcattagtcagaaaacacttaacccaaatatacatacagatttttaaactttaactactgaagatgagcaaaagtttaaaaatattgcctccactgtaactgataaggtctgacttcctgctgggacagatacaatttgtttggctactcttctgaattaattaaatgagttttactggcatctctatcctagaaattctccaattgggagggagtgaagcatgaagctgagataagtggcaagcatttttaaaaagaggtacttttaacttgtcccaagctttttttgaaccttaactgggttcctaatgtccagtagtctcccgttatctgtaggggatacgttctaaaatcccaatggatggctgaaactatgttttttcctatatattcatatcttatgataaagttcaatttataaattaggcacaataagattaacaggaataataatagaacaattacaacaatatactataataaaagttacgtgaatatgatctctcttttgtctcaaaatgtcttaatattttcagactgcagttgaccatgggtaactgaaacctcagaaagttaaagcttggccaagggagcctgtgctatatactacaggttaccaaacacactctgcctggaattagaaatttccacattaatttcaataatactgacttgaagatttttgtgatattatatctaagtacttcttagattcaacattttatttactttgctcctaaaattattttgtgcaatgatttctggcattcttgcaaagtagtaaatatacagaaattcaaatattcatatttgataggtactttaacattcaagactgcaagttgggccaggcgtggtggctcatgcctgtaatcccagctacttgggaggctgaggcaggagaatcacttgaacccgggaggcagatattgcagtgagccaagattgtgccactgtactccagcctgggtgacagagtgaaactccatctcaaaaaaaaaaaaaaaaagactgcaaggaaggaaataaggactgattagtattaatacttttattatatcccatatttttgaatcatgacattagagaggtatctgagaaatcaaactatgtatttgccttgcttctttgtcatttctgcaaaggttgaatgataaattattagaaataatttgactacaattttggtcaaaagtcaaatgtaacaaatatactgaaataaaatatttcagttattttcagagataagaactatgaaacacttcctgagggataatgatcaggaaataataagcagctattacataataaaattcatctgaggaaacaaaagtcatatacaattcctggcttctggagctgctaaaattcatagaaaagatatgcagtatcaaattataacagactcttgaacaacagaggggttaggggtgccgatcccccagcacagtggaaagtccatgaatagcttttggctctgccaaaacgtaactactagtagcctaccactaacataaacaattaacacgttatatgtatcatatactgtattcttacaataaagaaaatgttattaagaaaatcataagagaaaatatacttactattcattaagtggaagtggatcatcataaagttcttcatctttgcatcttcttattgagtagactgagaggagaggctagtcttgctgcctcaaggatggcggaggcagaagaggtggaggaagtggaacgggagtcaggagaggcaggcatacttgtgtaacttttattgaaaaaaatctgaatataagtggacccttgcagatcaaactcctggtgttcaagggtcagctatgtgtattctgatatagatttttttaattacttgctaatttgcttcttaaattggcttctgtttctcaacatcatgcacaggacattttgcacatgacatcacatgacattttgcacatgacatcatgcacatgaaattttgttttactatgacagaataccacagactgggtaatttgtaaagaaaatatacttctttcttacagttctggagctggaaagtccaatatcaaggtgggagcatctggtgagggccttcatgctgcatcatcccatggcatgagagagagcaagagatgaaactggcaacaagcccttttatgccattaatccgttcatgagggtggagccctcatgacctaaacacctcccattaggttcctcctcccaacattgttgcattagggattaagtttccaacacatgctttcagggggacacattcaaaccatagcaggatcccattttattgatagatactacttttgatggatatttaggttgtttctaatttggggctattatgagcaaagtttctatgaacatcgttgtacatatcttttaataagcttatatatgcatttctgttgcgtatgtacttaggaatgaaattgccctatcattgctgggtttgtgtatgttcagctttagtagatactgccaaaccgttttcaaatggttatagtagtttatcctccctccagcagtgcattggtgttgcagttgctccacagccttaacatttgggactaattatcttttttataaaaataaaatatttataaagatacattatcttttatattttggccgttctggtaggtatgtagtggtatctcactttgactttaatttgctttttctctgtaattaaggaaattgaatactttttatatatttaatggccatttggatataaaatgtgtagagattataaaatatttttatgtgtatcagcactttgggaggctgaggcgggcagatcacgaggtcaggagattgagaccatcctggctaacacgatgaaaccccatctctactaaaaatataaatatttagttgggcgtggtggcacacacctgtagtcccagctactcaggaggctgaggaaggagaatcgcttgaaccagggaggtggagattgcagtgagctgagatcgcgccactgcactccagcctgggcaacagagcaaaaaaaaaaaaaaaaaaaaaagaggaaaagaaaggaatttgaattattttattcagcagttagtatgattttgattttgcatttatcacttctcaaattactaaattatcagttattttgtataaagttggaatttatgaagaaacactagtttggagagaaagggttaagttaaatgtagaattaatcactattgatcctcttttaaagaacagctgggcaaaattgtacaaactagcttaccagtcctatctccatttcatgtacatgtccatttttctctcactgtgacctttcagacacctctgatgaaggatgtaaaagatctctcttactatcaacttgtaccctcatgcctgttaattcaaagaattcctctctcaacttttattggccgtgacattttatatatggccaagatctataacatttatactcaaatactttcatcttacaaccaacctacagacttagacctacatgtatcctctcctttttcctgctaatggtgtcccctctttgaatgctggcttttctcccatattttggattctgtcccttactctaccccttcctgctctggaaacatactgtcagtgctgctatctgtcacctatatttaaagtcctctctcaactatatctttctcatcagtatttatgtagatatgtttctttaaaaagaaaagaaagtctctctcagccacgtatctttttccattcaacagccaaatttcttgaaaatttcccttcattttacaccactcttcttaggtatctgtacccattactctagcaaaacagctgttcccaggattcccagggattttcataatagctggtccagttgataacttttagtattcattttacctgacatcagcagtactgacaatgctgacattcttcaaagctcatttaagccttcatatattaccactcttctgtttttctttaagcaatatccttcatgcctatttgacttttcttcatataccaatggcttctacatttatatatgtctaatacaaactactactttgagtttcagacctatgtatccagatgcttaactggcagttccacttgactatttcaaaaacacctcctacttggcaagttcattgtcttctctggcctgcggattttcttccagtgttttcctatttctgcagatgttatcagtatccttgcttatgcaagtctgttactcacaagttgtctgtcatttacaaccttacccccaatctaattcatcaaaagttctcacaacattttttctttcctgtttattttttattttccagctttattgaggtataattgacaaaaacagtatatattaaggtgtacaacatgatttgactaataacatttttttacactcgattctttctcctttgcagattatccaagacaaattcactgccactcttccacagtattttaattctctctcccctgtgattatcctagacttatccaatctctcttacctgtgccatactgtgattgatacaattaggaagtcactgggaccaggaaactaccatgatcagttagccactgcagctgcagtgggaacttaaaacaatatataaatggaaagaattggtctgtcttccagagaattacaaaccatactatgaaaaacttaaaaattttccctgacaatctttgaagagaaagtcagtatggaatggaatattacatgtctatttatatggagataaggatacatccttaaaaggtgaattaatttcagagatgtaaagaaaagcatccagtattattctattacatttactggtttgcacttttattttgagaatttatcagtctttttacatgctgtaaaaatctgcttattaaaattggaggataatatgaaaaaaaaaaaacctttatgtgatgaaaacaatggattagtttcaacatttatttttccatgccagtgtcttttcctgttttgcatagtgttgaaagctaataactatgtttcccagatccacttgcagcaagtattctggatataaggtagatttggccaatgagatgtacttgtgtatgttttagaaggtggaaatgagatagaggccatgcttctgttgcttttgcttttccctttacagatatgggtgcctatccattttttttttttttgctgatgtggcatggatttgaaaccaacatttgcggttgaccacagccatctttctcactttcctgactatatgcagggtagaaacataacattgggaaattggactaggcagtttagcaatagcagtcactgaagcgtttaagagatcctgctttgggcaggggtactatgctctgggttgactttcaagggtagagctactgtgtttggaaaggagacagccaagaacaagattatctggcaggaaccacagcagaaagaagccctgtaaaggcaactggagctctgggattagggatcagtctgtgtctgaaaggaaataaatacacaacagtattaggtgaatgacagattgtaatgttccctgtgtcacatttagaaccagctgggctgagctttcagatgagttcatttgacattgctattggaaggtacagtaggcagaagcagaggaaaggaaggaaggtaaagcaaatatgtgaccattttccagataagaaagctgaggtttaagtaactactgaggcaccctctgtctggtatatttattttaattatgtttgctagggaattatctactttacttgcctttcaaaagaactagcttttttcccttttctgttttattaatttctgcattaatgtttacccgtttcttcttcctactttgttttggtgtattttaattgttctttttctgttttcttggcctgggtacttggttcattcatttttagtttgtcttgttagctgcatgcattttcctctgtgtagaatttcatttctcatagattttgatgtaaaatattttccctttcattaatttctaggctatttgtaatttaaacttttatttctgtcttgaaaaaaaaatttttttaacttgtcagttgctgaggtgtttaaaaatcatttttgtctctgatggttattttatttgattattatttttaaatgtagtctgtactatctctaagttttagaattaagacttcctttgtgaccagacttattgctcattttttaaatgaaccatgaatataggcttggtattgtatgcttatatttctttttctttctttctttttttttttttttttttgagatggagtctcgctctgtcgcccaggctggagtgcagtggcacaatctcggctcactacaagttccgcctcccaggttcatgccattctcctgcctcagcatcctgagtagctgggactactggcacacgccgccacacccggctaattttttgtgtttttagtagagacggcgtttcactgtgttagccaggaaggtctcgatctccttacctcgtgatctgcccgccttggcctcccaaagtgctgggattacaggtgtgagccaccgcgcccggccgcttatatttatcttatatatatcttatatttgtaaacataaacacctcaaagtgttttaaaaattattattcaaattctctataattttgcttattttttgtttacttactatgtcaactctggtaaaggtatattaaagtattctgctgtgattgtttttatcaagttctatttaggagttttgctgttatgtgaatgaatttggagtgtttagaacataagggtttatgactgttttaacttttcagtggattagaccttttatcattacttattaccactctttgtcctattacttgcttttgacctttaattcccattttccaatgttaatatcaacactattgcttttcttttgtttgcgtctgtttttcttcatctgtgttttctgcctttttggttttgtttcaaagttagtttgttgatcagttgtattttgataagggagctcagtatatgtatagttaatgagaaacaaatgcttgattttgtttttcctctcgtctgtagtatgtgttatacttcttaatttttcttttgttggcttagtaaaatttctattaatttggaaatttttatatgcttttctgttacatagtggttaccttctcatccttaaagatgataataaaacctatacttttctattaataaatctaaatcaaataacagcttttactttaccacttacttacccttcttggtctgcttcctcttctttttttcttttttgaaaattctaggccactattaggttgtctcttatggcatatttcttctgttttaagaatacctacagacacatatattacaaatcacaaatcataatacttttgtatttattgttcactatttatacttttttattatgaaaaacttaaaacaaacagtagtagagagaatagtttaatgaattcctatattaatcatcactcatttaataattatcattttcctatattatcctttttttgaaggattttaaaatgaatatcagacattatgacattttattcctgagtgcttcactgtgcatctctttagataaagagatattaaatacccaggatactattatcccatccaatataatgaataattccttaacagcgtctagtagcagtctttattcagatgtccctagttgtcacaaatctgcctttttactctggtttaatttgaatcaggggccatacaagttccatacatgacatttggttgttctatctgttttttttttttttttttttttttgagacagtgtcttgctctgtcgcccaggctggagtgtagtggcgcgatctcggctcactgcaagctctgcctaccgggttcccgccattctcctgcctcagcctcccgagtagctgggactacaggcacctgccaccacgcctggctaattttttttttttttttttttttttgtatttttagtagagacggagtttcaccgtgttagccaggatggtctcgatctcctgaccttgtgatccgcccgccttggcctcccaaagtgctgggattacaggcgtgagctaccgcgcctggccagttgttctgtctcttaaatctctttattataaaactgtctgtcctctctctctttctccccctgccattgacttgttaaagggacctccttttcaagataaatcagtggcaagatttagtctaagatctagttaccagattatagaaatgatgattttgttctgtggatagttggtctgatgttcctgccaactcaattcccccagtaattagatatcagaagcagctgtctcttgaagctgcagtcttttgtttatctatattttggagaacgcttacttttttaatcttatggagaggacagaggtgtatccaactcaaataaatgtgttattaatctaaatttatttagatactagtttaaaataggggacataatgtattcctaaaataaaggagcagaatacatccttctactgtgctcgaaattattttcttatttgtcaagaaatcattcttattgaccttgactctcaaagaataataaatgttctcttatcagcaaccaggatttggtatagattaaccttatcactggttagtatatatagtttaaggctaagaaaatcaattaaagttataatcttacataaatttgaatacatctctccaaaggcagttgactttaacagtgatctattatggagaaacccaaagcctctccctacttcttttgtaacatattggccatagaagcccagacttaaaatttatcatgaagtaaactatattattgtatttattatttttatttgccctggaaaattagtttttattttgaaacttatttctaaagcattttcttttttctatttattttaaattttatatgcatctggtataaaatcctataatcctgaagatactgtgatgaatccaagtttcctgccttatcctcctgatccactcaccagagacaacttcctttaaatctctctattatttagtccttctagtggtgaatgcacttgtatacacacacgtttgttttggcttttttgctgcttttttttttttttttttttgagagaggtttggggtggggtgagaaagctgtgttgactgctaaatttacatgtgaaggtcagagtaaagagggcaaagtcattagtaagagtttagcttgagcttttaatcaataaatcagatacgaaaatgacccaaagacctagtgagaaagattacatggaattacagtcaagtactgcttaatgatggggatacatttcgagaaatgcatcgttaggcaattttgtagttgttccagcatcatggagtgcactttcacaaacctagatggtatagcctaccatacacctaggcaacatggtatagactattgatcctaggctacagacttgtacaacatgttactaaatactgcaggcaattgtaacacaatggtatttatgtatctaaacatagaaatggtacagtaaaaatacagtaaaaagatttaaaatggtactcctatataggtcagctccattataattttagggaaccactatcatatatgcagtccatcattgaccaaaatgtcatgcactgcattgactgtattaactttgaggcagttggtcttgattaataacactatacaaattaagggtcccagatgtcaattagagtttgaagttcctaaatataatttggatgaatgttgtcttccttcctcagtgaatctgatagccaggtagattatcttcccttcaatttaatacccctgagtctttttcaagggagtagaagtttcattaagaagagtttactttgagcgggccgggagcggtggctcactcctgtaatcccagcacttcaggaggctgaggtaggtgaatcacgaggtcaagagatcaagaccatcctggccaacatggtgaaaccccgtctctactaaacatacaaaaattagctgggcgtggtggcacgtgcctgtggtcccagctactggggaggctgaggcaagagaatctcttgaatctgggaggcggaggttgcagtgaactgaggtcacacgactgcactccagcctggccacagagcgagactccgtctcaaacaaacaaacaaacaaaaaacaaaccaaaaaaaacctgaagagtttcctttggtcagatcctggataagatcttttggttttggttttggttaactagccaaatatttttctactacctggcacacctaaaaatgtgggtatcacatttgtggagacactgtataaatagaatgagttttagattattgtcaatccattgattaaaatcagggtcagcaaactacagtccttgggccaaaagcagccactacctgattttgtaataaagttttattggaacaccaccatacccatttgtgtatgtattgtctgtggctgctttcttactacaatggcaggatttaatggttgtaatgaagactgacccacaaagcctaaaatatttactgtctgtccctttacagaaacagtttgccaatccttggtaaaaaataaaataaaaaatttcgcttgagtcacctaaggcagatttttcagtgctattacgtagcaaaacttaggatagcaaccatggaaggtataaagttaggttgagatttttcttcttcttttttttttttaagtgtgtttataactgtaaattttcttctgagcactgcttttaccacatcctacgttttggcatggtatgttttcgttttcattcgtatccttctctagagatttgttttttactttaaaaattaaatatcgtgatttaattttatttttccttaatcctcagttgttttaaattagaaaaaatagttatgattaactattaacattaatgaattaaaatcttccagaaggaatgaatccaaaaagaaatatctaacgggtaatgaaaccctgatattttatggcctttcctattttagtctcaaacattctaaacataaaggaagaaagagcttttcagttttattcttttaaaaagagtataggcttctctcctgctagtgaggatggtcttctaacacattcacaattatcttagagacaacataatggcacgttcattcatattacagtagtttctaatttcctttttgattacttgttgtttaaaaatgtgttgtttaatttccacatacgtgtgaatttttcaaatttccttttgtcattgatttctgatttcatttcattatggttggagaagataacgtagtatgatttcagtctttttaaatttattgagaccaatttaatagcctaaaatagggtatatcttggctaatattccttatgcacttcagaaaaatgcgtattctcttttggggtggaatgttctatagatgtctgttagatgtgtctagttggtttatactgttgttcaagttttctgttttcttactgttctttctgattgttccagtcattattaaaagtggagtattaaagtttccgttattatagaattgtctatttctcctttcagttctgttaaatctttacttcatgtattttggggctctgttaggtgcatgtttatgttatttatattgttatatcttcttgatggattgacctttttgtcgttaaataatgtcctttgtcttttgtaacaatttttgtgttaaaattgattttacctaatattggtatagctaccagctctcttttaattactgtttgcaaggaatatcttttttcatccattcacttttgatctatttgtatcttggttctaaagtgagtctcttatagacaccatgtacagtaaatcctctcttgccatcatcagtagagtcttagaaactaccacttgcagtaagtctttaaatagcatcatttccttcaatgctgtttcattatagcatgaaaaaaaattttcattatatgtcattttacttaaagttgcagtttctaagaacctgtcagtgaccttaagtgaggacttgctgtgatggatcatgtttgttttgaattcattctgccaatatctgcattttaatcagacagtttaactcatttaattttaaagtaattacagataaggaatgacttacttttgctattttgctatttgttttctgtatattatatgtcatctttgttctccagttcttccattactaccttttttgtattcagttttttttctagtgtactattttattcacttttcatttcttttactgtagatctttatattcttagtttttgccatgggaattacagttaacatcttaatttatagcaatccagtttggattaataccagtttagtttcagtcacataaaaatattttgctagaatgtgagatgcaaaaaggaaaaattttaaattaattttacaaagaaaataaaaaatgttgctcctatagcaagcactgttccctattccttgtgttgtttattgtcactctgcactccagattacatttttatgtatataatgtctgccatagacatagatttatattatttgtttatgacagatttataattactgccttatgtaactgtcttttaaatcatgtagagtaaaattgaagttactaaccaaaatgcattaataatgacttttatatttatctatgtagttacctgttttagtctgtgctgctataacaaaatactttatgctgggtaatttataaacaacagaaatttgttgctcacggttctagagactgggaagtccaagatcaaggtacaacatattcactgtctggtgagggccccttcctcatagatggtcccttctatgtgtcctcccagggctgaagggcaaaaaagggacagctctatgggacatcttttacaagggcactaatcccatttggcctaatcacttcttagaggccccacctcttaataccatcacatgggggattagatttcaacacatgagttttggagggatgcaaacattcagaccacagcattatctttaccagtgttttttatttctttgttgtgatttgaattactgtctagtatctttttctttcagcttgaaggactccttatagcatttcttataaagcatatctactagcaatgaattctaattttttaactgggatatcataatttattttgtttttgagggatagttttgttggatatagacttcttggttgatagattttttttttcatgttaatttactaccatctagcctccataatctctgatgagaaattagctgttaactttattggagatcccttatacatgataagttgcttcttttgctgctttcgggactctttcttttaacattttgattctaatgtttctaggtgtggatctctttagttttctcctacttggggtttgttgagattcttagatatataggtttatgtctttcatcagtttttgaagtttgctgtcattttttcttcaaatatgttttctgccccattttctgtttcttctcccttttggagatccattatgtgtttgttggtacttttaatagtgttccacaggtctcttaggctttgttcattttattcatttttttcctttctgctccccagatcaggtaatcgctattgatctaagtgttcattgattgtttcttctgcctactcaagcctgctgttgagccccaactagtaaaattttcatttcagttatgtattttgctagtccagaatttctgttttgtttttttaaagtctatttttgttgatattctcaattatgtgagacattattctcatattttcctttagttctttgaacatactctttaagcatatttaaaataattgatttagagtctttgcctagtaaatgcaatatgtggacatcctcagggataatttctattaattttttttctctgaagaccatactttcctgtttctttccatgctttataattttttattgagtattagacattttagatatatataatgtggcagtggtattttctactttcctagaggtttttgttgctgcttattatagttggtgttgtctagtgacttttctgaaatagacacttttgtaaagttcatattctgtgctgtgtatggccactagaatttctcttcagttagcttagaatctctggtcaactaatgatttgacagatattttcttaacagttggagccagaagtatatagtcatgcattgcttaatgacaaggatgcattctgagaaatgcatcacttggcaattttgtctttatgtgaatatcacagtgtatttatacaaatctagatggtatagcctactgcaaacctaggctatatggtataacctattgctcctgggctacaaacctgtgtagcatgttactgtactgaacactgtaggcagttgtaacacaaaagtatttgtgtatctaaacatatttaaacatagtaaaaatacagtataataggtacaaaatgtacttgtatagggtatttactatgaatacatcttgcgggagtggaagttgctctgggtgagtcactgagtaagtggtaagtgaatgtgaaggcctaggacatttctgtacactatagtataaacactgtacacttagacaacactaaatttattaaaaatatgtgatctcttcaacaataaattaaccatagcttactatgtaacatttctactttataaactttttaactttttgtaataacacttagcttaaaacacaaactcatatatagctgtataaaaatatttttatatccttataagcttttttctatatttaaaattatttagttttttttttttactttttaaactttgttgttaaaaattaagacacaaacacacattagcttaggcctacacaggatcatgatcattaatatcacatgtcatttaattggaaggtcttcagggtcagtaacatgcatggaactgtcatcttttataacaatgccccttctgaaatacctcctgaaggacctgcttgaggctgttttacactttattccttctataattttttttaaatttccctctgaaataaccataatagtatagtaaatacataaccctgtaacatagttgcttattatcatcaaatattatgtacaatacataattgtatgtactatacttttatacagctggcagcacagcaggtttgtttacactagcctcaccacaaacacatgaatagatacattgcactgtgacattaggaagggtaacatgtcactagaagataggaattttaaagctccattgtattgtattcttatgggaccaccatcatatatgcgattcattgttgatggaaacattgttatgtggtgtatgactaaatataaatgaataaataatatatatagttccagtgtttgccagtagactgtgtatatcttggggccatgccttccacactcagttgggcagtttacatctttcttagcttcagtttctgcttgtgcagagcctgaatatcagccagaagtgagaacttagagccttctcaagtctttctgagcatgtgctctgtcctgggcatgcacatggccatctagtttccaaggaatatgtaggagctttgaaagcccttagtccccaaagcatgtcacttttcagtctgtctgcccaagctttttgagagcttgtttggaggttctagcaggggagcacagctacttgtatacccttgactgaagactggtcctcctctatcagggatggttgtcctcttggaccgagcatgcagcttcgggaggggcacacatggagcagtgagggaagaaggggacacccgcctagccagccagatcagctgaatcaaccctggcgatcagtggggtgacagatgtcgcagccagatccccctcacatccccaagctttttgataatcaattaaccttagcttactatataacatttctacttgatgaactttttaattttttatctttttgactcttttgtaataacacttagcttaaaacagctttataaaaatatttttgtgtcctttcaagcttttttctatacttatagaaacaatttattatattcattgtttgcctcaattgctaccccttaccccattcagcactggctaatacatttgcctgtaggccaggcatggtggctcatgcctgtaatcccagcactttgggaggccaaggagtttgagaccagcctgggcaacatggcaaaaccctgtttctacaaaaaataaaaatcaaataaatacatttgcctttaaatgtttacgacaaatggcctatctgctctggcagagttctgagtgtggcaaaataaaagcaagccctttacacagtttaagccaacagagaggtcaaaacaaaataaccacagctctttgagaacaaggtcaactctgatctctctggcaccaggaacctaaccaaggccttaggttggcatctttaagacacttagtgagaatcatctttctcttaagtgcttgcctaattgctgtaaattttgacaggtttttagagatcagataaagttgattctgacatttttttgtcaggttattttcactgtttctctggagggacgaacttggagttccctaacatgctgttttttgctgacatgccattgcattgtttccattttgataagcttacattattttcagggtttgttgttggtgttgttttggagacagggtttcactgtgtcacccgggctggagtgtagtggtgcaatcgtggctcactgcagcctcaacctcctgggctcaagtaacacccccacctcagcctcccaagtagctgggattacaggcacatgccaccacacccagctaattaaacaatttttttttgcacagatggggtttttccatgttgctcaggctggtctcaaactcttgggctcaagtgatctgcctgcctcagccttccaaagtgctgggattacgggcgtgagccaccacacccagcctcagagtgttttttcgttttgttttgtttttgttttttttcccaaaagtgatgatacatttcttcttcatagaggtcacctgactgttaaaataattcatggttagcttgccaaagagccatatcacatttagaagggaaagaattctaacagatgaatccagtagatctaatatgaaaagagttaaagatagccacttcactcacgtgctgtcaaaaaattttcactccaagctggagagataaaacatctaatccagtgaatatgggagatgaatgttctaacattcaggcctctaatagaaatgtgatatcaaatgtattagacaagccaatacgtaccagggtttttacctttaaagctccaatggaacatattcacattgtagttatgtggacatgttccatatagtttatcaggtcaaggatgtaatagttgttctcactgccttcccaaaactgtctcattgggaagttactcagcccaaatctgaacctaaacagccaaaataaagagatctgattctgaagcaatattttctgagtttgaattcatcgagtacctaatattaaataaatacataagctagtttgaagtacaacttatctagagcatgtctttgtagataagaaaatcttcatgtttttcaccgtatctacttgaggtagaatttattggcaaaataactcaactggatagattctcaagaggaaaatagtcaggcaatatttgtgtataagaaacagagccctgttccttagaagagagctgtctgtatctgtagctgggtgaaaaacaacatgacattggtgaactgtgtatcctaaggtgtaataatctgggggaccaggaggatgagccaagagggtgggagataaggctaaaaaaattggaaaacaccagtgacaaaggcacctggtagctgctcaagggtttagagtaggagagccgtctgaccacatttacatttggggtacatatggtggcagaaaaatggaggattgggggatcagaatggtaagactggaagcagggaaatgccttaggttactattagttgtttttatttttaagtaagaaatgttctgtagtgaacatgtattaattttgtaatagaaaatacatagctattattttgtatgaaatatacttgtggaatggtttattatatagtcccaatttaaaaaaatctacaattaaaatcccaattagagattggttattcatttgacacttgatgtctttgctcaacaataggattcatcacagattttcattaaataatcatttatttctaccacattatctgtagtctatgtagggaacatgtcaattttattaagcaaagtagaatgaaaattacaaccatgttacctgcagtactttagttaatttttatagctcctcagccttccacaagtcacaaaaatactcacaccctgggtaacatactagtctggagcaacaagccccagaaaactgataataaaaataatggtttataaagacaagcctgacagactaattatagcctcactttgtctctctccaactctatttaaaaactattgataatatttagtcccaggtatatagattttttgtgttggtttggtttggtgttttcatcatttgaacttcttaatagtttttggaattaattagacagtcagctatcaaatgagagacatttagtaagcaagtttactatcattttgcccaatattaatatgttattttaatacactttaagtttaatacagatcaagttttaaaccccagccaggcgcggtggctcacacctgtaatcctacactttgggaggccgaggctgttggatcacttgaggtcaggagttcgagaccagcctggccaacctggggaaaccccatttctactaaaaatacaaaaattagctgggtgtggtggcgcatgcctataattccagctcctctggaggctgaggcacaagaatctcttggacccaggaggtggaggttgcagtgagctgagattgtgccgccgcactccagcctgggtggtagaatcagactgtctcaaaaaaagttttaaaccctacttgacagtgtattctttgttattattatgcattttatactggccatgtaaaaatgatgttgtctgattttacctgtgcacacaggattatataaaatgtaattttaatatccacttaatctaagtactgaaccacggtaaccttttaaatatatttaaactatacaagtaatacataaatattgggcaaatttatttgtatgaaccagactgaggaggctggccaacattgaaaataccctttaaagtactaagtaaataagtatagtatatttaactctttctaatgataataatttttgataaatgctaatttaactcccttcagataggcatgctttttgacatgtgaaagtgagattccataggttgttgctgagatgataaactcaatataaataatagagaaaccatatggttagcccgggattcagaaattggctttaacatttgccagtaaataaagagtttctttgaaggcacaccgatgtattaatttttaatttgtttctttttgatctcttaattactgaaaaagatttattggttaattttaggaaggcaagtgtttgaaaagtttcgccaaatactgtcttctttaaatgactgtatggtaatgaaaagttaagaggagagccaaattagattgaataattgttcagtcatgtgggtcaggcttgttgcatagcctggttgttaagactgattgctcaaattacattgcctggggtcctgcacttggttggctgtcttctcagatcttaacaaggttctgggaatttctttttctgacaaagtttgctttgtattttcccctccccctaccacctccaggatgcatcatctgcagacatcagaaaagcatatcgtaagctttcactaactttacatccagacaagaataaagatgaaaatgcagaaactcagtttagacaagtaagtgaaatatgctattatatatatattttgtgacaaatgtattaacatgtcgatggtagaaatattcacttatatatggaatattttcatttgaaaatgaggtagtagtttaaaatatagtgtatattttttttcaagtttctacaaaatgcatttttactattttgtattagcatctctaaattcttggagggtcataattgtcataattttcttgtctaaattacagcttttgcttctaaatgcacattttaagataagtattacttttgtaactgtcacaaagatttattttgatatcaagcatttttaatctcttaaggtactaccaaaacatagtgttacttataaaggagatttcatctgtttattgtatatataggcacataggattttctgcatgtgtattgtagtgccttcaccctcctatgtgatttcttatagttgagagtatttttattttaaagtaatgcttttattttagttggtggccatttatgaagttttaaaggatgatgaacgaaggcagaggtgagtgttcatttctgcttttgaattaagatgttatagtttcatgctacagtttataaagaattaagtcttcttaaacattttattattatgttagcattttatttttgttccttccgagaaatgcagtgttttaaaaatgtgtgtttgaagcagagttaattttattgaaagtattcactagattgatttgatacatacaagcttcaggattttgagtcataatgttagcaagtccgggcttccttaatacgacttttaacatgagtgtttatgccctgggagatacaaatactgcctgaattcaaataaatgtccattccttcccatatgtcagtaatagctcctatctgtgcctgatgcttggtgcttttcccccccattccttaaatgtttgaattagactgtagtgatagtcaagttagtactctttcttgatatttcctcactctcagaataacccagttatataagcttctgtaagcctgtagaagaaagaaaactttgcctcttgcatctatttcttttgcctccttcccttcctttactctgctccggcaattctgcattcagggttaaacttcagagtggaggtagcccctcactctaagacttctctgtgcccctttcagaagactggcaatatatttatgtagtagtttataatgccagtgacttaagaggagattacacagaggcccctttcctctactcctacagaatgtatggaatgtagacatcatttcagcagccttctaagttttttaagtcagaccacaacacatacgcacacacacacacataactaaaacaatagtttcacaagatatttcttattgcatgttaaacacattattttctattctaggctagactagtcttttggtgttttttatttatttattttttaaaaatgttggttgtggttcactaaattcatttcatgagacactagtggaccacaatccaaaatttgaaaatgttctacgatacaagagtacctgtaaaaaacaaaacaaaacaacacctggctatttgacatttaggcaaaagccagcctaaatatctgtgtccttcactaggggggtaatacatctccagacaaccctataaattgtgctatgttacattctgaatctttcctcaaatgtattatctggaattagtctgtatcctaaaatgttagctaccattcttgattctcatcttaaccgtttaatttgaatacctctgcttgtcagattgcaaagcacagggattcaagatcttctcttaaagtgttcttcactttataacaagggctggcattggtccagataccatagcagacattcctctggtttgagataatccatagtgttgaaagagtccaagaagcgtgttgaaagaagttttggtcattctgtgcatattttctagttggtttctctgtgagccctagttttgtttcacacatcaagaatgtgcctgtaaaggtagctttatttagttttctaatatttttggcttgaggtttttttctttttgtttgttatcttaaaagtcaataaactttgtaatttctttcagttaccaaaattatttctatcttttcaaaacaaatcacttctcatatataaattgtttcttcattaacatggaatcatctattaataaataacatcatctcttcaggattagttctctcatttattttagacagttgatagaaaaaatgaatgtgacagttacacaaacagctgtagtatttataccccttgaggcacaagtaactctttggtaactggttttccttgaggcaaaagtcttaactaatgaagctaagaatcactcctctaaagcttgtgcctgaggccaggtgacctatgagtatttaaacatacaggagacagacatctctgcagacaattacttaatgtttataattcctttaggaaaaaaaagagcacagtcagcattatcttctaaaagaagattatctacatattgatatgaaaaaatgcattttggtatcacagttatttactataaatattcattaaataatacttttaaatgtgtaaccttccaggaattggtaatttgggaaattgtcatagacatgtttcctatttatttcccttttatataattgtgttttctctgaaatcagatgcattatttgaattttgctggaaaagggaatagcagttaaattgataaattaacaaaccaaataacttttagttaaaaaaaaaaaaaaaaaggaaaggctggctgggtacagtggctcacatctgtaatcctagcactttgggaggctgaggagggcagatcccttgaactcaggagttggaaaccagcttaggcaacatgacaaaacctcgtctctgcaaaaaatacaaaagttagcctggcgtggtggcacatgcctatagtcccagctactcaggaggctgaggtgggaggattgcttgaaccccggaggcggaagttgcgcactgtgcttagcctgggcgacacagcaagaccctgtctcaaaagaaaaagccagttttgtttgattttttaacatccttatttgggtataatttgcatacaataaaagtcacctgttttaagtgtacagttaagtgctttttagtaaatttacaggcttgtgcaaaccatcatcacagtccagttttagaacatttacatcatttcaaaaaagctttagcccatttgccgtagttcctcaccctgatctccagctccaggcaattactgatcgatttagtgtatttataaatttgtcctttctggacagttcgtataaatggaatcatgcaatacgtagttttttgtatctggcttctattaacataaggtttttgagattcatccatattgtagcatataccagtagttcattcttttctattgctgaacagtattccattgtatggatataccacttacgtttatctattcaccagttgatggacatgtgggttgtttgcagtttggggctgtgatgagcaaggcttctatgaacattcacataaatcttcagatggacatatgttttcatttctcttgggtagattcctaggagtgcaattgtgaataaacgtttaagcctttttctcccccaagaacatatatagcatgaaaatacagtcatgtactgcataatggcatttgactcaatgggggaccacatacacaatgctggctgggcgcagtggctcacacctgtaatcccaacgctttgggaggctgaggtgggaggatcgcttgagcccaggagtttgagaccagccctggcaacatagctagaccctatctctacaaaaaataaaaaaattaccagggtgtagtgttgcatgcctgtagtcccaactacttgggtggctgagatgggaggattgcttgagctacttgtgatgctgagatgggaggattgcaaggctgcagtgagccatgatcgtgccattgtactccagcctgagtgagagagtgagaccccatctctaaaacaacaacaacagcaacaaaaatacccagtgctagtcccataagattataatatggtatttttactgtaccttttctaagtttagatagacaaatacttaccattgtgttataattgcctacagtgttcagtacagcaacatgctatacaggtttgtagcctggaagcagtaggctaccatatagcctacatgtgtagaagctatacaacataggtttgtgtaagtacaccatgatgttcacacagtgaggaacttgcctaacagtttgcctaattatgcatttttcagacccagtgactgtcattattaaagcatgcctataacaggttttcctggttattgtaagaaaacctagcttagcagccttctctaaactctttagctaacttgttttgggaaatagtagcccagctatgttccaacaaatttttatgagtgccctgaatgttagttgaggtaaaatactgagtactagtcatgacatttatatactagattgcgctttagtaatattaacatacctacttttgttcaaaatctattacgaatttttaaccagtcttcttttgctaacccagttgtgcaactttaaaattttttgtctgtttcatgttactatatttataaaagttgaatgtgttttttagtttactaaataacgtttcatttacaaatgctgttaaacgtatagttattcagccttaatatgttaaacttttataaatttattaactagttattgtaaatttgattacaggtgtgttagaatcaaaataaccattagtctgagaataggaaatttattttggcacctttcctaaataaagtgcagtgtaccacaatttttggcatatatatatttttttcaaagaagaatgacagcaattaatttagacatgttttctgtttataatctttgtacaagtagtttttattcagtttcaaaatgtgacctaagtggaaattatgttattattgttttaaactaaaaattcaagctttgtaatacagaagattcataattaggcacatgctagaattatttaaatattcattttcataatatacagatttttaattttagtttcataattactattttatatttcaaaaaattgtaacgttttaaatttctgtacatttttctgctggtaacttgaaaaaattttagatttgtttttcagtgtttgtattagcctaaatatgtttgatgaattgcagattatagtataaaactcactaatgagtatgtaaccattattttatgttcttgatgtatattttaagaaaatcaagtgaaataaacacacattaggccatatgttggatatgtggaattgattaatgttttcatttccaagaaaatgccattataatttcctatgatttttagcattagtgatattttttatcatagagatttctttctttatatcttacaacacatacatttatacattcttaatctggctttaataaatagttgagaacagtttgtatgaatcccaaatacagagcattttaacagtgttatatgtttaaatatagaaaagcctaatacagtgatgttttaaattttatgtgttgtcaacacagtatttcttcttaaataacttatgaaaagtgtctgtgtgtactttggtaagaaatgtattttcaatgtttcatcaagaaagcagtgatttatcttttaacagcatatattctaaaaaatgaactataatggaagctatctttccttaaaatggccagtcgtgtgagctataatatagttcattgatagtaaaatcaatagagcattgattctaagcttaatccttagagactgttgtttagagtgacagacataggctagtaaatatctagttctgtttaatgtgttcagtgcatgagattttgctatcttgaatttgtacaccaaatacaatttgtacgtagggtagaaaatagtagctattaacagacacatagcactttcagttatgatggtgataaaatatttgataagagattcttagctatgagttcagctgttttctcttctgctatagtttagttatacccaaagcaaatttaatacttaagagtgctattagggaattgtctccattttcttagatgttctttatcaataactatactttttacctgaagttatttcatgggagaggtttgctgaaaatgatgatttctatattcaccttttttctccctcaacaaatctgaagtagaatgtggattgagaatagattcaggacttaaggttgattggacttcatttgaatgttgtaatcttatgttagagcacttgaaacctttttacctatacattttctcatttaaaatgaatcagtatttataagatagatttaaacataaatttttgataacatgaatgatagtttttatgaagtcatattattatatcttgatgttaatattcaagaatttcgataaacattgaaaaagaatagcaccaaatttttctggtgtagctactgccaaaccatacattactttgtagactcttgtatattacacaatttgctttttaagagtttagtactaattaatgtcctttgctttcaacattggttattccaatttgatgatattgttattaataacctaagttgatcagaaggtcaggttttctagatttgctaataaaatatattttacatttatatctgatgtttttctactgaaaaaagaagttgcctgtaataaatcctctgctttatttttttagcatatctccaaggtatcaatttaataactatcaaagtagctactgcagttgttgcatttaaattgatttacatgtcaagactggcagtttagcagctgcgctattattcctagatcggtcaatttacttgagaaaaacctactaccgagttctactgacctgcctgacaatataggccctatttctattcctgtaattaggcctgcgactaactcagaatatttttaattaaaatattttggtcaatgtgttgcaccaaattaggcctttcagtgaagatttaattctggaaatagtgtgattagaatatttaatgagttgtgttcaattaacaggttgtgtgtgttgaacacacagtgtttgtatgtgaccattttgagttttacagtcataaatgttactccttatttttaacctcaaagatatttgttcaatgattgtctgacaagtaaatttaaattgagttgaaaatttattttaaagtaacttttttatcctgatagtaccaagaaagctgatttaaaatgcatcagctttttaaaggactaggaaagcttttacttgttaatgttcttctcttccagcaaaagccaaaaatgaggaaattgccacttaattgtttacaaataaacagttttattgagaaatccaacataaacactggttgttaccacatctctttttaatttgggagttttttattttctaaaggaatatagcaatacaaaattaaaagacactcaattttataggcttttacctcattaaaaagctttgataaaatcatgtgtataaatacttcagccttgagccaccgtagtttaggggtagacataaaagcactgactagaaaatttattctgaatttgattcaattaatatgtaattcacggtaacaaacagctcttatcttgatctttctcctattgagatcctcctttttgttgctgacttcaatggtagagtctttactatagactagtagacaggtagactacacgtagctcctttagtttagatgtcactccaggagtcacatctttgggtgctgtaaaaacatgagatctggtatccacagtatattactggacacttttttgaagggtgtcagtgactagagctatctacagtgctttgaatttactcgatattataatgctgggaacgtacataaacattatctattttggataatttgttttctttttcctttttgtaatataggcacaaatagttttttttgtttttattttaaactccccgtgaaaaactgttatatttgtactgtaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggtaagtgttagtaataaatcaaatgaactagcctccttaattttatatggaattttggacatttatttttcaactgatgaaaatttctgtttctctctgtatacttctcattctaatagttttatactcaatgtttgacatatttctaagtcaagaagaacccatgaaataagaaaatattcttcttttaaaaaatgtggcacttaagtttgttataaaactttgtgaaagcccaaatatctagctgggaattagaaggtagagccatgttttcattatcaccttccaaatagaaatattttttatttaagactgattttagatttttttgtgtcacaggcctttatataatgaatgtttacttttaaaatgttttaggtaaataaataaaattggaaatgaatataatattctaacttcaattggttaaaaaaattattacacttttcttggtttaatatgctactctatagtttattctttgggtttttatttatatgttaaagataatcaaacatatttatcagtattcatgaattagcatctgtttactcattccttttgaagtgacattattaaagttggatgaatgagaaaaagtgagttgaatgctttctcttcttagaaaactttgattgctatggagatgcacatgactgacagtcctgaacttcatgtgtgtttaaggcctggataccatggcaacagttattgtgaaagattgatgattttacttaatcatgttggaccctacatacatttgcataaatgttcctctataatgtttacccttcacagaagagcctagataacatttgaagtgtacatgttaatgataacctgtaaccataattctttccacattaaggatgaactactaagtagaaaaaagagagaaaagaaaaaaaagactggcagcaagagtgtggatgtatcaaaactcggtgcttcagaaaaaaatgaaaggtgagagcatataaaaatactttataatttgaagctgttttaaaatacatctttaatatgattcaacttcatatgtatgtctatttacatgtgctctcatttatatctgtggtagtcttataaaagactaataatgtgccattgtttatgagacaagttctaatcttaagcaaaatgtcttcaggttttttcccccatataaagtgtgactatatatttaaataatccctcaaattcttctagtttgaaatttttatactgaactttagaaacaaagtactattagacggacctatcacttagctcaggagtgacagtatgtagagaggcagtgatatgcagtacactcaaaaagataccaccatttcttctattgattcatagaaaggaataaagggtttaaatagttcacacagcagggcatgaactgggatcaatgtgggatggagatcagagactattctgcctgtcatctattctgatgacatcagtgagtaatgcttcagtgaactgcaaatgacattaatttttatgtattggtttgtttatgctacagtcttcatatctggttgtcagcacttgggaacactctgatgatggttagttttttatagctgaagtaatcataaggcttaagaattcgttgtacaaaagtgatgaaaagcccaggttagaaagaaggcttttgtttatctttgtaacttgattaggagcctccttccccaaaatcttagcctagattctcttacatgctatatatattgcatttgttgtgactactgtatttcatgatggagtaagtcagttataaatatttcagtgcatactttcttcattttttttgttgaagtagccattcacaaaagaattcatgatctttatagaattattttgcctcccaactttctctgtatattcctcatatgttgtatggtgttcttttttctccctccctttagattgctgatgaaaccacagtggcatgatttgcttccatgcaaactggggatttggttttgccttacactaaaagcattacctcacctcatccaggtaaaatgtacctcttttatataacattagatcttttatttttaatcactcatgaaataatttatgcccatgtcggctctctgaatgctgatatgcagtggatgctttataatgttgattgagtaggatttttataagttaaacctaatttagataattctaagataatttagatatgtttctgtaattatcttttataatggttttagatcaccttagagtcccaagatgctagaaaaagaaaaaaacatactatctttagtacagagataaaagcaataaaaatttaatccactgttatcattaaaagcataaccagtaaaaaggaacagtattcaagtagcttgccacccattattttaatagcatttaagtacatagtgttaaaaaaaaaaaaaaaaaactttacatgaacatctgtataattgtaccaaaatatatattgctttccattttatttgcaaatttaagaggagtgaggacattttgtcttatacaggtaatgagtttctgtttctatttagtcttgattaaataataaaatgtggatatgtatcatatttagatgtcagtttcttttatttttttacatttagtataccaaagcatattttattaaattattgctttgttaattttgatttttgcatcaggtttgaaaatccccaacacataaatatttgaaagtaaataaaacactttttggtgtacagattttgaggttgagattgtaattttttggagagaaatgttttattttagaaaataagtgtttataatctagaggaccagataatattctaattcagttctacccactttgtagttatatattagagctatttttcctgattttttaaggaagctaatgactacaacttctgcattttcctttatttttctcataatgaaaattttatatttaaaggggatattgaaccaaaatactagtgtgcttctttttatcctttgagaaattaccagttcttccatcaaaatagttcatcttaatagttattgcttatagaatcttatattttgtttacagttaatagagaaaaattacagtattttggtaatttaaaaggtttgtttttaagttgtttagtgtgttatattgtttgcttgaaaaaatactctgcaatgtttgtatgctgtctgtaagacttaatgagggagggaaagtctttatcacactggtatgtttatgagaaaatgaggcagaaaatatttttagggcagattttcttattttttgaagtctgattattttttgccaactttagaatccgtgcaataggcaaaccagaatatagatgagttaaaaagtatattcatgaggcagtataaatagaatattacataagatatcaatattaaacacttctttgtaattttaatctaatttgaaataaaatttatttggtaaaattaacatatttcttgtttagcatgcagggtaatttgccagactagaaccaacatattgttatggcttagatttataatttactttaaaatacttgcctgtgatagctgttaattcatgtaatagattgattgttttgcctcatcataaatttgtagaaaatatacaaaaatgaggaattttacagaaactttttagtttctttagaaactctgctttttttaactgatcactttgaattttaaagtttttacttacttgatggtatctgctggcctttcggttttgagatgctaggcattagggttccaagaccttttaaatctaatttttaaattttattctaattatttcttcttgataaatggatttcaagaagaaaattaagatgattttcctttttaaaggaaatatttgatatttttattctgctgtggggaccttagattagtgtttctagtggtcactaacaaaataatgtaatgcagtagactctttcaaatatatattataatactttagaaagtactttagattgattgcttatgaaatacattagcaaaacaatactgttcagttgctctcaggattagatttttgtcgctttttgttttgtagtatgtgatgacctttgtattaattttagatcttcttaaatacgatatttatgaaatttacaacaagtctttttcacccgaagttatctggattggtaattggaacagtggtcaaaaaggagccctgttaaggctctaagaataaaaaatgataggtacaaccttaaacttttaaaacgtgtactttatgtaccactcttgtgatataggaccattgtttttttatttttattttcttttttttgagacggagtcttgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgatctcatgatccgcccacctcagccaaagtgctaagattataggcgtgagccactgcacctggccattgttttatttttaaataagagtccactgattgaagtttcttgtactctttctggcataaactataccgataatcttgctttctttaaagaagagtcaaactagagtcttgtgaaacagtgtaattgtataatctttgtagatatatatggttttctccaagtctttcataattggctttctgacatctagttaacttcattttaatttaatttaatttaatttttattttttagagacagggtcttgccatgttgctcaggctggcctcatactcctgggctcaagtgatccccccacctcagccttccaagtagctgggactataggcacacacctccaagccagacttttttttttttttttgggagatgggggtaccctaggtgggacattaaaacagcatttttaacaactcttattttgagcttgccaaagcattcaacttggttttcatagaaacaattcttatttcttactcatatctcatccttttttagatggtaattaattgaatcatgtaattagaataacaagtataactaccactaggaggtttaagagttaacacacgcagctcttataagtatacagtaaattagttaagcacatgtaagttaaaagagttttacttttggcgtaaattccttgaattttatgaaaagttaattaaaactgagctgcaaatatttgatgtctgtatatagctattggttaagaagcagggtccaagctaaaagtgggagattcagaggcttccagcaagtgacctttacactggcagaatctgtacccaaatcttgtcatagcaatagttcttcagtttaatttctttccttcccattcatcctctaaatacccattcctttgctacgcttcacatacataaggtcgtctggtaagattgggaaagtgggatttctggctcacctgtgctcccaagttcgcttttattacttagcatctaagagccctaagaaaactcctgttgcctgcttagtatacctaaattattttctatttcctcccaaacaaaattacaaatgcaagtaattatttccacatttgattcttaagatgtcttttggtcagatgtttagaaagacagttcagccagttcaataaaaagatattaaatgtatatcagaacaaagcactactagggactacagagataaatatgccttctctaggaccttaatgtcaggtagcagttataacacatgaatttaaataaccattctacaatacggtatatatgcttcacattttagtatgaacagtgacttctgtagatagtcagagaagtaaggttgtctctatttgggatgaccaaagaaaactaaaaagagtaaacacttgaactgagtattgaaagatgaatagacacttaacagttaagtgcccactttgtatactaggtggtatacaaagataattttgtagatgcagtacttcccataaaatcatactgtgttaaggctaaaagcatcctaaggaaaacattatacaacagcctttttttaaagagggtatcatgcagcccattactgtcttctcagactgtattccaggtctgtagattctgagtatatctatttaggaatttatattataacaggtaaatctgatatgacaagtctaaaaagaatatttagacagaataaagttaactgataagacaacaaagtgtttctttgattacacacacatctgtgaaagatctgtgtacattgttaggaatggtagaaataaagtacataaggactgtgaaatcagcagaaaataaatgaagtggttctgtgattaggcaagatagaggtaaaagtatctctttgatagttccccttgcttctttgtaaaggtccttattacctccagagcactggattttgttcctttcctttgctctgagaaggatattgggagaattataagaagtgatagaagaacaaagccaaacagtgaaaagctattatacttagtggatgttaaatatttgataatattaaattaatatcagacatttcccaagtgggtcagtattcaaggacaagatgcatggatatttctatatttagtcaaatgtacgccccatgtaatctacataggcagaaaaggtaaaagtcaagtgagaaattacaggaaaagaatatggtgtttgtaaattgatgaatgaatggaaggctggtgtgtgtgtgtttagagagatgagagaacactggagaggagtgaaatggatgactacatacaaggaagcagggggagcttcaggaagtgtgttgagatagctaacaaagcaagtagagtgatccccagaagatgtgggtatgagttagtatataacaaggaacttggactatatcaacagagggcttaaatcctttgaggcaagaatttaattgtaacatttaaaatatagctcccgtgacactttgacatcttaccagtctgtttctgctctcctggtgggtttgaagaaagtacacattctcttggaatctgacaaaaaccaatcttctttgttggttgtgttcggcttgtaaccccaggaaatttttgtaacctccaaaatgcccttcttgggtatttttaaattgattatatgttctgtaacctggaaaatagcaagtagttggtgacatataatcagtgctctgtgcatattttcaatttagctgttataacttagtttattttcgcaactgtttcagaaccttaaatatttgggcccataataatttagattgttcagaccatcagtttctctcataaaatcaggaagtgccacatatcccaagtgattaccagtctaaatcatagacacagttctctgcattttctgagatcaaacaggtcttcagcagtcagaacttaatttgcttgagaatttgtttgatttttctaggaattcaccattcaagtttctctctgactcatatattacatttctcggtagcataatttataaaatataaaactcatttggttgtgcattgcctaaagttgtaaattttttacctttttaagttccagtcccatcttttctcattactaacagatctaacaagaacaccagtcaaataaaaattgtcataggaagtttccagcatgcatatccccacccccatcaggatgtataggttgcctaggagtagtggctgagaaaatagaggaatcttctctgtacagctctggcttttacctaaaaaaaaaaaaaaaaagttgcctaagagtaaagggagtactatactttatacaactgtctataaatggaagcatcctccctcccaagaagctgcttctcccatggagactacaactgtggacaagcctggaggtcaccctccctgacaattagggcccttcctttctagccccttcgcttctgcttgctaggactctgtcagaaaccaaacaaacagaacattcacagctaattagcaggaaaaaaagcttctaaaaggctatgaggcatttgtttcaagctgagtcgcctgcccttctacttagagttaaacagattttccaagggatgaggcagcttgcttttaatactctaaaactttttaaaacttttcagacacacacacatacagaaacctgacacaggaaatacataaacaaatgaaaatagatggagaagttcatctgaatttttataagctgaaactactgctacaggacaaagggatacaggcaaactggaatgaccttacaacataagacagagattccttacttccaccctctgaaagtaaatccttgcatcttatgcaagtactcagagatccaaagacagactatagagttttgtaagttattgctagatgtagaaaagataaaaagccacaaaatgttaggtaggatgttagcaacatatagtctcatcaattccatattttatagatgaaaatacttaagactcaaattggtgaaacaatttccccaaagtgacacaactagttaatggtagaaatgaaactgaaagcagatgaaaataaatattaaaatataagaaaaaaatacataagaaaaataaaaactaaaaaagaataaatttcgccccaggtcgataactagaactttatagtataagctgtgtaatcttaaactccctgtcagaatgttcaggctgattataattacacattttcctcaacttatcgattgcatcctgataagcccatcataaggagaaaataccctaagttgcaaatacattaaatatacctaacctccggaaactcatagcttagcctagcctaccttaaacacgctcagaacacttacgtttagcccacagttgggtaaaataatctaatacaaagcctattttatttttaaaaagcgctgaatatcccatgtaatttactgaatactgtactgaaagaaaaaacaaacagaatgattatatagaccctggaagtatggtttctactgaatgcatatcactatctcaccatcataaaatggaaaagttgttctgttaaaccatcattaagttggggacatctgtaggacataagttgtaggattcttacattgagttagggctgaataaatggcttctacagtctcttctatctcttggaacaaatggaaaaaatagtttttaggctgtgcatctccttgaatattacagtctcagaccagaggaagacagtagcttctggttttctgttttatttttattactttttgtggatttagtcttattatagttctgtacagaaattttgactcttatcaaaatgtacaattttacagtttttctatatttttcattgtaattttattgcatattatatgtaattctgagattatagtataagtcaatgggagaacaaaacaatatagagcatttgattttgtgggcagattttcagaaatgtacttatggtattttcctacattgaaggttatttctaagcctcaaacgaaagagaagatttgggctatcaaacaatgaaaaagaaatagaacatcctctatattgtttctaggtatccttcctcatagctcttccacgttccttattcccatcaggacaggtggtatttccctccccctaccactgtaaatcaatgcctgccccgcctgcccgccttcccgccttcccgccttccttccttccttccttccttccttccttccttccttccttcctttctctctctttctttctctttttctctttctctttctttctccctctctccctctttctctcttccccccctctttctttctctctctcttctttgtctctttctctctctccatctctctctttctttcttccttttctttccttcctttccttcctcctctcctctcctctcctctcctctcctctcctctcctctcctctcctctccttcctttctttcctttcttttcttgttctgggctacatgtgcagaatttacaggtttgttacatagggaaacgtgtgccatggtggtttgcttaatacccatcacctaggtattaagccccatatgcattattagctatttatcctgaagctcaccctcttcccaccccaccacaggccctgatgtgtgttattccccttcttgtgtccacgtattctcatttttcagctcccacttatgagtgagaacatgcagtgtttggttttctgttagtttaatgcccttgtttcttaagcttttctttggattgcttaatatgttgatgtttatatggagagataaaagtgaaccaaaacattataaacagtgccaccttagcatgttctcttatcacttaatgaactatgtcaagaatgttaaagggtgtccgggtgcggtggctcacaccagcactttgggaggccaaggtgggcggatcaccagagatcaagagttcgagaccagcctggacaacattgtgaaacgccgtcttactaaaaatataaatattagccgagtgtggtggcaggcacctgtagtcccagctatttgggagactgaggcaggagaatcgcttgaacccagaaggtggaggttgcagtgagccgagatcttgcctctccactccagcctgggtgacagagcaagactccatctgaaaaagaaaaaaaaaaaaggtttaatgtaaggatattccctatctcacagcttactaatcttggaaatattgtatcttcaggcttaactaaattatcatcattatgaagccttccttcatcaggccaactgaaaaattctcattgtatgttctccatactaactttacagcatttactatttgtattaatcacggtagactgatagaccttagtctgtttctggcatatgcctcatgtctgtcactggttgataggaaagtgggcattctggtctacctaaccattcaggagctcagagcaatgatgtgttcaccaccttcttagctgtatccatctggaacatgtggcctccttgctcattatgacaagaggagagagctggaggatttgcatgagtttttctgtgagttggtttggaaatgacacatgatatttccatccacagcccatccagaactagtcttctgaccccacctaatcttaagaggacagcggaatatagggaaacagaatgttgagtgagcaccactttctttgccagtaattcattcaacaaactttatttattgattgcattatttactttgtgccggggcaggggtagggggtgaaagacaacaattcctgttctcacagagcttatattctatattccatattttagttaatatttatagttatttttacatattccttaagggaaactgttgtatcttatataatcaccacatatcctaataatgtacaatacatataataatggttcaataaataagcataaatatccctgtttaatgtcttcttgtgcaggagcctatgctctataattacgtacaaagaacactcatacattatttaagttagccatagtttaaatgtaaaacctgtcccctgtttgatgtctatgaaggcaggttttgagctcttcaggaaatcttaaatattggccaggggcggtggcttacgcctgtaatcccagcactttgggaggccgaagcaggcagatcacctgaggccaggagttcaagaccagcctggccaacatggcaaaaccccgtctctactaaaaaatacaaaaattagccagacgtggtggtgggcacctgttatcccagctacttgggaggctgaggcagggataattgcttaaacccgggaggcggaggttgcagtgagctgagatcatgtcactgcactccagcctgggcgacacagcgagactctgtcttggggaaaaaaaaaaagaaagaaattttaagtactaatacagttgcttctagaataaaaacttttgctcatggttccattcataaggattataaactccttgagaataggagttctttctgtttggaaaaatgtaaactccataattttaatacagtattatgaggcaggcagttcagagccctaatcaattgaagtaagcatttaattattcattaaatatttattaagcttctgtaagtgccaggcagtgtactagggctataaggatggattagaagtttatatccccaggaaatctaactttctgtgtaggtaaactggagtttactctggacccaaataagtttttgtgcttatttttcccattaaacgattttattataattttattcacttgaattcaccccccccccatgaaaaatgggagggaaaaaaggttgaaaacaatttatcttattcatcctcttttgaatgcttggattcaaaagcataccttacagaatagccataccttagaacataccttaaagaatagccacgtggtttcttcttgaatactatctccaaaatcagccgatttcattttcaggtaattttaattattaggaaattcttatatatatatatatataaaatatatatatatattttctctatattatatatattttatatatattatatataatatatattttatatatataatatatatttttatatattatatattatatatttttatatattatatattatatatttttatatattatatattatatatatattttatatattatatatattttatatataatatatatttatgtatattatattatatatatttatatattatattatattatatatttatatatattattatatataatatatttcatatatatttcatatatttcagacagagtctcactctgtggcccatgctggagttcagtggtgtgatcttggctcactgcaacctccacctcccaggttcaagcaattctcttgcctcagcctcctgagtagcggggattacaggtgcctgccaccacacctggctaattttttgtatttttagtacacatggggcttcaccatgttggccaggctagtcttgaactcctgccctcaagtgatccgcccacctgggcttcccgaagtgctaggattgcaggtgtgagccaccacacctggcttcttcctcatattgatccaaagtcaaaactttcatctctggaatcatatgcagtagtttacaacattcttgcctgtaataaaccttgagatattgtatggtagttatgaagttatccccagtcttcttatctctaatcccttataaaaatagagtttcaagctgcctccctatttaatcactttccttttaaagtctttctatttgtcagtgcatcttaaagtgtgataccccaaactatacacagggatggttgaaacaatgtagagttgtttagtaaagtagaattgcttgagttcatagattgttaaggaagtaatgtttcctggagtgggcatattgtaatttgatttcaaagcataggtaagatatgaaaaaaaaaaaacatgaggaatgtttaaataaatgcttagaaatggagcaaaaggaagataaaaatagtgactgaaactagggaatgtaatgaaagtctcagattaagtagagtaggttagggtgattgggtggattgcagtcctcagataagtgaggatttggattaaatgtgtatttcaaagaggaagttttagtgggattatgtcccatagcaggaagaagaaacattaacagggaaaatgttcaaatttggcaggactactagggagaggttgctattatacagcaaaatgaagtgagaaggatgcaattaaaaaggtcacataagcaagaagatacaggatttggcaggggaattttggtgaagtatgaagcacaaaactcatcctttgtgttggaaaacaagatccttgtcaaattggtagaagtaataataaaaatagctaacatacatataaggcctaactgtgtagaagatatcattctaactgtttcccaggtattaacacatttaatcttcataacagtcctataagttaggtacttttgttatccccattttatgaatgagaaaatggacccacagagaagtaaaataattttctgaatgtcacatagctagtaagatggcagagctgagttcttaattcagatagtctggctccaaatctgtcctcttaatcaccatatttcactgtgctatactgtgatgattgatttcagcctactttcttttacctctcataaataactaatctgtgcccttcttttcttgcatgtgccacatttcctactcccctcaaggagccaatgccttcctgaccttttcttcttccctactattaaaacctactctgtggaaagaagctaataagctcattcattcattcacaccaaggtataaatgactcatatggcttaatataaaataatacttctttagggttgactttttttaaggggggtggggaatgttaagggctataaaaccttaacccaaaaccctgttgaaacttaaactatatatgggcatgggaggatgagtaagttggttgcatggccatctgtgctcttctagtagtaccattgtttacctggcctagggcttgtgtgaatcctcatagaaatgaggtaggaacataaaagtggggatgaaaagaattaagagatcttttactatattaacaatacatctgtattgtattgattcaatgattttaggaataccaaattcttattaggtggaagagttctgatagaaccccaagagacacagacccccaggaaaaagctttaatttggacacagtcgtagacgaaaagagtttctagggtttaagtatttatgtatttacatctgagtcaaagtagtgtcaaagattttgttcctttatttcttgcagaaataaagctctctcagatgggtctatgatttatctgctctaggaatcttatggtctgagaatgttaccctagagttattcttgaaacccttctttttcttatttcaccttagttagtcatcaggccccttcatttcttgctttattaggtttctcacatatttcagtctagttcaattcggtaaatacttattgagtacctgctttatggcagatactgtgctctgggcatgtaagtatccctttctcaatttctcatctggaagagaatataacatgatacaagcagttatagacatgtttaaatatagaagtagtgtacaagggagaattacactgccagagaaggtcagaaaaacttgcaaaggagatggggcttgaatgggttttcagggattaataagagttcatcagaataatgccagggaagtacaatattgtagccagagggcaaagcaattgcacagacatggaagcacagtgtgggctggcagctgttaatacaagtggtattcctatagactatctgaggtttgagccaaggagtgtggtaaaagatctgttttgcttattttcattgtcgggatctcatatgcctagagcatcagcttgtttatttttatgtatgtcattatttaagacctaggttttttttttttttggtacaccactaaagccttacctgtgtgccactcattgagacttcagtcactgtatcttgacacctaagtatatgtatgcagtatgtgtcctcagtcctcaatcctcaagacttcatggtaatggtttttatactcgtctctaagggtggtaaaaggaggagtggcacctttcacttttatatacatgctcgtataagttttataatcagatttgaagataattttgaatatctattgtagttaaagggctaatatgaaaatagcagtagtactttgttagtcacagtaatataatttactgtgccaaatcagttcagcaaatgagtttttctgctctctgtatatgcaacagtatattatgaaaatagcatacaatggaagaaaacaggaagaggatacctcctttccatatctgagagaaaaaatagtttaaaattatactcataaaatttctcattgtaactggctctccaggagagaaaaatcatagagaaatgtttaatttctgctcatcataaaatttgaaaacaaaaagaaagcctacttataaaatgaatataatgctttaaagttaagttacatggaaaatattattgaagcacactgatttttatgttaatttatgtataactttttttcttaaggatgctgggcagttttatgctaaatataaagaaacaagattgaaggaaaaggaagatgcactgactagaactgaacttgaaacacttcaaagtgagttttaaacattagtgttttaacaatgtcatataaaattaattatttaaatgtgaattatcttttaaattcagcagtaattaaattttctggttttctttttttttttttcccactccctagtggagtcacttgtacttaatgtatttgacatggaacatcctacattatagcattactttaccacccaaagtttgatatcagaaggaaggataaaatcagcttgagtcatgtaactcctcaaatctaggggcatccaaagtctgcaaagccctaaaatacttcagtactataattacagttgatatttagtgctagtttaaccagttaatcacccaactttctgtgtaacagttgtagttaggaaacctgaaaataccaatgatttttgttttgaaagtttttgtttaatttgcaatattgttatatagtatgaacaactttgtataaattatcagtatgttgaaaagaaatcttccattgaacacaaagacagttcttgctgattttaggaaaagttgaacatattatgtaaaaaggtattttctcagccgcagtccttttgtctatttttgccttatctacatcttggctcccacacatatatactgtgtctctttgcatttctttatttttattccaagcacttaatactactttaatttatatattagttttgtttaccatctgatttccaaccccccacccccagtagaatgtaagctccatgagggtaaggactttatctgttttgttcactgttgtgtcccaggttgtagggatttgggtgtggtcattttagggggtcatttttcagtctatcacaatccttcaggtgtctggacagctttagaacagagactgttcatctctgtgtctgtagcatcaaacagggtcctggcacataataaatgttcagtaaatggatagatgtatgaattcatgtaatgccatgaatattaatgagcatccactgagcacctagccatgtaaaacaccatctcaagaagcacataatttaattcaaaaagcttcaatacttacaaatacaaaataatattcagatcaactatataattgtttaaagtagacttctgttaagaaggagtaagaatgatagaggattattacatgccaaggttgacatatgtgttaaaaagtaggagtgtgcaaatgaaactcttgtcatttttatataattgttattttaggaaaaattggtagattacaatttctaagccttttcagactaatcacaaggagaagaaaaattacatttataagaaaagagaagaatatcggccaggcgcagtggcttacgcctgtaatcccagctcttttggaggccgaggcgggcggatcacctgaggtcaggagaccagcctagccaacataaaaaccccgtctctactaaaaatacaaaaattagccaggcatagtggcggacacctgtaatcccatctacttgggagctgaggcaggagaatcacttgaacctgggaggtggaggttgcagtgagccaagatcacgccatggcactccagcctgggtgacaagagtgaaactctgtctcaaaaaaaagaaaaaagaaaaatataaaattagtccaaaatttacctgtagaggcaacgtgaatacactacatttgattgctctcatggacacagcttatcatttctatgtaattttttgttaaaaaaaatattataattttggtagatgtgttagaattatttagtagtaacaagactaagtatatacactaccccttttgaaattaggttaaacatgaagtgtttatcactatacaaaagctcctttcggagttaactatttttccaaaattgtccaatgacttttgttctgcttaagagtttgatgtaattctcaaacagatttaatagtctcctcttggccgggcacagtggctcacacctgtaatcccagcattttgggaggccaagacaggcggatcaccagaggtcaggagttcgagacccacctggacaacatggtgaaaccccatctctattaaaaatacaaaaattagctgggcatggtggtgtgcgcctataatccccactattcgggaggctgaggcaggagaatcgcctgaacccgggaggcagacattgcagtgagtcgagatcgtgcctgggtgacagagcaagactccgtctcaaaaaaaaagtctcttttaattttgtcattgtctgattatgtaaaaatcacaaactaaaaaacatataaatatctgaaagtgaaaatgtgtaacagtcttgtaaaacatttgaaaattcatcactagcttatcagttattgaaactcagaatggaataataccagaaagcatattaaaaacattcctcatactatgctgtgaataataagattgttatcttgcatgcttcttttatcagtggtatatttagaaaaggtgatggtatcaacattaagaatgttaaagaacagtcacatttactgttaacaatgtcagactgtcatgtattttttaatatagtctctaatggttacatgcaaataatattttaattaattttattaacttcattacagtattctgcattgtatactttagaattaatacataaaggccccaaatcccccaatgtgcatttcatttgccccatccttcttaattttaaagaccatcatcagaatatcaagttcataataacatttccatctacttaattgagtaaatgcatctcatgtagattagcaatagctgttttatgctgcctgtttttcatgacctaattgctaatctgccctcatctgctttactgcttagattgtacagtattctctgagggctgcaccagaactactttgagtagggtgtgatagtcttattaaaatggcattttagatatggggggcagtgaaaagggtgatttcttaaaaataaatatccttctgagaagtctttctgtaaaaaaattgttgatatatatttgggaaatttggggcactttttattataaacttttaatcaattttgtggtttaggtttaaataagttgaatacttataaatattagacttttgagggttaatgattttttacacattctctaatgatatgttttattctaaattaataaaagagaattctatgtactaaaacagcccatatcgcatgagaaaaagacatgtttgacttactttataaagaaattataaaggtcacaatttgaatagacaaggaaaggaaaggatagaagtaaactcgattatttccttgacccctttctttgtaccttctatgattttaaaacaaaaccagaattaaataatcaaaactctactgccaagtacttcatttaaatatggagaaatagttcccaacattagttatgtttttcttcttgttttgtggtccttgttgcatgccccagaaagggactgaagtaagggtgcctcagggacacaccctgtaggatgaagcacttagcgagaaagtggggggacagaatgtgacttttcagtgtggcaggatgagaaaatttagtcaccttccttaagactaaaggaagagtgattttctagaaaactcaggttcatgaggaaagtagttgattcaggggttggtagggaagaaggaaaaatagattgagaaagagcagccgcagtttaggttagaacactttgcctgtggtaacatagggtgctcacggatgggaatatactctctgagataacttatgcggaggcatgtaactgatcactagctccagcatatctgaaaacatgacctaatagaatctctgtaccttatgccatttcatattataaaacctaaaatctaataggagcccttgttccaaaacagtttatatgtaggcagataatatctaaagaatatagtattttatcctaggtacttttacctagggtacagtataatatcctaggatatttgaataccaatggaagtgtgaaattttaaaatcatacaactcaaatataaatttacaattcccttaatatttcaaatcataatgctgtgtatgtacaaatataatgcagtcttagtttccccatggcaatgattcagaaaatttttatccaattgaatatataagtgtttatggctatagattaattagtcaaatttctttatctttttttttcttttgctttttttttttgagatggagtctcactctgccacccaggctcaagtgcagtggcgcaatgttggctcactgcaacctccgcctcccaggttcaagtgattcttctgtctcagcctcccgagtagctaggattacgggtgtgcaccaccatgaccggctaatttttgtatttttaatagaaacggggtttcaccatgttgtccagactggtctcgaactcctgacctcaggtgatccacctgtctcggcctctcaaagtgttgggattacaggtgtgagctgctgcacccagcctattgaagaaaatttctgaaagtaaattttgtgtagcctaagtgtactgtgtttacaaagtctaccatgttacacagtaatgtccgaggtcttcacattcactcaccaatcactcactgacacccacagcaacttccagtcctggaaagtttccagctctgatctctttctgagacaaagctcctaggcagaggggtggcctctgcggttcagcagactcagctttgagttccagcctgccagttttggagaatccaaacagtctggactaggaagggtccccccgcaatgcaggatacctattctaccaaaaggcagccggactgcttgttcaagtaggtccctgatcccattcccgtcctcaacagatcagagctctgttcgtagaactctggctggagtggctgaagcccccacagggaggtccagcccagtgaggaagaatgaattggggtcccgcttaaagaagcagtcttgcaagtcttggcaaggcagctgtgctgcattgttgggggatcctttctcatttggactgtctgtatactccaaagccagcaggttggaatggccaagtctgctgaattgcagagatggcacctgccccttgccccaggtcctgtctcaggtagactccagcctgttgctgttggccagctgtaattccgagccccagtgggtcttaactcgtgaggtgccatagaagtggggcctgcagaatgatgctgcttgtctccctggattcagcccccttcctagggatatgtacagatgaattgcctgccttgccagggatcccagggctggagtatgtaaaactctcagcctctgtgtgtgcctcagtggctgctctgccaagactccacatagctctgtgtattgtacccaaggacttcgtggcataggctcttgaggggatctcctgattgatggattgcatagatatgtgagagaagtgtggtttcccaggtgtggttgcagtcactcactgcttcccttggctggggttgggggttcctttagcttcatgccactctctggggggccatcaccccaccccgcttttcttcattttccatgggtcaagtagttttcctagtcagtcccaatgtgagaaccgggatatttcagttgaaggtgctgaattcactcaccccttttgttcctctctctgagcgttgtagactgccgctgcttctaatcagccatcttcttttttttttttttagtaagtagaaggaatactctctaaagtaatgttaggaagtatagtatattctggcctggccaacatggcaaaacctcgtcatgtactaaatatacatgtactaaaaaatacaaaaattatctggctgtggtggcacatgtctataatgcctgctacttgggaggctgaggcacaagaattgcttgaacccaggaggtggaggttgcagtgagccaagatcgcgccattgcactccagcctgggcaacaagagcaagactctgtctggaaaaaaaaaaaaaaaaagtatagtatagtaaatacataacctaataacatgcttatttattataatcaagtgttatatactgtgcacaattgaatgtgctatacttttatataactggcagtgcagtgggtttataccagcatcactacgacacatgagtaatgcattgcgccatgactttacagtggctccattataatcttatgggccaccatcatatatgtggaccattgttgactaaaatatcataatgtggtacatgattatatttcagtttggagaggattgatatatttaccattgagtattccaaatctatgaatatagtatgtttcttcattaattatttatatcttcattgatttatttcttcagtcttttgtagttgttagcaaattaaatcctgtgtgtgttttgttaggtttatacctgcttctctttattttgagtggttataaatggtgttggattttaatttcagtttccgcatgttcactgtgtgtaagaaattcaattgatttttgaatgcagatatttgttttgctaacttgctgaatttacttattagtgctaagattttttaatgtagattccttggattttctgtgtagacagttatgtcatctgaccgtggggacagatttacttcttcctttacaatctatgcattttatttccttttcctgccttatagtactagctagaattttggtactatgtacaacaaagtgtggtgggagtgggcatccttgccttattccaaaccttaaggggaaagcatttagtattacaccgttaagtatgatgtaagctgtaggtgttttgtagatgctttacatcagtggtccccaacctttttgtcaccagggaacgatttcgtggaagacagtttttccatgcacctggtggcagtgggggatggttttgtaatgaaactgtagttagattcttataaagattgtgcaacttagatccttgagaatctaatgccactgctgatctgacaggaagcagggcgcaggcagtaatgcttgtcctcctgccgctcacctcctgctaggcggtctggttcctaagtccatggcccagggtgttgaggacccctgctgtacatgaagttaataaagtttccctctattcctagttttctgagcattttttaaaatcatgacggggtgttgaattttgtgaagtgttttttttcctctatcaataattgtgattatgtgatatttcatttttggtgtattaatacgatatattacattattggactttgaatattgaaccagctatgcatacttggagtaaacaccacgaggacatggtatataattcttattgctgaattctatttgctactattttgttaaagaattttacatctatattcatgagagatactggtctgtaattgtcagtgtccatttgtgctgtaacaaaatacctgggaaataacctgagactggctaatttataatgaacagaaatttaattctcttcttgatgctggggagtccaagatcagggcatcagtacgtttggtgtctggcaaaggtttctgtctgcttccaagatggcaccttgttgcacatcctccggagggcacaaacacatgtcctcacaaggaacagaaggggaaaaggggttgaatgctgtgtgaagtctcttttgtaagagtcttaattttttcaagagggaagagccctcatgacctcatcacctcccagtggccttttcctcttaatactattgcattggaggttgcttccacataaattttggaaggactcaaacattgaaaccatagcatttcacttctgaaccccccccttccaaaatttatatccttctcacatacaaaacatattaattaaataccaatagcccccaaagccgtaactcattccagcatcaactttaaagtttaaggtctatagtcttatctaaatataatctaaatcagatatgggtgagactcaaggtgtacaattcattctgaggccaattcccctctacctgtgaacctgtgaaatcaaacagtttctatgcttccacattataatgatgggaccggcataaaattgatattctcatgcaaagagggagaaataggaaagaataaaggggtaacagtccccaagtaagctgaaaacccaatatggcaagcaccattaatttttgaggcctgagaataatcaactttgacttcgtgtttcatcttccagacacaggagagtagaggttgggtccccaaggctctgggcaaccccagcactataattttgttggtcacagcccacagagcagctatcacaggctggagtctcatgcctgcaagctctcccaggctgaagttgcatgctggtggctctgcagttctgaggtcttagtggtggccccacttctattgctccactgggcatttccctagttggggctgtctctagcagccccacctttgtggcatttccttgcctgggccccaaggctctatgaggcatctgttgaaatctaggtagacatgtctccacaactcacgtactctgtgcacctgcagagttagcaccacatggatgccaccaaggtttactgcttgtgccccctgaagtggtggcctgaagtggtggcctgcatgagctgtacctgaggtgactgaggaacattgtgtctgaatgtgtgggaaagaaacaagacatcctgagcaacaagccccatggtttcacaagtgttttgggccccttttttgaaactgttctgccctcaaggacctggtgctctgagcctgctatgagaagggcagcacagataatctccaaaatgcctttgcggtcattcttccattgtcttgatgaatagcatctgtcttccttctattcatattaaatctccttatcaaatgtttgcttggcgacacccttggcattctccctcaagcatactttaaaacctgaccaggctgagaattttttaaatctttaacttctgctttccttttaattacaaattttatatttaatttgtttctctcttcttgcattttactataagtagtcaagagaagccatgaagcaccctgaacaatttacttagagatgtcatccacaaaataacctagcccattgctcttaagttctgccttccacaaagtaataggacacaaaacacaattcagccaagttcattgctactttgcagcaagggtggcccttcttccagtttccaataaactgctcctcatttccaactaacgccttatcagaatggcctttactgtccatatttctacgagcattctgatcacaaccacttagatcatctctaagatgactgagggtttctctacagctctcctcttctgcagagctctcactggaaacatgcttaatgctttagcatgcacttcaaagctattctggcttctacccattacccaatttcaaagccacttctacattttcaggtatttgttatagtagcaccatcggttctcactactactttctattttagtttattttgtgctgctatacaaaataactgagactgggtaatttatgatcaacagaaatttatttctcacacttgtggagtctgagaagtccaagatcaagataccagcaagtttagtatctgatgaggccctggtctctgtttccaagatggcaccttgttgctgcatcctctaggggagatgaatgctgtgtgctcacatggcagaagagatagaagaaaggggacagcatgctgtgtgaagcctcttttgtaagggctttaatcctgtttatgagggaggagccctcatgacataatcactttccaaaggctccacctctgtgcagactgtttctacatgaattttggaggggacacaaacgttcatagcattagctttctctttttgcattatctttgtgttaccttggtattggtaatgccagcttcatataatgaaataggaagctttctctcctcttctgttttctttttcttttgaaaaacagagttttgctcttgttgcccaggctggagtgcaatcgtgcaatcttggctcactgcaatctacacctcccaggttcaagtgattctcttgccttagcctcccaagtaggtgggattacaggtgcctgccaccatacctggctaatttttgtatttttagtagagatgaggtttcaccgtgttggccaggctggtctcgaactcgtgacctgaagtgatctacttgccttggcctccctaagtgttgggattacagacgtgagccgtcgtgcccagccttcctcttctattttctgaaagagaatgtctaacactggtattaattcttgaaatgtttggcagaattctgtggggagatcatctgagcctgaatatttctttctttggagtattaaaataacaaattaaattggatttatagttatagagctatttaaatatctatttcatgtttcatttatctgtttcatgagtgaattgagatagtttgtgttttttgagcaattggtctttttcatctaagttgtcaaatacatgtatctagagttgttcctaatatttgttttttatccttttgatgtctacatgccctgtagtgatttctcctttttaatataggtaacttttgtcttctgtttcctttgtcagattcgccagttgttgatcttttcaaaggatcagttctttgtttaattgattttctctatggtttttgttttcaatttcattgatttctgctcttatttttattacttccttccttctgcttgcttttggattgttttggtcttctttttataatttcttgacatggaagtttagattattaatttgaggctttttttcttttctaatgtcagcatttaatgctatacatttccctctcagcactgctttggctatgtctcatatattttgattttatttattattattttttttaactgagtctcactctgtggcccaggctgaagtgcagtggtgtgatctcggctcactgcaacctccgccccctgggttcaagcaattctctcacctcagcctcctgagtagctgggattacagcacttgccaccatgcccggctaatttttttgtttttagtagagataaggttttaccatgttggcccaggctggtcttgaactcctgacctcaagtgatccacccaccttggccttccaaagtgctcgaattacagctgtgagccactgcacttggccacatattttgatatatttttatttgactcagctcagtatttttttcttgagatttcctctttgatccattgattatttaaaagtatattgcttcgtttccaaatgttcagagacgtttttgttatatttctattaaacattaatagtttaattcccttttcattaggaagcatactctgtatgagttaaattcctttaagtttgttcaggtctgttttatggcccaagatatgatccatcttggcatatattccatggacatttgaaaagaatgtgtattctgctgtggtgaattggagtgttctataaatgtcagttacatccggttggctgatggcattgttgagttgtatatcattgcttatttatatatttagttatgctattaattattgagagggggtattggactttttgactgtaattataaatttgtctccagttccgtcagtttttgtttcacatgttttgcagctctgttgtttggtgcacacacatttaggattgctatgccatcttggtggatctttttatcattatataatgtctctcttcattcctggtaatttgtttttgctttatagtctactttaccttacctgatattaatataactactgctgctttcttttgattaatgtttgtatggtatatctttccaatccttttactttcagtctacccatattgttatatttgaaatgagtttgttatagatagcatatatatatatatgtaaaaaagatgaaaaaccatgtgtttatatgtttgtgtgtgtgtattaaatggtttgtatatttaaactgtttatatttaatatagtgattgatatgttagggcttaagtttgccattttattttttattttctattatttctctctatcatttctcttttttctctattacagatagaatttctctgttataaatagcatatatatgtaaaaaagatgaaagaccgtgtgtgtgtgtgtgtgtgtgtgtgttaaatagacaatttgtgtatttaaaccatttacatttaatatagtgattgatatgttagggcttaagtctgctattgtattttttatttcctattttttctctcttattatcatttctttgttttcttctttctgcctccctgtggctcaacattttttagaatgccacttgaatttatttttaatgtttttttaaatatatttctttgtatcactttttagtgagtataataagtatgttatatatacataacatcacagtctactggtgtcagatttttgctatttcaagtgacatataaaaaccttacctccccttaaatccctttaccttctttatttatagtatcattgtcttgagtattttctttataacactgaaggttataattttgatttagtggtcagacataattagaaaactcaagagcaggaggaaagtctattgcgtttactcatatttttactcttttgtcctttcttctttccttgttgtccaatatattttcttttatgatttattttctgtttatagagcttcttttagccattattgcaggataggtccactggtgacgaattattttagttttccttcatctcaggatgtcttggtttccccttcatgccggtaagatattgtcacaggatattgacttcaggtataacagttactttctttcagcatttgaaaagtgctgtgccacttccttctggcctctatggtttggggtgagaaatacactgtcatttgaattgtacttctactacagataaggtcttgtttctctgttgctgcttttaagttgctgttcagagtcccaaaacttcccagggcggtgttcttttttttttcttttctttttttttttttttttttgtctactttgtttttcagattgggcactttatgtttttctatcctcagattcactgattcttttccctgtttgcttcattctgctgttgagcccatccaataagtttttaacttcagttagtgtacacatcaattctgacatttccatttggttcttctatatgtcttctatttttttgctgaaactttttatttgtttcaagagtgttcattattgcttgtcatatcattatgacatggctgctttgataacacagtcaagtaattttttatttatttatttttttgagatggagtctcactctgttgcccaggctggaatgcaatggtaccgtcttggctcactgcaacctccgcctcctgggttcaagcgattctcctgcctcagcctcctgagtagctgggattacaggcatgcactaccacagctggctaattttgtatttttagtagagacagggtttcatcatgttgaccaggctggactcgaactcctgacctcaggtgatctgcccaccttggcctcccaaagagctgggattacaggtgtgagccaccatgcccagccaagtaatttaaatatctcttttatcttgttggcatctgttaccttttgtcattcaaattgaggcattcttggttcttggtgtaacaactgatttttgatttaaatttggacatttaggggtattatgaaactttggaccttatttaagtcttctgttttagctggtcttctctggcagtactctagccatggaaggggtagtgctgcctgttactgctaggtagaattgaagtccaggtttcctatgtggtctgtttaacagatgaggaacggagcgtttgtggattctcaggtgggtatagatattcctgcttgcctctaggcctccactgaaaaccgctgcctggaaggaggagcaggaatacctacttactgcaccccacttgatctccactgacattatatggggatggctttgttaccattgggcagttgtgaaagccctgattcttcagtaggcttcctttctttttttttttttttttttgtagggggggatatggagtctcactgtttcgtccaggctggagtgcagtggcgtgatcttggctcactgcaacctctgcctcgcaggttcaagcgattctcctgcctcagcctccccggtagctgggattacaggcacacaccaccatacctggctaattttcatatttttagtagagacagggtttcaccatgttggccaggctggtcttgaactcctgacctcaggtcatccacccccccccagcctcccaaagtgctgagattacaggtgtgagccatcacaccagcccactagacttcctctgtaaccacactgcctgatagaggaagagacacctattacttctgggtggttctggaggttcaggctacccatatagtctccactgactttattagcaggagaaggatccgccttaccttttagccttctctctcacatcaccctggtggggaggttgggtgcctcattacaggctggcaatggcagcagcctaggtttcccattagtctttgctcttatgctgggtggtgggatgggggtaacactactttctgtcttgtttgcctgtattagagtggttattgtctaaaagctttatcttctagacaaaagataaatgcctatgctgtctcttttttgaccctttagctagagagagcaggcttttgtttttgttttgcctgtatgtgtgtgtctgtgcctgttagtgtttctgggttgctagtttctgcagcaccaagtctgagatacataagaaacacaaagaaaactcgtagaactgaccactgtgggtattcttgagtcctgcagtacctagctggtcaggcttctctcttaactttcaaattcttcttgtgtttgttgtatatataatggttactataagatatgagtaaacaaataacttgtttactcttttatcttttttataattcttagtgagaggaatgtggaaaagttctccattttttctgaaatggaagttttatattaatatctcatatggttgggatctgtgctcccacccaaatctcatgttgaaatataatcaccagtattggaggtggggtctggtgggaggtgatttgatcatgggggcaatgtctcatgaatggtttagcaaatccccttcgtgctcttcttgagacagtgagttctcatgagatctgcttgtttaaaagcgtgtagcagctcctccctctctctctcgtttctgcccctgccatgtaagacacctgttctccctttgccttctgccgtgattgaaagtttcctgagacttccccagaggcagaagcattcacacttcctgtacaacccgcagagctgtgagccacttaaacctcttttctttatcagttacccagtctcagttatttatagcaatgtgagaatgaactaatacattttgaaaaaagatttttttaaagcttatttatttatgtattttttaaactttcaggttcaggggaacatgtgaacctaaaagtttagaaaaataaataagctttaaaaaagcttacataggtaaactcatgtcacagggacttgttgtacagattatttcatcacccacatattaagtccagtacccaatagttatcatttctactcctctccctcctcccaccctccaacctcaagtagaccccagtgtcttttgtttccttctttgtgctcataagttctcataatttagctctcacttgtaagtgaaaacatatggtatttggttttctattcttggtttagtttgctaaggataacagcctccagctccatccatgttcctgcaaaagacatgatctcattctttttatggctgcatagtattccatggtgtatatgtaccacattttatggctgcatagtatcccatgatgtatatgtaccatattttctttatcaaattgctaattgatgggcattcaggttgattccatgtctttgctattgtgaatagtgctgcattgaacatctgtgtgcatgtgtctttacggtagaatgatttacactcctctgagtatatactcagtaatggtattgctaggttaaatagtagttctgcttttagctctttgaggaatcaccatactgtcttccataatggttgaactaattttcactcccaccaacagtgtataggtgttcccttttctccataaccttggcatcatctgttattttttgaccttttagtaatagtcattctgactggatagagatggtatctcattgtggttttgatttgcattactctaataatcagtgatatggagctttttttcatgtgcttattggctgcatggatgtcttcttttgaaaagtgtctgtttatgtcatttgcccactttttaatggggttgtttgtttttctcttgtatatttattgaagttccttatggatcctggatattagacctttgtcacatgcagagttttcaaaaattttctcccattctgtaggttgtctttttactctgtcgatagtttctttatgctgtgcagaagctcttaagtttaaatctcagttgtcaatttttgcttttgtttcaattgcttttggtgtctttgtaatgaaatcttggcccattcctacatccaggttgctattgcctgtgttgtcctccaggttttttatagttttgggttttatgtttaaatatttactccatctttagttgatttttgtgtatggtgtaaagaaggggtccagtttcaatcttctgcatatggctagccagttattccagcaccacttattgaatagggagtcctttccttattgcttgtttttatcagctttgtcaaaagtcagatggttataggtgtgcagccttatttctgggctctctgttctgttccattggtctatgtgcctgtttttgtaccagtaccatgctgttttggttatgtagccctgtagtattgtttgaagtaaggtagtgtgatgcctccagttttgttttttttgcttaggattgtcttggctattcaggctctttttcatttcatatgaattttaaaatagttttgtctagttctgtgaagaatgtcgttgttaatttgataggaatagcattgaatctgtaaattactttgagcaatatgaccatttaaatgatactgattcttcctatccatgagcatgggatgtttttccacttgtttgtgtcttctctgatttctttatttgagttttgtaattctcgtcatagaactctttcacctccctggttggctgtattcctaggtattttattctttttgcggcagttgtgaataggattgcctttctgatttgactctaggtttggctgttgttggagtataggaatgctagtgatttttgtacattgatttgtatcctgaaactttgctgaagatgtttaccagctaaaggagctttgggccgaaactatggggttttctagatatagaatcatgtcaattgcaaacagggacagtttggcttcctctctttttatttgaatgtgctttatttctttctcttgcctaattgcttcagctaggacttccaatactgtgttgaatagaagtggtgagaaagggcatccttgtcttgtgccaattttcaaagggaatacctagtttattgagagttttttttaacataaaggggtgttgaattttattgaaagctttttctgtatctattcaggtaatcatgcagtttttgtctttagttctgtttatgtgaagaatcacatttattaatttgcttatgttgtaccaaccttgctacctggggttgaagaatacttgattgaggtggattagctttttgatgtgctgctggattcagtttgcaaatattttgtaatttttgcatcactgttaatcaaggatgttgaactgaagtttttttgttgttgtggctctgccaggttttagtatcaggatgatgctggcctcatagaatgagtttgggaggagtccttcctcctcagttttttggaattgtttctgtaggaatgataccagctgtttgtacatctggtagaattcagctgtgaatccatcaggtcctggcctttttttagttgggagcctaatttattactgattcaattttggagctcattattggtctattcaaggaatcaatttctttctggttcagtcttaggagggtgtatgtgtccaggaatttatccatctcttctaggttttctagtttgtgtgcatagaggtttctgtagtagtttctgttggttatttttacttctgtggggtcagtggtaatgatgacacccttcatcatttctaattgtggtttttggggttttctctctattagcctagctagtagcttacctatcttgttaaatttttttttaaaatccattcttggatttgtttatcttttgaatggattttcttgtctctgtctccttcatttcagctctgattttggttatgttttgtctcctgctatctttgcagttgatttgttcttgcttctctaattctttccgttgtgatgttaggttgttaatttgagatctttctgactttttgatgtgggcatttagcgctatgaatttccctcttaacactgccttagctgtgtcccagatattctggtatgttgtatctttgttttcattagtttcaaagaacttcttgatttctgcctttatttcatgatttatctaaaagtcattcaggagtatgtcatttaatttccgtgtaattgcattcttttgagcaagtttcttagtcttctgtttttattgcactgtggtttgagagtgtgtttaatacggttttggttcttttgcatttgctgaggatagtttaatgttcaattatgtgatcaattttagagtatgtgccatgtggcaaggagaagaatgtatattctgttgtttgggggtagaaagttctgtagagatctatcagatccatttggttcactgtttagtttgggtcctgaatatctttgttaattttctgcctcagtgatctgtctaatactgtcaatggagtgttgaagtcttcaactattaatgtgggtgagtctgtgtctctttttaggtctctaagaactcgctttatgaatctgggtcctcctgtgttgggtgcatatatatttaggatagttaagtcttgttgaattgaaccctttgccattatgtattgccctttttttgtgttttttaatctttaaattaggattgcaacccctgcttttttctgttttccatttgcttggtagttttcccttcatttctttattttgaggctaagggcatcgttacttgtgagatgggtctcttgaagacagcatgccattgagtcttgtttttttatccagcttgccactctgtgacttttaagtggggcatttagcacattgacattcagggttagtattgatatgtgtggatttgatcctgtcattgtattgttagctggttataatgttggcttgtttgtgtggttgatttatagtgacactggtctgtgtatttttgtattagcttatagcagtatttcatttctgtatttagtgcccctttataaatgcttatttaaaaagacatcacttgcagttgtgatgaaacaccccagaaataaatacaaacaattgaatttatttgctttttaaaaaaataactgattctctatatgtagcccaaattacttctgctattgctctacttcaatggtgatttcatacttctcattgtaaaagcatcatcaataattattcagtcatttctcctaatagtgtttactgtgttaatagtttcatctctctatgaagaaatagtaaatagtcatacacacacaaatacatacatacccacatacagttatatttgagtacttttgtttctgggagaattgctggggaaaaggctgtatatgttaattttaatggatatgtttagactgctttccagaaaggctctaatagaataatacatttcctccaccaatttagaagtagccttttccctgccaacagtacatctgaattagattttaaatttgtacccatatgattggtataaaattatatcttggtattacttaatttgtatttctttaacctttagagtgtatgagcctcttttcttatttgttagccacgtgggcactcaattgtggattgcccatttatgaccttttgcctatatttttctattgggtggttgtccatttataaaatctgtttatagcaatcttctgtttatactctgaattggatacatcctttccaaatctattatttgtctcttgatttgtttactcttttatcttttttgtaacagcatctgggttttcattcttatttagatgtccccttcctttaaatagtacaagtagattttaagatttctttttgcaaaatttttattgttttggcttttaaagtcaactctcttctctatctggaatttatttgtgtatacagtgtaagagttttcttttaaatggatactcagttgtgtaagcattacttaataaattgttttcccactaaattgaaatatagacaatcctagacttataatgatttgacttacaattttttgactttatgatagtgcaaaaacaatactgtactttgaatttggaatcttttcctggactagcaatatgcggtaggatactccctcataatgctgggtaacagcagcaaactgcagcttccacttagccatatgatcatgaggattaaaactgatcctctacagtgtactgtgtcactatgttattttgcccaactataagctaatgtaaatgttctgagtacacttaaggtagactaggctaagccatgaagttagttttattaaatgcattttctaattaaggatgttttcaatatatgataggtttatcaggatgtaatcccataataagtcaacaagcattggtatttacagattctctattctcttctaggaatttgtctattcctatgccagtatatactgattttgttacattggcagtatagtacatgcaaatacacacatacacacgtacacatggggtggtgaaaatactcttatgaggctgagtttgactatagtaattaagaatggagttgcttctcaatgtcaagtctccagttaaaatggtgtgtgtgtgtgtgtgtgtgtgtgtgtgtgtgtgtgtgtgtgtttgagatagaatctcactctgtcacccaggctggaatgcagtggtgtgatcttggctaaccccaccctccacctcctgggctcaagtgagtctcatgcctcagcttcccaagtagttgggattacatgcatgtaccaccacacgcagctaatttttgcatttttagtagaagaagggttttgccattttgcccaggctggtctcgaactcctggcctccagtgatgcacctgccttggcctcccaaaatgctgggattagagccgtgaaccactgctcctaggcctaaaatgggatttaataaagagcccaatggatggccatcgattcataactactcttgatgttgccagatcatatttcacctttgtaaaatattgaaaaataaatgtataccatttagtgagagccaggttttttttatagatgagaaagttgatactgttctaagtgttaatttatttgcccagtattatttacttattacatggtaaagttagggttacaatattaaattgaagctctttttattgtgccaaaatgaaatattttatgaaaagtactttgaaaacaaaggtgtatgcaaattgatatgatggctatctcatgatcatctccacaatagtagcaactctgagttttatttagaaacaatgcaatggtttatgtacaataaaagttatagccaattatttataacagaacaattatattttgatgttttctttcaggatatggtctatgaataaaatgttagaaattaattttattctttaaaaatctcaataattggttcttttaaacattttttagaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggtaaataagctttataaaacttgttttgagtaaaacatgtacagaaaagcacataaaatacagggttagctcacgatatagtgctttgttttattgcacttcacaaatactattgttttgttttgtttgagacagagtctcgctctgtcacccaggctggagtgcagtggcgcaatctcagctcactgcaagctctgcttcccgggttcatgccattcgcctgccttagcttcccaagtagctgggactacaggtgcccaccaccacgcctggctaattttttgtgtttttagtagagacagggtttcaccgtgttagccaggatggttttgatcttctgacctcatgatctgcccccctcggcctcccaaagtgctgggattacaggtgtgagccaccgtgcctggccggttttttttttttttttttttttttttacaaattgagggtttgtggcagccctgaattgagcaagtttacgggcaccatttttccaaaagcatctccttcctttgtgtctctatataacattttggtaattcttgtggtatttcaaacttttcattactataacatctggtatggtcatctgtgatcagtgacctctgacgttactgttataattatttggggtaccgtgaagtgcacacatgtaagacagcaaacttaattggtaaatattatgtatattctggctgctctactaatcaatcatcctctagtctctttccgtctcctctggtctccctactccctaaggcacagcagtattgaaattaggtcaattaataaccctaccatggcttccaagtgttcaagtagaaggaagagttgcatgtgtatcactttacataaaaatgattaagcttagttcggaaggcatggttgaaagccaagataggccaaaagctaggcctcttgcaccaaacagttagctaaattttaaaatgcaaaggacacattcttgaaggaaattaaaagtgctgttccagtgaatacatcaaaggtaagcaagcaaaacaaccttattgctgatatggagaaagtttgagtagtctggatagaagatcaaatcagccacaacattctcttgagccaaagcctaatccagagcaatgccctctctctcttcattctaagaaggccaagagaagtgaggaagctgcagaagaaaagttggaagctagcagaggttggttcattaggcttaaggaaaacagctgtctccataacataaaagtacagtgtgcagcagcaagtgctatggagaagctgcagcaagttatccagaggatctagccaagatcattgatgaaggtggctacaccaaccagtagattttcaatgtaaatgaaacagccttctgctggaaaaagataacatctaggactttcatggctagagaggggaagaagttgatgcctggcttcaaagcttcaaaagacaggcttactttctcgtcagggaataatgcagctggtaactttaagttgaagccagtgctcatttatcattctgaaaatcctagggtactcaagaattatgctaaatccattctatctgtgctctataaatggaacaataaagcctggatgacagcacatctgtttacggcatggtttactgaagccctatgtggagacttactgctcagtaaaaaaatatttttttcaaaatattactgctgattgacagtgtacctagtcacccaagagctctgagggagatatgaaaggagatgaacattgtctatatgcccataccacaacatccattctgcaacccatgaatcaaggagcccttccaacttaagttttattatttaagacatatattttataaggctgtaggtgccatagagagtgattcctctgatggatctgggcaaagtaaattgaaaactttctgggaaggatttactattctagatgccattacaaacattcatgattgatgggaagaggtcaaaatattgacattaacaggagattagaagaagtttattctaatcctcatggatgactttgggttcaagatttcattggaggaaataactgctgatatggtgtgaatagcaagagaactagaattagaagtggagcctgaagatgtgactgaattgctgcaatcccatggtcaaacttgaagagataaggagttgtttcttatgggtgaacaaagaaagtggttcttgagatggaatctattcctggtgaagatgctgtgaaagttgttgaaatgacaacaaaggattgagaatattctgtaagcttcactgataaaggaactagcagggttggagatggtaaaatgctatcaagcagcatcacatgctacagagaaatattttgtgaaaggaagacttaatgcatcaaacttcattgttgtcttattttaggaaattgtcacagacaccccaacctttaccaaccaccaccccagtgagtcagcagccactaacatgaatgcaagaccctctaccaatagaaagattatgacttgttgaaagactcagatggttattaatacgttttagcggtaaagtatttttaaattatgtacattgttttttggacataatgctatcacacacttaataaactaagctacaatgtaaacttagttttaaacatttttttaaattattattatttttttgagacagagtctctctctgtcgcccaggctggagtgcagtggcatgatctcggctcactgcaacctctgccttctgggttcaagcgattcttgtgtctcagcctcctgagtagctgggattacaggcaagcgcaatcacgccctgctgatttttgtacttttggtagagatggggtttcaccgtgttggccaggctggtctcaaactcttggcctcaagtgatccgcctgtctcagcctcctaaagtgctgggattataggtgtgagctaacgcgcctggcttataaacaacttttatatgtactgggaaacaaaaaaaattgtgtggctcattttattacaatattaactttattgtggtagcctggacctgaacttggaatatctctgaggtatgcatgtatagatatgcagctcagtgaactatcacaggtgatgcaagttaaccattgccaagttcaatgactagaacattgccattgtgcagaaaccatgctttctgccactatttccttctcttccacaaagatgatgacattcctgacttcggagtagttttacctgcttgttagtttataaatagcatcatttcctatgtagtcctttgagtatgatttcctctattcagtgtatttgtgagatttattcataattgcatatagcagtaattttcattgctgtataatactttataaatatagcacaatttatttttgttggagaaatgtggtgttttcagtttggggctataatgaataatttttctgtgaacagtcttgtgcatgccttttagtatgtatatgtgtaaatttcaatttttggagttagttgcagggtcagagctcaacttcagtaaatacagttgatccttgaaaaatatgggtttaaactgcataggtccacttatatgtggattttttccaaaaaatattttggaaaaattttagaagattttgggtaattgttcaaatctcaaaccatgtagcctagaaatactgaaaaaattaagaaaaagttaggtatgtcatgcataaaatgtatgtagatactagtgtattttatcatttactaccataaaatatatacaaacctatcataaaaagttaaaacttatcaaaacatacacaactacttactgtacatggcaccatttgcagatgagggaaatataaacaaatgtaaagatgcagtactaaatcataactgtgtaaaatcaactgtagcacacagtgtacctactatactactataataatttaaaacacctctcgttgctgttgcagtaggctcatgtgttgcaagtgttggcttaaacctcccgatgatgctaatcatctctgtgtgagcagtttgtctctccagtaaattgcatagcatagaaaatgtgatctatctgggttctcatgtattttttatcatgtttagtaaaatactgtaaaccttgaataacaccattgggcctatggaaagtaccactagtgatgctaggagtgttctcgagaaccagaggaaagtcatgacattacaagaaaaaattgaattgctttataagtatagtagagtgaggtctgcacctgctgttggctgccatttcagacagacaacaacgtgaacttagggtattgataaatacagtacattactataaaggtattttccttaagattttgttttctctagtttattgtaagaatgcagtacataagcatgcaaaatatgtgttaacttattgtctgcattattaaagcttccagtcaacagtaggctgttagtagtaaagtttttgggcagtcaaaagttatacttaggttttcaactgaccaggggttggcgccccaacctccatattgttcaagggtcagctgtacttttaaattgttttccaaaagtttgtgtcaatttatactttagcagcaggatatgaatattccaggtactctatatttttgccaatgcttggtcaagtcttttatattttatccattctggtaagtatgcagtgatacctaattttggtctaatttgcatcctttgatgaataagactgaacaccttttcttatggttattggatactgatatcttactaagtgaagtgcctttccaaatcttttttaattgtgttgcctttttgtttttaagactggattataaagagttctttctgtatttcagaaatgagtgttttgcacatattttctcccattgtgcttggcctttttttgttcttagtggtgtcttttgatgactagaacttactaattatattaatcagtctgccttttccttatttggtgttttctatgttcaaatatatatatatatgtatatatatatgtattttgtttttggagacaaggtctcactctgtcactcaggctgaaggacagtgatgcaatcacggctccctgcagcctcaatttcccaggctcaagtgatcctcacacctcaacctcctgagtacctgaaaccacaagcatacaccaccacacccggctaatttttaaatgttttctagagtttgggtctccctgtgctgccaagtctggtccaacctcctgggcttaagtgatcctcctgcctcagcctcccaaagtgttaggattacaagcatgagccgccacacctgaacaaacaaatatttttctatctcaaaattataaagatttttcaaatccttctagaagctttattatttgacttaaacatttcaattaacaatatcctggaatgttttgtttgtttggcattaagtagtgatcaagattaatgttttgttccaaaagttctccaaacccttggcctgctacaaattattttaaaaattgcttcctacagctctacaaaggtcagtttaatcataatccaagtgtccataactgtgtaggtctgtttccacatgttctgcttagttccatttatctacttgttcatccttgtgctactaccacacggtcttaatcactgtaacttcatgataggtatctagtacagtaattttccaattttgttttccttctttaagattgccattttacattttcatataaatgtttaatgcagcttgttgttttccacaaattattcagctgagatatttaattgggataacaattatatatggatcagttgtggagaaattgacattcaaattgtattgactctaaaacccataaatagatccattaatttagatcttttaaagttttttcaggctgggcacagtagctcatgcctataatctcagcactctgggaggctgaggtgggcaggtctcttggggttaggagttccagaccagcctgggcaacatggtgaaaccccacctccaccaaaaaatacaaaaattagccaggtctggtgacacgcacctgtgatcccagctactcgggagcctgaggcaggagaatctcttgaacccaggaatcggaggttgcagtgagcagagatcatgccactgcactccagcataggcgacagagcaagactgtctcaaaaaaaaaaaaaaattaacgttttttcaataatgtgttgcagctttttgtacatatgggatattttttcttacatttattttttgtttttagatgattattgtaagtggcattgtgtctcaaatttcactttctaattatatttagtatatagaattaaaactgatttttgtctaacaaccttgttaaattttatttatttatttgagacagagtctcactctgtcacccaggctgaagtgcaacagcatgatctcacctcgctgcaacctccgcctcccaggttcaagtgattctcctgcctcagcccctggaatagctgggattacagacgcctgctgccacacccagctaatttttgtatttgtagtagagatggggtttcgtcatgttggccaggctggtctgaactcctgaccacaagtgatctgcctgcctcggcctcccaaactgttgggattacaggtgtgagccaccacgcctagcttattttttaattctaatggtttctctgtatattatacatttttctcttatttgtgttgattagaatctccaatacaatatagaatagaagtgatgataacaagtatccttgtttcattcccaatctcaaagaaagctttcattgctgaaaatctttatttcatcattgaaattgtttatttaacttgtggctggttgtgatggcttacacctgtaatcctaacacttcaggaggctgaggtgggaggattgtttgaggtcaggacttcaagaccagccagggaaacctaggaagactgcatctctacaaaaaataaatgaattagccaggcttggtggtgcacaactgtggtctcagcaagttgggaggctggggcacgaggatctcttgagtccaggagtttgaggctgcaatgagctctgatcacatcactgtactccactgtctcaaaaaaaacttttctcgctgggcgtggtggctgaagcctgtaatcccagcactttgggaagctgaggtgggtggatcacctgaggtcaggagttcaagaccagcctggccaacatggtgaaaggccgtctctactacaaacacaaaaaatagccgtgtgtggtggtacgtgcctgtaatcccagctacttgggatgctgaggcaaaagaatcgcttgaacccgggaggcagaggttgtagtgagccaagatcacaccactgctcttgagcctgggtgacagagcaagactccatcacacacacacacaaaaaaacaaaaacaaaacaaaaaaacttttatcatgttactattaaatatgatgtgtgctataggctttttataacatttttgttgaaatgtacttgacagaacataaaattcagcatttaaaaatgcacagacacttcagtggtttttagtctgtttagcttgtgcaaccattaccactctctgatgctagaacattttcatatcatcagaaaataaaataaaaccatatctattagcagttagcaattctctgatctcccctcttctggcaaccactaaccaactttctgtctctggatttgtctattctggacactttatataattgaaattatacaatatgtagccttttatattttgctcctttaatttggcataatgttctcatggcttatttgtagtgtagcatatagcagtactttgtacctcatctctctctttttttttttttttacagaccaggtcttactctgtttgctctgttgcccaggctgctggagcacagtggcataatcatgatcatagctcactgcaacttaaatctcctggactcaagcagtcctctcacctcagcctcttgagtagctaggactacacacgtgtgccaccaagcttggctaatttattttttttgtttggacggcatctcactatgttgcccaggctgggcttgaactcctggcctcaagtgatcctccctcttcggcctcccaaattgctgggattacaagagtgagctgctttgcctggccttcatttctttttgtggctgaataatattgtatgaatatgtcacatactatttatttgttaatcagctaatgacatttgattacattctgggtcttttggctatgttacagctgctgtgaacattctaatacaagtctgtgtgaacatagttttgtggtttctctagggattacaattaacatcttaattcatagctgtctacttagaattaatgcaaattttaaaaagtacaaaaactttgcccctgttccactgccctttatgcctgttcttattatttattattgtcacagattaaatctttagatattatgttctcatcaacctagatttgtagttactgctttatgcagttgtcttttgaattaggtttttaaaaagaaaaggaattacaagccaaaaatgcctttatagtgtcttttccacttacctatgtttatacctttcttggcatttatttttccatagggagttgagttactgtccagtgttattttatttcatccctaaggactccctttcgcatttgttgtagggcaggtgtgctagcagtgaactctctcactttttattttactgagaatatcttgatttatccttcattttgaaggatagttttttccacatatattaattcttggtagaattttttttcaccacttttgattacataagctattacctgctggccttcatcgtttctgattagaaatcagctgttaatcttattgaagatttctcaaaatcatgagttacttctttggggcattcagtattctcctgtctttagctttgatggtttgattatgatgtttcttaatatgggtctgtagcaggatgagccgcaggcaagaacccctcagacaccaagttgtagaaggagagggctttatttagctgggagcattggcgggctcacgtctccaaaatccgagctccccaagggagtaattcctgtcccttttaagggcttacaactctaagggggtccacgtgagagggtcgtgatctattgagcaagcagggggtacgtgactgggggatgcgtgcaccggttattagaacggaacagaacaggacagagattttcacagtgcttttccatacaatgtctggcatctatagataacataaccggttaggtcaggggtcgttctttaactaccaggcccagggcacggcgccgggctgtctgcctgtggatttcatttctgccttttagtttttacttcttctttctttggaggcagaaattgggtgtaagacaatatgaggggtggtctcctcccttaggtccattggaatttatcctgcttggagttcattgagcttcaaattttggaagatttagaccattatttctcaaaatatttcttacctgctctctcctctttctcccactcctccccaccaccttctggcacttccattgttcatatattgatatgcttaatgatgtttctgaagatttattcatttttcctttattcctttttattctgttcctcagcccagatcatttcaatgcacatatcctcaagtttgctgattctttcatttcctgctcagatctgctgttgagcccctctagagaattttttatctcagttattacacttttcaactccagaatttctatttgccctttaaataacttaatctgttgatattctgaatttggtggtgcattgttcccatactttcatttaattctttagacatggcttcctttagctcattgaacatatttaaaatagatgattggcctggcacggtggctcacgcctgtaatcacagcactttgggaggccgaggcaggcagatcaccggaggtcaggcgtttgagaccagcctggccaacataaccctgtctctactaaaaacacacaaaattagccgggtgtggtggtgggcacctgtaatcccagctacttgagagcttgaggcaggagaatcacttgaacccaggaggttgaggttacggtgagccaaggtcacaccactgcactccagcctgggcaacagagtgagactccgtctccaaaaaaaaaaaaaaaaagatgatttaacgttttgtctagaaagttcattgtctggtcttcctcaggcacagtttctatttttttctttatgtcagccatactgtctcatttctttgcatagcctgtaatttttcattgttgaaaattgcacattttggctgggcacagtgattcacacctgtaatctcagcactttgggaagctgaggcaggaggatcactcgaggccaggagctccagaccagcctgtccaacatggtgaaaccctctctctactaaaaatacaaaattagctgggtgtggtggtggacagctcctcaggaggcttaaccacaagaagcgtctgaacccgggaggcagaggttgcagtgagaagagatcacgccactgcactccagcctggatgacagagtgagactctgtctcaaaaataataataataataacgaaaattagacattttaaatgttataaatcagcaattatgaaaatcagatctctactttttaaaggatttgtagtattgggcttgttgtagttgtttgtttttagtgagttttctgaactaattctatgaagtctctattttttgttatgtgtagccactgaagtctgttacattagctgggtaatcagctaataattggaaagagattttcataaatgcctggaagcaaaaattctttccatctttaccttgggctctgtattggtttacaattctgccttaaccttttttttttttttttttccccgcttctacatagccttaatgtcagcagcaggtgagagcttagcgccttctcagaactttcctgagtatgtgcgcagccttgaacatgcacatggccttctaggttcccaggaatgtcaacatttcatgcctcagcctttcctctcaaactttttggtttgcctattgtttgcaccaactgttttaataacttcatgcatcatacaaagacaatattctgtaaatttttttaacaaatgcccccagggaaacagccttagcataaggctagttttaagttaaggaaaataaatacaagccttttaaacctgtcttccagggaggtaccaaacaggacagaacaaataatttccattctttgcaagttagttcattctgttccttctagtactggtaatacaggttgtgatgttcacaggttgtggtcacccaggaacagtgggtaggactagaataaattaatgtgccgtaaagttactgttctgatcaaaaatcatatgtctgtctttctgtctgtctgtattttgttctttctttcttttctctctttctttctcttttttgatatgaggtctcgctctgttgccaacgctggagtgctgtggcgccaccatagctcactgcagccttgaactcccaggctcaagcaatcctcccacctcagcctcccaagtagctgggactacaggcatgtgccaccatgcctggctaattttgtaattattttctagagatggggtctccctacattacctaggctcgtctccaactcttgggcttaagcagtcctcctatctcagcctcccaaagtgttgggattacaggcatgagccactgtaccaggctctagcctggttttcttgagtgtatcttactcatgatgctgcaagccttttgttaatttctggagttcagaaaaagtcgattatatagttttggctttttgttgttgttgcttttatggaggggtggaatttggagtttcttactcttctgattttgtccacatcagtctaagtttttaaaaaatcaagttgagaagttttctttctagttttgctaaaaaatttttatttattacaaatgaatattgttaagtattatcaaatatttatttttgcatctattaagatgattgtgtgatttttcacctttgttttgttaatgagataaagtataccaattgattttctggcattaaatcactttatttttctggaatgaaccttctttggtcctatgaaatattattctttgttatttgatttgatttgctatctttttaggatttttgcttttatgtttatgagagagattcacctgtgattttcttttcttatttgtcaggtgtggtgtcagttacatgcttgacttataaaatacgaatttttttatcaagtttttattttaaaataaataaaattatagattgatgggaagtttccaagacagtacagaattcctctgtacctgtcacccagtttttcctaatggttacatcttttgtaactgtagtacaatgtcaaaaccaggaaattgacatttgtacattggctgtttatagttgtatgtcatttcatcacctatagatttattaaccacttctccaaacgaggtatagaactatttcattgccacaaaaatgtcactcatacttctccttaataatcacacctgttgatgaaaaaagccaagttcagttaaatatttaaagaggtttattctgagccaaacgttagcaaccatggcccatgacacagcctcaggaggtcctgagaacaggtgcccgaggtggttgagttacaacttggttttatacattttagggagacaatagttacaggcaaaggtataaatcaatacgtataaggtatacattggtttagctcagaatgtcaggacatttcgaagtaggggcttccaagtcaaagatttcctgattgggaattgattgaaagcattaagctttgtctggagaattgaagtcaatataaagaaatgcttgagttaagataaggggagttgtagaagccagggttcttgttatgcagatgaagcctctaagtaacaggcttcagagagaatagatggcaaatgtctctttttttttttttttttttttgagatatggtctcattctgtcacctaggctggagtgcagtggtgtgggcaactgtcttatcagacctgaaaaggtgtcatattctccagaagagatatctggaaaagacctagtaagggaaggagattctctgcagaatacaaattttccccacaagagacggctttgtagggccactacaaaaagtgtcaaataaatgtatttggggacaaaatactttgatttcctttaagccctgttcctttcttgtgataatataccaaaggttggaatttggtatcctattgctacaaagaatctgttttgtcagtcttatgatctccattttaatgttaatttttggtcagttgtgcctaaactccaaagggaggagggtataatgaggcatatctaacttcccttcccatcatggcctgacctagtttttcaagttttctttgggatcccttggacctcagtggaggtccataaatttggtttggggagcttcaaattttagttttggtttacatacctatcccctactcaccctccttaacctctgacaaccaattctctacagttttgtcattttgagggtctaatgacattgatgatctaatatcattttgaggatctaaatggaatcattcagtatgtgacctcttgagatcaacttttatagttagcataatgcccttgagattcatccaaatgtttgagtgtatcagtagatttctttttattgctgaatattccattgtatgcctgtactacagttcatgtaattatttctctatttaagaatatttttggccgggcatggtggctcacgcctgtaatcgcagcactttgggaggccgaggcaggtggatcacctgaggtccagagtttgagaccagcctgaccaatatggacaaacccatctctactaaaaatacaaaattagctgggcatggtggtgcatgtctgtaagcccagctactcgggaggctgaggcaggagaatcacttgaacccaggaggcggagattgtggtgagccaagatcatgccattgcactccagcctgggcaacaagagcgaaactccgtctcaaaaaaaaaaaaagaatattttcattgtttccagttgttgtttttttttttgtttttttttttttggagacagaatcttgctctgtcacccaggctggagtgcagtggcgcgatcttctcagctcactgtaacctctgcctcctgggttcaagcaattctcctgcctcagcctcctgagtagctgggattacaggtgcatgccaccatgcccagctaattttttgtatttttagtagagacagggtttcaccatgttggccaggctggtctcaaactcctgacctcaggtgatctgcccgcctcggcctcccaaagtgctgggattacaaacgtgagctacggcacccggcctgtcacccagttttacactaaatatggatgttcctgaaactgtcataatactggtaggtgtgtgatttttgtatgttaatgagcatataatgaggttctaggtgaaacctaggtcaaatccagtgccatgtgggaaccagttggtcttagccagcttgatctactcctgggttttcagggtcttatcggtccctagctgcagctatttcaatagattccttttgctagtcgtgtgaaactgctgcctgaaattttctattctcccgcgatcaccttgtattattcctctcagggaccaccttgtattattcctttctcagtatgtggctcttgagcaattgaaatttgactagtatgactgagagactagattttaaattgtgttggcctgtaaatactttaaattttactttaaatagtttcaactgacagctaccatattagacagcacacatctgtaggctgtgtaatgatgtcctccttttcattcctaatattggatatttgtatattcttatattcgctcgctgtctccttttcaggccattaagttactggtcttttcaaagaaccatcttttgcctttttgagtctgtatattgtatgcttgttttctttgttactgatttcaactgttttattttttctttcattttactttgagtttaatttgcaatttttatctctcctctaaagatgaagaattactatactgatatttagactttcttgtaatataggtattaaaggctataaatgtccctctaggatcagcattagctgaaaagccagttttaataatttgtgttctgatttcccatttacttaaaacatatttctagttcttcttgtgattgttttcttgacccattgattctttatgagtctgtttcttaatttacaaacacatgaggatgttctagttatctttttgttattaatttccagcttaattgttttgtaatagaacacactctgatttcagtcctttgaattgtgttgacactggctttatggactactctgtagtcagctgttttaaatatttgatgtactgagagaattgtatatctgtgggttcagaattatatatatgccaattaattaaagcctgttaactatgtttttaaatcctttgattattattagtttggggttgcttgtttgaccagctacagccagaaatgttaaaaacctgttgagataatgtatgtgtcagttttttcttgctcagttaacattttgctttatatattttaaggctattagtgcatttgaatttcacatttttatatctttggtgaatcaaagcttttactatataaagtgttgcagtttatttctagtaacttttctgctttgggtttttttgttattgtttaatattaatataactaatcgagctttcttttggtttttgtttgcatgttatatatttttccattttgttacatctttgtttcttatatgttaagtgtgcctgcttttgtgcagtttaaaaaactctagtgtgacagtattcaaattttatttaaagcattcattccattgttatgtaataaaactactttagatctgtcatattactgtttgggttttttatttttttgcttttgtacctcttgtctatgtactttttttttttttttttttttgagttgaagtctcactctctcgcccaggctggaatgcagtggtgtgatctcagctcactgcaacctccacctcccaggttcaagcagttctcctgcctcattctctcgagtagctgagactacaggcatgcgccaccacacccagctaatttttgtatttttagtagagatgaggtttcaccatgttggccaggctggtctccaactcctgacctcaggtgatccatccaccttggcttcccaaagtgttggaattacaggtgtgagccagcatgcctggcccaggactaatttttaatattccatttgtacttcatgttctaagttttttttctcacttaagtcttttgtattgattaatttactgtactccatgtcccctttttaacagctttattattgatataccaatgatataaaaataaactagacatatttaaagtgtaccatttcatgctctttgacatacagatatacctgtgaacccgttgtcagaatcaagatattgaacatgtagattttcctcacaagtgtctttacaaccctttgtaatttatcatactcatccttcacctatcttcaggcaaccagtgatctgctttctattatcatggattagttttcttgctctgcatattatgtataatcatacagtgtaaattctattttgtctgacttctttcactaagcataagtctgaaatttattcatgtttgttcatgtatcagtggcttgcctttttttgtgctaagtaatattctattgtatgagtatattaaagttttttaattcattcactatttcatggacatttgagttgtttctagttttttgaccatcattaataaatctgctatgaagattcaagtgcaagtcaagtttttgtgtggacatatgctttcatttttctggagtaaatgccttgtgggagaatgactagaacctgtgataggtatagtttaaccatttaagaaactgccagtctattttctagagtagctgttgatttttacattcccaccagcagtgtgtgagaagtgcaattgctccacatcctggcctacactttttatcatcaccctctttaattttagtcattctagtggatgtgtaggagtacgtcgttgtgattctgattttcagctccctaaagattaataatgccgagcatcttttcatgtgttttccatttgaatatcatgttttatgaaatgtccattcagcactgttgcccactttgtcttattgctcagtttaagagtttgttatataaatcagatagacgtgctgtgttcctgtatgttttgcagatacgttctcccatcatttggcctgctttttattttagtaaaagtatcatttgaagagtaaagtttttaatctgtatgttcaatttttttcttttatacttctttttatatgtcataattaggaaatctttgccaaactcaaagtcgctaagattttcttctgtttctttctagaagtttttgtttgtttgtttgtttgtttttagacagagtctcactctgtcgcccaggctggagtgcagtggcgtgatatcggttcactgcaacctccaccccccgggttcaagcaattctcctgcctcagcctgccgagtagctgggactacaggcgcatgccaccacgctcggctagttttttgtattttttagtagagacagggtttccctgcattagccaggatggtctcaatctcctgacctcgtgatccacctgccttggcctcccagggtgctgggattacaggcatgagccactgcacctggcctctagaagttttatagttttatcttatatttaggtttctgatctatttaaagttatcttttttgcaaataggtgaggtaagggtcaaagtttatagttttttgtttccttctttttgagacagggtctcactgggtcactgaggctggagtgcagtggcacgatcttgcttcactgcaatctctgcctcctggctcaaatgatcctgccgccttaagtaagcctcccacctgagcctcttgagtagctgggactacaggcacacggcaccatgcctagctaatttttgtacatattttaaatagagacagggttttgccatgttccttaggctggtcttcaattcctgggctcaagtgatccacccgccttggcctcctaacttccttgggattaaaggcctgagccacctcacctggccattttgtcttattcttgatcttgaaagcattcagtcttttaccaccaattatgttaggtgcaggcttttaacagatgcccttaatctaggtgaggaaagttacttctatttctagtctgctgagagtatttatcatgaatagatctttttttctgcatctaatagcatgattgtgtggtctttttcttttatctgttaatatagtgaattctactggtttattttaaaatcctaaaccagacttgaattcctggaataaacttcatttggtcattatgtattagccttcttatatattgtggatttagtctgcaaattttcttttcagtttatgtctgtgtacatattggtctataatttagttttattttaatatttttgtctattttttttatgtccagtgacagtgatattgaccttatagaacacattgggaaatgttccctcctctgtgtagaatttcatctatttcttcttatgggagttttgatggtttgtgcatttgaagaggtctgaccatttcatctaacttgttgagtgtgctggcatgaattgtttctaatagttccttattttaacttctatagaatttatattgatgtctcctctcttatttctaatattactattttgtttcttctctgttttagcctctcttgagctacatcagcttttggtttcatttatttttctctgtttttttcagttttgtgtgtcattgatttctgctcttacatacctgtcttctacttagtctgggttttttgtttgtttgtttgttttttctgagacggagtttcactcttgttgcccaggctggagtgcaatggcgcgatctcggcacactgcaacctccgcctcccgggttcaagcgattctcctgcgtcagcctcctgagtagctgggattacaggcatgcgccaccatgccttgctaattttgtatttttagtatagatgggattactccatgttggtcaggctggtctcgaactcccaacctcaggtaatccgcctaccttggcctcccaaagtaccgggattacaggcgtgagccacctcgcctagccttggtcttccttttctaatttcttaaggtggaagattaggttgatttgagaacttccttctttttctaagtgttaatgctttaaatttcctctgagcattggtttctttaaatatagtttatgaccgggcacagtggctcatgcatgtaatcccagccctttgggaggctgaggcagttggatcacctgagatcaggcgttcgagaccagcctggccaacatagcgaaaccctgtctctactcaaaatacaaaaattagccaggcgtgggggcatgcacctgtaatctcagctacttgggaggctgaggcaggagaattgcttgaactcgggaggcagaggttgtagtcagccaagatcacacgactgcactccagcctgggtgacaaagtgaggctcagtctcaaaaaaaaaaaaaaaaaaatgtagtaacagatggtattttacagaaatctttctgacactgcctcctgtttgcatatggtttttagtcttattattatttaggtgttactatcacaggaaagaggtccagatcctagaccccaagagagtgttcttgaatctcacacaacaaagaattcagggtgagtccacagtgcaaagtaaaagcaagtttattaagaaagtgaagggctgggtgcggtggctcacgcctgtaatcccagcactttgggaggctgaggcaggcggatcacctgaggttgggagttcgagaccagcctaaacaacaaggagaaaccccgtctctactaaaaatacaaaattagccgggcgtggtggtgcatgcctgtaatcctagctactcgggaggcagaggcaggaggattgcctgaacctgggaggtggaggttgtggtgagccaagattgcgccattgcactctagcctgggcaacaagagggaaactccatctcaaaataaataaataaataaataaaaaataaagaaagtgaagggatgaaagaatgactactccagatcgagcagccccaagggctgctggttgctcatttttatggttatttcttgatgatatgctaaacaaggggtggattattcatgcctcctctttctagaccatccggggtaacttcctgacgttaccatggcatttgtaaactgtcatggtgctggtgggagtgtagcagtgaggaccaccagaggtcactcgtgtctccatcttggttttggtgggttttggccggcggctttactgcaacctgttttatcaacaaggtctttatgacctgtatcttgtgccaacctccttcctgtctcatcctgtgacttagaatgccttaactgtctgggaatgcagcccagtaggtctcagcctcattttatccagcccctactcaagatggagttgctgtggttcaaacacctctgacattactgtttttgaaatttgaggtaagcgttaaattcatttatatataatattaatactgacatttgggggttaagtctattaggatttgctgtttatccttcttgtttcaaatttgttcctgtgtcctcttttgctttcttttggattaatatttaatattttgtttctcctttctatgaaattgatgcagttctatactcttttcattttatttttactggataatttaccacaggcttgtttgaatttctttgcctttttccagaaaatgcaatgggcttagaatctttacctcatctgtcttcctcctgccttttgtgttaggagctaattttatctcctcaaaattcatgttgaagtcctgacccccattaccttagaatgtgaccttatttggaaataggatctttgcagatgtaattaaatgaggtcatactggagtttttatctgtagaactgtgtgattaagcagcatttgctctcctgggttcctttgtttcaaagcctgtattctctttctcattgaatttgtatctgtggtttctgtggttgaacttaccatagaaatgtgcacacattagactctcagtaagtacttgttaagttaatcaagcacccaattagtcatggtgacctctgctgagagagcataatcttgggaagagtgggagacaagatcctggtctctaaaggttgggagacttgaattctaggtacgttttgtttgtttgtttgtttgtttgtttgtttgtttgtttgttttgagacagagtctcacaatgtctcccaggctggagtgcagtggtgcgatctcagctcactgcaacctccgccttctgggttcaagtgattctcctgcctcagcctcccaagtagctgaggttacaggtgcgcaccaccatgcctggctaattttctgtattttttagtagagacggggtttcactatttttggtcaggctggtctcgaactcctgacctcacgatctgcctgctttagcctcccaaagtgctgggattacaggcatgagccaccgcgtccatcctgaattctagttttaacatcaccatttattatctttatgatctgagttttagttttcttatcatttagtatcttataaaagtatgaaattatctcctctttctattttagagataagagaatatgtggtaaaaaacattttataaactcaaaaaccctgaaacatgaagttttcctcttattcttgccttgttttggatctgctgtcattttcaaagtttgcttaaggtttttttttttttttctccttttcattagtataaaccaaagtgaagataaatgtatgtcctagttaccctctctgctgtttgcattaagaagttgactctggccgggcacggtagctcatgcctgtaatcctagcactttgggaggccgaaggggtggatcacttgaggtcaggagtttgagaccagcctggccaacattgcgaaaccccatctctactaaaaatacaaaaattagccagatgtggttgcacatgcctgtaatcccagctactgaggaggctgaggcaggagaatcgcttgaacccgggaggtggaagttgcagtgagctgagatcgtgccactgtactccagcctgggtgacaaagccagactccgtctcaaaaaaaaaaaagttgactttttctccaagagtttatctgttagtttccctgactagtttttgttttgtccagtatttataatctaaaagatctcacaaagtattgatgtaaaatgtcatggcagtgaatgaccatagacagagctagtatgtctgtgtataacccctctgtctatgtaacccctatgtctatgtaacccctatgtctatgtaacccctatgtctatgtctataggggttttaccatagaataccagaaaaataccatagtagaaaactgttgatttttactgatgatttcatatcaaataggggaaatataaaatgttcatcattattttcatcattcttaacatcttttgagtgtcagatactgtcctgtgtgctcatggagtggctcatttaacttcacaagaatcttaggtaatagtattttcttcattttacataggagtttgaatatcggggacattgtgctgtgtttaatttagtcatatgcaatagccactttttagggcaaaaacattcaaatgtcaagaatctttcatggctcaatcggcattagtaagttaggcattaagctattcccttaagaaggaacttcttaaccttcttaagttcttggaagagtcaaacgtaggtaaattctccagaatttgccagggctttcatcagtgacagtgcctacaacacttgataggaataaatgaaatatgacaaatatccaagtagtgggaggattagatgaaattttaaaaattataactgatgatttttaactgcctgacattttatgagttaagttggtgatatactttttttacaatttccaaaacaatgtagttaaatattttaaatctagtaagcagatatcaaacaatattttgtggaaacaatcattcaaatttgtgagtaatgggagtaaagttctgatttcatcaggtaagccaaaacaaataattttccaccataaatattataacaaataaactcttttaaaataaaatattttcttccttttcctccctggtgacctagtggtaatgttctgcagtgttttatgtaggagacctggatttcattcctgttctcgttatctctctccctagggctgcaatgaattaaataagaaataaaatcactatcctgcatccttattgccatgggctgtgcccttgtcagatttcataagctaaactagctggacctggttagtattgggttggaagacctcaaagaaaacaaagtctgtgaaaacacagatcttctatacagccagtattttcttccatgaaaccttgtcttacggttattattgcactttcctctttactatttgattgatttgcttgctccaggtaaaaagaaaggtcttttaaagtaaatggcattctggtcgtttaaatcaatgcacttattatttatttttccttttcaaaatagaaaacttgtttagtttgaaagatacttggttatattcttgagaaggcagtatcccaactagcagtgttttttactgtataaaaatttactttctcagagactttttattttattcattgctataaaatgcctgttctgtttctttttgttttgagagataatgttgcccttactttacgaatgatgtaacacataaaaaaatttttaatgcatataactgtgtgaagatccaaaattgtttttgtgttccctttaaaacctaggttatatatctctgaattttaaattataatttaggataatctcaaataccaatacttttaattagatagctgtggttatatatgtataatagacaacaaatataattcagtaagaattgcactaatgtttgttgacattcatcttttttacacaaatagacccagtttacccaaagttgtttctcccagaacgcacacaaacatacccggtttttttttttgtttgtttgtttgtttttttgagacggagccttgctctgttgccaggctggagtgcagtggcacaatctcagctcactgcaatctccacctcccaggtacaagcagttttcctgcctcagcctcccgagtagctgggactacaggcatgtaccaccatgcccagataatttttgtatttttaatagagacggggtttcaccaacaaacataccttttataaatactgatggtatggatacatatacacacatcccctaatattccctaacatgctgatttccttcttctctctctccctttttttcttcctatcttcctacaaaggaacactttttttctaatgacattttacatagaaccccagtatattaaagaatgatacaaaaaatttctctggttaatgccaaaatgagggaggctaaagtcttgtcatctcagcttcttcctcactccatgaggtgtagaaccttggaaaagccctaaaattccaagaaacatgtcttccctgcttagtttcacatttatctatatacacaaaaatttagtggttttggaagagttttctgttcctgtttaaaagggttagcactaagagtatggtcctgaaaagtattcaacaaggacttttaatggttcttactctactcttatgccaaaccctcttcatttccaagtaaaatggcccccaaaccaaaattaagccatcaaagtcatagcagtcagttaaagataaatggcatatccttctttattaataaggatagttgttaattgtattatggagtattccagaattgatccactttataatctagtaccatttaagataatatttttcggctggacatggtggcatgtgcctgtaatcctagcactttgggaggccaaggtgggtggatcacctgagatcaggagttcgagaccagcctgatctgcatggtgaaaccccatctctactaaaaatacaaaaattagccaggtgtggtggtgcgcacctgtggtcccagctactcggaggctgaggcaggagaatcgcttgaactccggaggcagaggtggcagtgagccgagatagcgccattgcactccagcctgggtgagaagagtgagactctgtctcaaaaaaaaaaaatttttttttctatgtgtcattagtgatttttttaaagggtagttttccaactatcttgcagtgtaaccaattttaaaccagccctctttatcaaaattctagaatataccatgagtgtgttggtaaattttttttaattggttcttaggaggaaaaaaagccttgatttgtgacagttgccagttttaatggtgttaatttctcccaccgtggctgatttcaagctatcaacgtgaaacaccgaaagtggaattggaagtagatgcatagtagtagattaccattatatagtatttccaccatgcagctacaatagatataaatatcctcaaagacatacacaacaatagatgtaaatatcctcaaagacatacacaataataaaatgtagtaaaataggaagtgatgaattttgagtcattattacttttttgtataatttaattatgtttacataatttaatttttaatgatgcatatatttaactggcttatagaatttctgaaaatagtagttgcagtcatgagctggtatgagtagacttcagcatactactgttccttgggaaaatttggtttctttacctttcaaaacaaaaccctttagagataatatctaccttcaggagaatgtataaaattcccactctaagtctaattcaaccatccctcagtctctgtaactatctctaatattgttcattataaatagttatgtagattattttgctgtatctagagaatatttagaggaataaacaccaacctattttctgcttttcgtcaggttattctgtctgtcttatgaagtcatctgttatattattctgtagtcccttaatctcgttgcttcctgttaacttgcctagcaaaatgacttgaaacctatcaaaatgaacatcttccctatgtcttaacaacacaaccaaaaaaaaggcgggcagggtggcggtggggtaggggtgggggtggcggagcactgattacgttgaagtgttggtgagactctttttgctagatcttcagctacctaaacggttttattgttaagaacagagttttcttttttaagcttctaaatgtaattagtttgataacagctgaagtctccagtggtaagtctcaatctgttaccctagcagtcacctatttgtattcatcattgataatatcaacttgctactgaatattttcaccattcattagtttactctttaataaaaattgttttttatcacatacattgtctaaaacagttttatttttttcaaaaatctgagctttgcctattagaaaatcatatatgttattgatttggccttttgaattaaagatatttatcacataagtaaagtatcaagataaaaagaataactttctctaaaccttgtctctaactgttgcagaatggatgaaagaaaagacaccctaatgaatgaattattatatggcactattaaaaatacacttcagagttcttttgatcatcgtgacagaaaagggccagtgatttgagagctcaaaaaaatgggctgtttattcactgtttatgtgttttgtattcttgctttattaaaatcctattttaactccgtcagtattgattaaatgcctatattttttaagattctattagaggtagaactttttaacaatgcaatacaaaaaaagtcagatcttaactagatgattttctagaagaattaatggaactatggttaaagtagatttttatcagcatgtctcattcacttactaatactctctaatgttatctttagtttcgtaatatcgaagactgtatttcacagatggctgagaaactttacaaccattctcttgtgatggccatttgactttaattttttagttataaatttattttcttagaaattttctacaataaaaacagtttacaatcaatttttaaaacgccaagataatattgataattaagtctttaaagtaggtcttttgttaaacctaattataagtgtatcttataattaatggctgctgtcataccacctgctctcttctgccttgaatcttatcacatctatgttgctttgaaatctgagaatgcttttcacttcctaacaactgatatgctacttcttccaatcagacatcacattactgattaggtgaatactacttcctgtttgtttgttttttttcctgtatctctaaatgcaccacttctgtcttaggaatatgacattatgtaaaacagatacttaaattaattagattttatttttgtagaggtaaggaaattatagaaaagacaagttatagtgtattaaatgctttccaaaagtaaaagtttgataatatttaaaatacaactatacctatggagaaacagttttttttttttttttttttaaagatccacatttgtatctgatagtccttttataatgtaaggttttttcaccatattgtatagtataggatttagtttttgtattttatgttgttttccctgcatccagccttattaatataaataactaccttttaggaagaattgagatataattcttatattataattacctggtgacttatatttctcttctcttctactataaacaacctgatggttgagttcatggcctttttatctttgtatccactgtagtgtctatagggtaaatgtaattaaattgagttggtgaattagactgatgccactaatttgtttcacttaatcactcaatgtctattacatgttcttatcctttatgtgttgatctttcaaaggacaatcttatttccgtcattttaaacttctgggagtatcttcccatattcacaactaggaataacaggggtggcagagctaacttgataagttttgacactggattagattcaaatggatgaaccagaaaagcagtttccccagtgatagtctttttttttttttttttttttttttttttgagatggagtctcattctgtcgcccaggctggagtgtgcaatctcggcttactgcaaccactgcctcctgggttcaagcaattctcctgcctcagcctcctgatgagctaggattacaggtgtgcaccaccacgcccagctaatttttatatttttaggagagacagggtttcaccatgttggccaggctgtcagtgacagtttttaagtagagatattctggtacaacaatatggttagtattgaggaaataactttttttaccgaaataaaaggtcagggaggccaaagtgtgctcctgaatgctaatttttattcatttttagtgtgtatcagactacttccataaacgtggtcagtttactctctcccagggttaatctacatgttaagtaaaattaaatgcaaaagaccctttatcaatatatagtaccatgaaagactcactttctcatgaactaacaatactcaaagtacagagagtgaattcttggaagaaacacatgtggcgcaaagacacaaagccaagacatttcaacagtatattccaaataagatatagcaggccagaatgacttctggaacatggcaggagtagaatatgagataaagctggaaagaaaggtaggtaacaaaatgtagaagtttttgaatgccaagataagaagtttagattattttatgtagtagggaatctttggatttttagctggaaggaatggggtattgacatgctctgttttgtaaaggtgaaagtagcagcagtagactgaaactgtggagtgagagtggaaaggaaagatattttataattgatgcagaaataaaattcagacttgctgaaaatcatagctaactagtaaatggtggagtcagaactcaaatgatctgactccaaaaccactacaatatccaccctccacaatataagcatattataatcatttgtgtgtgtatctttattaggagagcaaaccatatcttttcatttatgtcctgtttcttagcatagtacctaaaaaaaaaaaaagtgggtacttcgttagttcaatcaataaatatttattgagcacctaaccaagcattatgcttggtatgcatatggtttacgtctggtaaatgttgccagtcttcccaagtaattgtaaccaatttatacatccaccagttagttcatgaggatttctgttgctccacaccctgacaacacttgatattgtatgtcttttttcattttagcttttctggtggatctcacaatgaggtatgattttattgttgctataagagtttttaaaaattgaggtgaaatccatataacataaaattaaccttttaaaatgaacaattcagtagcatttaggacattcacagtgttgtccaaccaccacctctgtctagctccaaaacatgatatcacctcaaaaggaaactgtacccattgagcaattgcttctcattgcccacctccaccagcccgtgacaaccaccagtctgcattttgtctctatgaatttacctgttctgaatatttcatttaaaggaactcatacagtatgtgaccttttgtttctgcctcctttctcttagcatattttgatggtcatccactttgtagctagtatcaatctttttatggctgaataatattccgtgtgtgtgtgtgtgtgtgtgtgtgtgtgtgtgtgtgtgtgtatctcacaattttttattttttttattttttattttttttgagacagagtctcactctgtcgctcaggctggagtgcagcggcgtgatctcggctcactgcaagctccgcctcccgggttcacaccattctcctgcctcagccttccgagtagctgggactacaggcgcccgccaccaggccagctaattttttgtatttttagtagagatggggtttcactgtgttagccaggatggtatcgatctcctgccctagtgatccacccgtctcggcctcccaaagtgctgggattacaggcatgaaccactgcgcccggccgtatcttacaatttgtttatccattcatccattgataaatgtttgggctgtttctaccttttacgtattgtaaatgatggtgctacaaatgtgtgtatggttatttgagtttatgttttcaattgctttgggtatatacctgattggaattgctaggtgatgatggtaattttatgtttaactttttgatgtaccatcaacctgttttccactgcagccgaaccattttacattctcactagcaatatacgaggattccattttctccatattctcaccttcacttgttatttttcacttttgttgtggttgtgattgttatagccaccctagggtgtgcagtgatatctcactatctcactttggttttgatttgcattcccctagtgagtaatgatgttgagaatcttttcacatgttttttggccatttgttgtgtagcttctttgaataaatgcccttttttgaattgggttgtctttttgttgttgagtttgttataattctgcatactaggtgcttatcagatatacgaattgtaaatattttctctcatcctgtaggagttttttcattttcataataatgttctttcatgcacaaaagtttttaattttgatgaagtccaattgattgacttctatttttgttgtttggactaagaatgcattgtcaaatccaagagcgtgaattttacccctatgctttcttctatgaattttatggtttttcttattatatttaggttgttgattcattttgcattaatttttatttgtggtgtgagttatgggtcctgcttcattctgtatgtatagtctcaggactatttgttgaagagactgtttctatctccattaaatggacttgtcacctgtgtcaaaaaccatttgatcatatatgcaaggtttatttctggcctctctattcttttctcttgttctatgtgtctgtcttcatgccagtaccacaatattttgattacaatagctttgtagtaaaatttcaaatcaggaagtgtgaattctccagcctttgttctttttccaagttcattttggctatttagggttccttgagattttaattaattttagcatggaattttttgtttctgcaaaacatgtcattgggattttgttgggtattgcattgatgtgcatagatgtgcatagtagtcacatcttaacaatattgtctcccttgtgctaggaagcactaagtaaaaaaaaaaaaaaagaaaagaaaatttaaatattaagtattccaatacatgaacatgggatgtcgttccatttatttctgtctcctttaatctctttcagcagtgttttgtaattttctgtatacaagtccttcacctccttagttaaatttattcctaagtattttattctgtttcatgctgttgtaaatggaattgttttcttagttttcttgtttatattgtccattgttagtgtctagaaacccaactgcgttttatgtattgatttttgtacctataatgttactgaatttgttaattctactagttttttttgtagggtcttcagagttttctacatatcagatgatatctgtgaacggagataattttactttttccttccaattcagatgtccattatttctctttcttacacagttgccctggctagaacttccagtactatgtttaaacagaagtggctaaagtgggcatccttatcttgttcctgatctcaacgggaaagtttttagtcttttaccattgagtatgatgttagctatggtttctccacaaatgacctctattatgttgaggtagtttccttctattcctactttattgggtgttttaattaggaaagggtgttgaattttgtcaaatgtttttctgcatcaattgagatgatcatgtgtggtttttttttcccttttatctattaatgtgatgtattacattgaatgattttctcatgttgaaccaaccttgcattcctgggataaacctcacttcatcttagtgtataattgttttcatacacttttcgatttgggttgctaatatttttttgatgatttttgtatcaatatctataaacaatattggtctatagtttcttttctcatgctgtctttgtcagacttggaaatcagtgtaatactggcatcataaaatgtgttagcaaatgttcccttctcttcagattttttaagattttgaaaaggactgagttatttgcatctcccctctttttttccccctgtcagtattggcttgtcagttttgtctttttaaaaaaatgacattttgtttcattgattctattatttatctgttctctatttcatttttattatttccttccttttgctagctttggtctctgatctcctttttctacttccttcaggaataaagtctaaattattaatttgaaatacttcttatcagtgtaggcatttactttttttttttttttttttttttttttgaggcggagtcccactctgtcacccagcctggagtgcagtggcacgatctcggctcactgcaacctctgacttctgggttcaaatgattctcttgcctcagcctcctgagtagctgggattacaggtgcgtgccaccatgcctggctaattttttttgtatttttagtagaaacagggttttgtcatgttggccagattggtcttgaactcctgacatcaggtgatccacctgcctcagcctcccaaagtactgggattacaggcttgagccactgtgcctggctggcatttactattataagattaccttcaaacactgctttcactgtattcatacattttggtatgctttattattattttaatttgtttctgagtgttttcaaatttcccttttgatttttcttgtactcattggttaagagtgttttaatatccacatgctttgagttttctcgtttttcttctgttgctgatttctatcttcatttcttgtgattacagaagatactttgtgtgatttgagcaatttaaaatttattgacacttgttttgtggcttgatacatgttttatcctggagaatgttccatgtgcactggagaagaatgtgtattctgctgttattggatggattgttctgtagatgtctgttagatctatttggtttataatgttattcaaatcctctggttccctatttatcttctttctagatgttctatccatattgaaagtggggttatattggggaaatacttcaggacattggtctgggcaaagatttttttaggggtaagacctcaaaagcacagaatacaaaagcaaaaatagacaaaaaggattgcaacaagctaaaaatgttctgcacaacaaaggaagcaacaaagagacagcctatggaatggaggaaaatatttgcaaactattcatctgacaagggattaataactagaatatataagaaactcaactcaatagcaaataatctgattttaaaatgagcaaatgatcttaatagacatttttcgaaagaaggcatagaaatggccaacaagtatatgaaaataaatgcttagtatcactaatcatcagggaaatgcaaatcaaaaccaaaatgagatataatctgaccccagttaaagtgactgttatcaaaaagacaaaacaacaagtgttggcaaggatgtagagaaagggaaacactaatagttcactgttggtgagaaagtgagtataactgctatggaaaacagtatggacattcttcaagaaactacaaatagatctaccatccgatttagcaatccatttgctgggtatgtatccaaaagaaaggaaaccagggtatcaaagtgatacctgcatgcccatttttgttgcaccactattcacaatagccaagataacaaaatcaacctaagtgtccattaggatatgaatggataaagaaaatggtgtgtttgtccatatatatatggacacacactcaatggaatatcattcaaccatgaaaaaagaatgaaattctgttagtagcagcaacatagatggaactagaggacgttatgttaattttaataagccatgcacaagaagataactattgtaagttctcactcatatgtgacagctgaaaaacttgatctcacagaggtagaaagtagaatgatagttactagaggctgacaaaggtaggagggagggatgatgaagagaggctggttagcggttgcaaaaatacagttagaaagaataagttctagtgtttgatggcatggtagagtgaccatagttaacagtaatttgttgtatatttcaaaacagctagaagataagatttggaatattcccaacccaaagaaatgataaatttttcaagtgatggatatcctaattaccctgatttaatatatgtatgcatgcatcaaaatatcacatgtgccccataaatatgtccaattattatatatcaattttaaaagaagaaaattgggagaaagtaaatgatattttggagtcacaaaaattgctgaatcctaactgtgtgacatttttatgactactttgctggttctttcctagaggcacacagtttggaagtgacaatgcttataacacactatgaatgtaaaagtaaaataatgcatagatgcaaagtgacacctaagggaaaagaaattacacttgagctgaacattgaggaataagagctaaacagctagaaaaggggaagggacctaggagtaatacatatttatttctagtaactgtattatgtgaaaaatgtttatctctttatcatagaagcttcctatctatttgtccttgacaccttcaagcaggattcttagttatcacctctcctatctaagccagaactgaaaacggagtttaaaaaaaaaaaaaaaaagtcattatccatttgtctttcatctttgatatggaaatgtttatttttgaaatacaaacgagacaacaccagtttcattattttgtgttgtaaaatggagataatagtaggttgttgggaagattaaatctgttaatgtaaaacactttgatacttgggatatagtgtttaatcctaacctcattttggctggcttttaaattttctgtcttccatctcgctaatactctttgtaacatatatatttaatttgcttttatacctatctgctgaatattatatttcaattttaaaaagttttaatggtagaggctctacttggtactttatcaaatccttttggtaaatatttatatttttctaatacctctgcatatgtggatattttcatgctggtcttttatttctttaaacatagtaacaccttatccacagatgcatttagccacagggatggtccagatacctggtcaaccatattgaggaaactttaaacctttggtttttttttgccatattaaatgatttttggcagagcccaaaattgttttctaagggagttccaataaagtagcaggtatctaccttcagaattaaaagaggatgatagtaatagcggttaatgtttgtttattatttattacatgacaggcattgtgcttgaactccttcagttcacagacattgtacgcaaactacctcaattaagccttacatcaactatgtgagataacattattattatttcccatttactgatgcgttaacatgaggaggtttatttgaccccagtacttttaatcattataccagtctacctttaattggatcatggctgttgcattatagatctttcataactaaatttggttcaactatggatattctacttagcaattacaatttaatctagaggtggttaaggaaatctgaagctgaaatggttcttttttcaaaagtttcttaattcaaataggtaaaatttaatatagactcatttaatgtacttcttcctgggggcatattaccaagaatatatttaccttttcatattgttgtatattttatgtacatgcttgattatcttactatcagattaccagagtgtttttttaataattattttctgcattaaaacaattgccttggagcatttcacaataaaaaaataattgaattaatactttatacttctaagtgccaccagttagttttagagcccagtttaaaaattaatgtcctaggcagggcacagtggctcatgtctgtaatcccagcactttgggaggccgaggtcaagatttcgagaccagcctggccaacatggtgaaaccctgtctctattaaaaatacaaacattagccgggcatggtggcacacacctatagtcccagctactcgggaggctaaggcaggagaataggttgaaccctggaggcggaggttgcagtgagccgagatcacaccactgtgctccagcctgggcaacagaacaagacccagtctcaaaaaaaaaaaaaaaagttctaatttttatgtagtttatgcagacatagttaggaattttagtgtaccatttattaactacttaaaagtgactttttttcccctccagcttgcttgatggaagatcagaatctatgcaatggcacacgagacaaacaaatttgcagtttatcatcttgtcactagtgctacttgaaaggacaaacagaagcccccaaaatacagtgtattatctaggaaggcttttacggttatagctacgtaactaccaaacccagacaatctctccaccgtagggaaatttaaaaatctgtgtgtacacatataaattttttgagacagagtctcatactctgtcacccaggctggagtgcattggcatgatctaggctcactgcagccaagcagtggcacctcctgtgcacaagcagtcctcctgctccagcctcctgggtagcttgggctacaggtaggcaccaccatgcctaatttttaaaatttttttgcagagacagggtctcttatgttgccaaggctggtattgagctcacgttcaattgatcctcccaccttggcctcccaaagtgttgggattgcaggcgtgagtcactgtgcacagccaaaaatctatttttttaaaaaaacagccatttttcctcttaaatgatagtatctttaatacctattctaatggggtggtggtggggtagactattgtggatgtattagtaaactaaacaaactgagttgaaaatcaacatatgtttcaaaatgattaataggatcaaaaatgcaaagttgaataatagtttttaattgcagtatagtctctttactggtgtgtctctgcccgaaactttttagcttgccattattctctatgtacttctaaaaatcttaatattcatgtctccttacataactcaagactgcacagatgaagtactgtccaatgacagtaagattgggccaggcacagtggctcatgcctgtaatcccaacattttgggagcctgaggtgggtggatcacttgaggccaggattcgagaccagcctgggcaacgttgtgaaacccaacctgtactaaaaatacaaaaaaaaaaaattagccaggtgtggtggcgcacagctgtaatcccagctactcgggagactgagtatattggtccattttcatgctgctaataaagacataatcgagaatggataatttataaaggaaagaggtttaattgacttacagttccacttggctggggaggtctcataatcatggtggaaggcaaaagagaagcaaagacacatcttacatggcagcaggcaagagagcttgtgctgaggaactcccatttataaaaccatcagatcttgtaagacttactcactaccatgagaacagtatgggggaaactccccctgtgattcagttatctccacctcaccctgcccttgacaggtggggattattacaattcaaggtgagatttgtgtgaggacacagccaaaccatatcactgaggcacaagaattgcatgaacccaggagcctgaggtggcagggagctgagatcacaccactgcacttcagcctggatgacagagtgagacttcctcttaaaaaaaaaaaaaaagattgtaaaatcatttctgaattttgaggtcattaagaaaatctctaagtaggccaggcacagtggctcacgcctgttatcccagcactttgggaggctgaggcagtggatcacgaggtcaggagattgagaccatcctggctaacacggtaaaacctggtctctactaaaaatacaaaaaattagctgggcatggtggcacgtgcctgtactcccagccacttgggaggctgaggcaggataatcacttgaacccagtaggcagaggttacagtgagctgagattgtgccactgcactccagcctgggcgacagagtgagactctgtctcaaaaaaaaaaaaaaaaaaagggaaacctctaagtaaatgtactaattaaatctgggattttgattattagaagtcagcactgcattctttgatttgaatttaaaaattagctctttacctaaaagctgggacttcacagagattacaaagttagctaaataaatgttttggatcattttactaatatatacatgtatgtgacgaaaaatagaattaagcttattccaataatcatacatacttcctctaattccaacttaaatttcaattcatgagacatttttcctcaattccaaataatatttgttttcaaggattttatacctctgatgctggctttttgcttaatatatgcacaccatcctaggtattcaatatcgatactcttttcatccacaagcatacttttcgctgctttttatttattcaactaataagaaatctgttgactactatgtataaggtactgaactaagcacaggggatacatttgagaacataatgacccctgctctcatgaagtttatattatcactagagagatagtagattttactgttcctaatttttgagattatgtatatcccttatcagaacattcattgatagtttttgataattagactattaattttattagagaccatccttaattatgggaaggcagaggtggaattttctcacaaactgtactccgtcatcctctgttcatcctccatatttactcctgccagttcatttgtgcctcatttcatttcattctatcctgaggacttctcaatttacatctttaaaacctcttgcctattctttatagctatctacaggaccttgccataagatggcgttcagtgtacctgaaattcaacataggtaaaactgaacttaattctcccaactttctcatatctgtacttgtaacttattctgacaataccatagactcagaattatatacgctttttaaaaaacttcttgttttacaagtccagtttatcctggccctacctctctgtgttttcatctcttccttggaaatccctcagtgctaccatcctagtccaatctcttattatctcatgcctgctaatactttcttcgctattatcctgtcagttcatcctatttgcttctctcacatgaggttttttttttttaattcttattatactttaagttttagggtacatgtgcacaacatgcagtttcgttacatatgtatacatgtgccatgttggtgtgctgcacccattaactcatcatttagcattaggtatatctcctaatactgtccctcccccctccccccaccccacaacagtcccaggtgtgtgatgttccccttcctgtgtccatgtgttctcattgttcagttcccacctatgagtgagaacatgcgttgtttggttttttgtccttgcaatactttgctgagaatgatggtttccagtttcatccatgtccctacaaaggacatgaactcatcattttttatggctgcatagtattccatggtgtatatatgccacattttcttcatccagtctatcattgttggatatttaggttggttccaagtctttgctattgtgaacagtgccgctataaacatacgtgtgtctttatagcagcatggtttataatcctttgggtatatacccagtaatgggatggctgggtcaaatggtatttctagttctagatccctgaggaatcgccacactgacttccacaatggttgaactagtttacagtcccaccaacagtgtaaaaatgttcctattactccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatatcttcttttgagaagtgtctgttcatatccttcgcccacttgttgatgggggttgtttgtttttttcttgtaaatttgtttgagttcattgtagattctggatattagctctttgtcagatgagtaggttgcaaaaattttctcccattctgtaggctgcctgttcactgatggtagtttcttttgctgtgcagaagctcttaggtttaattagatccatttgtcaattttgccttttgttgccattgcttttggttgttttagacatgaagtccctgcccatgcctatgtcctgaatggtattgcctaggttttcttctagggtttttatggttttaggtctaacatttaaatctttaatccatcttgaattaatgtttgtataaggtgtaaggaagggatccagtttcagctttctacatatggctagccagttttcccagcaccatttgttaaatagggagtcctttccccattgcttgtttttgtcaggtttgtcaaagatcagatagttgtagatatgcggcattatttctgagggctctgttctgctcctttggtctatatctctgttttggtaccagtaccatgctgttttggttactgtaaccttgtagtatagtttgaagtcaggtagtgtgatgcctccagctttgttctttggcttaggattgacttggcgatgcaggctcttttttggttccatacgaactttaaagtagtttttttccagttctgtgaagaaagtcattggtagcttgatggggatggcactgaatctataaattaccttgggcagtatggccattttcacgatattgattcttcctacccatgagcatggaatgttgttccatttgtttgtatcctcttttatttcgttgagcagtggtttgtagttctccttgaagaagtccttcacatcccttgtaagttggattcctaggtattttattctctttgaagcaattgtgaatgggatttcactcatgatttggctctgtgtttgtctgttattggtgtataagaatgcttgtgatttttgtacattgattttgtatcctgagactttgctgaagttgcttatcagcttgaggagattttgggccgagacgatggggttttctagatatacaatcatgtcgtctgcaaacagggacaatttgacttcctcttttcctaactgaataccctttatttccttctcctgcctgattgccctggccagagcttccagcactatgttgactaggagtggtgagagagggcatccctgtcttgtgccagttttcaaagggaatgcttccagtttttgcccattcggtatgatattggctgtgagtttgtcatagatagctcttattattttgagatgcgtcccatcaatacctaatttattgagagtttttagcatgaagcgttgttgaattttgtcaaaggccttttctgcatctattgagataatcatgtggtttttgtctttggttctgtttatatgttggattacatttattgatttgcgtatgttgaaccagccttgcatcccagggatgaagcccacttaatcatggtggataagctttttgatgtgctgctggatttggtttgccagtatgttactgaggatttttgcatcgatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctagtcctgggctttttttggttggtaagctattgattattgcctcaatttcagagcctgttattggtctattcagagattcgacttcttcctggtttagtcttgggaggatgtaggtgtcaaggaatttatccatttcttctagattttctagtttatttgcgtagaggtgtttatagtattctctgatggtagtttgtatttctgtgggatcagtggtgatatcccctttatcattttttattgcatctatttgattcttctgtcttttcttcttaattagtcttgttagtggtctatcaattttgctgatcttttcaacaaaccagctcctggattcattaattttttaaaggattttttgtgtctctatttccttcagttctgctctgatcttagctatttcttgccttctgttagcttttgaatgtgtttgctcttgcttttctagttcttttaattgtgatgttagggtgtcaattttagatctttcctgctttctcttgtggacatttagtgctagaaatttccctctacacactgctttgaatgtgtcccagagattctggtatgttgagtctttgttctcattggtttcaaagaacacctttatttctgccttcctttctttatttacccagtagtcattcaggagcaggttgttcagtttccatgtagttgagcggttttgagtgagtttcttaatcccgagttctagtttgattgcactgtggtctgagagacagtttgttataatttcttttcttttacatttgctgaagagtgctttacttccaactgtgtggtcagttttggagtaggtgtgttgtggtgctgaaaagaatgtatattctgttgatttggggtggagagttctgtagatgtctgttaggtctgcttgttgaagagctgagttcaattcctgggtatccttgttaactttctgtctcgttgatctgtctaatgttgacagtggggtgctaaagtctcccattattatttttttttcttttttagtatttattgatcattcttgggtgtttctcatggagggggatttggcagggtcataggacaatagtggagggaaggtcagcagataaacaagtgaacaagggtctctggttttcctaggcagaggaccctgcagccttctgcagtgtttgtgtccctgggtacttgagattacggagtggtgatgactcttaaggagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaatttttcttagtacagaacaaaatggagtctcctatgtctacttctttctacacagacacagcaacaatctgatttctctatcttttccccacatttcccccttttctattcgacaaaaccgccatcgtcatcttggcccgttctcaatgagctgttgggtacacctcccagacggggtggcggccgggcagaggggctcctcacttcccagaaggggcggccaggcagaggcgccccccacctcccggacggggcagcggctgggcggagacgccccccacctcccagccggggcggctggccgggcggggactgccccccacctccctcccggccggggcggctggccgggcgggggctgcccgccacctccctcccggacggggcggctggccgggcgggggctgccccccacctccctcccggacggggcggctggccaggcgggggctgccccccacctccctcccggacggggcggctggccgggcgggggctgccccctacctccctcctggaccaggcggctgccgggcagaggggctcctcacttcccggacggggcggctgccaggcagaggggctcctcacttcccagacggggcggctgccgggcggaggggctcctcacttcctagacagggtggctgccgggcggaggggctcctcacttctcagatggggcggccgggcagagaggctcctcacctcccatatggggtcgcggccaggcagaggcgcacctcacatcccagacggggcagtggggcagaggcgctccccacatctcagacgatgggcggccgggcagagacgctcctcacttcctagacgggatggcggccgggaagaggcgctcttcacttcccagactgggcagccggacagaggggctcctcacatcccagacgatgggcggccaggcagagacgcttctcacttctcagacggggtggcggccgggcagaggctgcaatctcagcactttgggaggccaaggcaggcggctgggaggtggagggtgtagcgagccgagatcacgccactgcactccagcctgggcaacattgagcactgagtgaacgagactccgtctgcaatcccggcacctcgggaggccgaggctggcagatcactcgcggttaggagctggagaccagcctggccaacacagcgaaaccccatctccaccaaaaaaatacgaataccagtcaggcgtggcggcgcacgcctgcaatcccaggcactcggcaggctgaggcaggagaatcaggcagggaggttgcagtgagccgagatggcagcagtacagtctagcttcggctcggcatcagagggagaccgtggagagagagggagaggaagaccgtggagagacggagagggagagggagagggagctctcccattattattgtgtgggagtctaagtctctttgtaggtcactcaggacttgctttatgaatctgggtgctcctgtatcgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcccattattttgagcctatgtgtgtctctgaacgtgagatgggtttcctgaatacagcacactgatgggtcttgactctttatccaatttgccagtctgtgtctcttaattggagcatttagcctatttacatttcaggttaatatttttatgtgtgaattagatcctgtcattatgatgttagctggttatgttgctcgttagttgatgcagtttcttcctagccttgatggtctttacagtttggcatgttttttgcagtggctggtactggttgttcctttccatgtttagtgctgccttcaggagttcttttagggcaggcctggtggtgacaaaatctctcagcatttgcttgtctgtaaaggattttatttctccttcacttatgaagcttagtttggctggatatgaaattctgggttaaaaattcttttctttaagaatgtcgaatattggcccccgctgtcttctggcttgtagagtttctgccgagagatccgctgttagtctgatgggcttccctttgtgggtaacccgacctttctctctggctgcccttaacattttttccttcatttcaactttggtgaatgtgacaattatgtgtcttggagttggtcttctcaaggagtatctttgtggtgttctctgtatttcctgaatttgaatggtggcctgccttgctagattggggaagttctcctggacagtatcctgcagagtgttttccaacttggttccattctccctgtcactttcaggtacgccaatcagacgtagacttggtcttttcacatggtcccatatttcttggaggctttgttcgtttcttttcattcttttttatgtaaacttctcttctcgcttcatttcattcagttcgtcttccatctctgataccctttcttccagttgatcgcatcggctactgaggcttctgcattcgtcacgtagctctcgtgtgttggttttcagctccatcaggtcctttaaggacttcactgcattggttattctagttatccattcgtctaatttttttcaaagcttttaacttctttgccgttggttcgaatttcctcctttagctcggagtagtttgatcgtctgaagccttcttctctcaactcatcaaagtcattctccatccagctttgttcccttgctggtgaggagctgcattcctttggaggaggagaggtgctctgatttttaaagtttccagtttttctgctctgtttttttcccatctttgtggttttatctacctttggtctttcatgatggtgacgtacagatgggtttttggtgtggatgtcctttctgtttgttagttttccttctaacagacaggaccctcagctgcaggtctgttggagtttgctggaggtccactccagaccctgtttgcctgggtatcagcagcggtggctgcagaacagcggatattggtgaaccccagacgctgctgtctgatcgttcctctggaagttttgtctcagaggagtacccggctgtgtgaggtgtcattccgcccctactggggggtgcctcccagacaggcttctcggggatcagggacccacttgaggaggcagtctgcccattctcagatctcaagctgcgtgctgggagaaccactactctcttcaaaggtgtcagagtgggacatttaagtctgcagaggttactgctgtctttttgtttgtctatgccctgtccccagaggtggagcctacagaggtaggcaggcgtccttgagctgtggtgggctccaccctgttcgagcttcctggctgctttgtttacctaatcaaacaactaacttggcaatggcgggtgcccctcccccagcctcgctgccaccttgcagtttgatctcagactgctgtgctagcaatgagcgagactccatgggcttaggaccctctgaaccaggtgcgggatataatctcctggtgtgccgttttttaagtccgttggaaaagtgcagtattagggtgggagtgacccgattttccaggtgccgtctgtcactgctttctttgactaggaaagggaattccctgaccccttgggcttccagggtgaggcgatgcctcgccctgcttcggctcgcgtacggtgcgctgcacctactgtcctgcacctactgtctggtactccccagtgagatgaacccggtacctcagttgaaaatgcagaaatcacccatcttctgcgttgctcacgctggtagctgtagaccagagctgttcccattcggccatcttggctcctctccttagtccacattaggtcttttaaacaacgtttcactggggagcccctctttctttctttcttatttttttttgagatggagtcttgctctgtcgcccaggctggagtgcagtggcacgatctcagctcactgcaagctccacctcccaggttgacgccattgtcctgcctcagcctcccgagtagctgggactacaggcgcccgccaccgtgcccggttaattttttgtatttttagtagagatggggtttcaccgtgttacccaggatggtctcgatctcctgacctcgtggtccgcccacctcagcctcccaaagtgctgtgattacaggtgtgagccaccgcacctggcctggggaacccctctttcataaagtatttttttttacaaacttaccctacagtgatctttcccctgtctgatttctagtagcacatttctgtgccacttaatcttgtatttggttgtataatgctttacattatatagtattttgttggtggtaatttttttaataaaaaacagttgccatctatctgctggtggaagagtgtgagtgggtggtacagtgataaataagacatactgaattttgtcctgaatattagctaacatttattaagtggctactgtgtgcctggtactgttctgcgcacttcatgtgtattaacttatttgattctcacagcaactccatttggtagatgctattattttcttcattttacacaggagaaaactgagaggcaaggtaaattctcccacactgcttagctaatacatgacatagccgtgattcacacccacttcactggtttcagaattcatgcttttttaaatttatttatttttattttattttttgtgtcagagtctcacactgttgcctcagctggagtgcaatggcaccatctcggctcactgcaacctccgcctcctaggttcaattgattcgcctgcctcagtctcccaaatagctgggattacaggcgcccgtcaccatgcccagctgattttttgtatttttagtagagatggggtttcactgtgttggccaggctggtctcaaactcctgaccttgtgatccacctgcctcagcctcccaaagtgctgggattagaggcctgagccactgcgcccagccagaactcatgctcttaaccactgtcactatatcatgtagttgaaaaggtcagacaaagagctaaataagcatattttgaggtgtactttgtgagaggtttaaagtactattgcagtttagcagatggcaagattacttccacctaggaaaaaaccaaaaatttttatgaaagatttagaagtggggtggggaaaacattccagaaactaaggaataaatcactcttgagacagaactactcagagcatatcatcaggaacagtgagtaatttagtttagctgggtcaaaggattcttgaaatgataaagagaaaatatgtttgtaaaagtaggtcgcagccaaatcatagatcttgaatgagaggttagagtgtttaaatcatacagaaggtgaagtgatgttgtccacatattagaaatatttcactgcaaaagtatataagatcaaagggaagagaaggacccattagaagatttttgcaatagtcttagtaagagataataaattcctgagtgaagtagctaacagaaatagagaccaggggagagactggacaaatcttgaatgttcaggattcaagaaatcagttgattggataatgcaataaggaggaggaagaagtaaaaatgcctacttggtgattggaagagacagttaccattaaaaaaatatggggcatggttaggaggtgatagtttggcagagagaatgatatgtaatcagtttggtatgtgctaagtttatgatgcaaatgggacatacatcaggaaacattcagcagatagttgttaatgtagaatttaagaaatcagaactagagatgtaactactggggaccttgacatacatttgatggctaaaaccagggaagcacatagaagaaaaacatctaggagagaaattgaggaatcagaaccagaaaaggaatattcccaaagtaaggagaatgagaagattactgtgacttaaaataggacatgaaaaagtggaatgttgcaggagataaaacaaatatggcaaaacgtcagcagttatgaaatctagactgtgagaatttacatgtatttttatgccttatatatgctatgttattctttttccttagatttttattttccttcgttttctgtcattgcttgttctacttcagatcattttcttatatcctatgtcaattctaaattttcttcattgcacctggaaatcacaggatgactatggtatccacctaagttttatatatatatctacctaaagcggatattatgttatagacataagagtaaatgtatcaatccttgagaaggcttccttgggagatttctggccacctaacagactgagctgatatgaatgaccgttccaagaaaggattaagcatttttttttttttttttttgagatggagtctcgctctgtcgcccaggctggagtgcagtggtgcgatctcagctcactacaagctccacctcctaggttcacgccattctcctgcctcagcctcctgagtagctgggactacaggcgcctgccaccatgcctggctaatattttgaattttgagtagagatggggtttcaccatgttagccaggatggtctctatctcctgacctcgtgatccacccatctcagcctcccaaagtgctgggattacaggcgcaagccactgcacccggccagattaagtattaagaacaacaacagtaacaacaaaagtaatcatagtatagattaaaagaatgaaaagtaaatctagttttggtaccagtaacaatagctcaaaaccagagtattagcagaaactgacaccacagaatataagtgttagtgcctggggttttaatacccacttggggcagaaattgtgcctttgagtccagaggcagctggaactgagcctctagcctgctctcaaagggctacccttctgtgaaaggagaatgagaaaatcctgtgttctagaaccattgaaatctctgggcacctgacagaggccagagcaaaaactattctttaggcttaccccaaacagggtttttggaactgtcacagaaggaaaaacaaagaccacccccactaccccacccagtaaagatgtgcccactattaaaactcataaactttgagggtagtcagcagatgcaacaaagaagaaaattggcattacaagaataagagataagaaaaccaatctgaaagagaccacaaaactcagcatttctataatgattaaagagataaaagtaggaataaaaccatagtgaaagaacatgacaggatatgaaaaaaagaacttttagaaatgaaatgttcactgagttttttgtttttggttaaaccattttaaaaaatgtttgaattgaacttctaaaatgagaattcatgagttagaagatgatctggtcaaatcatccagaatgtagaaccaacagataaggatggaaaatataggaatagttaagagacactaaagatagaatgtttaatacatttcagaaagaaagaatgagaaatgcagtattataattttttaaaaagacagatttttcagaattggtaagaaagagaaatctttgtatttgagtagtacatagtatactgaacaggatgaataaaaacagtctacctctaaacaaatcaaggagaaactgttgaacattaaagcaaatagaaaatcttaaaactaaccacagagagaaaacaaaggaacgccagttatactaccaattaccttctcatctgcaacaaaaaatatcagaagaaagtaggaaaatatcctcaaagtgctgagggaaatcattgtcaacttagcattttatgtattgttaaagtattagttgaaagtaggaataaaataaagatattttcaaacaaactaaggcctagcagtttgccactcatggacccttaccatgaagtctacttaaggatgtgcttcagcaagaagaaaattgaatgtagaaaaaaagagagggtagtgagaaaaagttgtgacaaaacagggaaatcatgttgataaatctaaagcattgactgtaaaagcaagtattgtaataatggtgactagtttagagcaaggtaaaacaaactaaaactaaaatacatgacagcaacacttagaagatgggagaaaaaaatcagaaacattttaggattcttgtatttaatgggagggggatagatatggatttactttagatttgttagtgattgtttaaaaaatattggatattcattactgtagctagaatgtagaacttccaagccaattgagagaggatcatgagcaagaaaactttaccagtctgaaagaacatatgaaaagagaaagaataaaagaaagcacatggtaaatggcataaattaagataaggaataaatccaaatatttcaatcacaataaatgaaaataggctataattaccagttaaataacaaatattgtcaaattaaaagaatgaaatccagccatatgttatttacaggagagacatttaaagcataatgtcactgaaaggttgaaagtaaagggatgggcccagcccagtggctcacgcctgtaatcccagcacttggggaggccgaggcaggtggatcacctgaggtcaggagttcaagaccagcctggccaacatggtttaatcccgtctctagtaaaaatacaaaaaaattgctgggcgcattggctcatgcctgtaatcccagcactttgggaggccgaggtgggcggatcatgaggtcaggaaatcaagaccattctggctaacacagtgaaaccccatctctactaaaaatacaaaaagaaattagccgggcatagtggtgggcgcctgtagtcccgcctacccgggaggctgaggcaggagaatggtgtgaacccgggaggcggagctgcagtgagccaagatcacgccactgcactccagcctgggcgacaaagcgagactccatctcaaaaaaaaaaacaaaaacgaacaacaacaaaaaaatcagctgggcatggtgactcattcctgtagttccagctacttgggaggctgtggcaggagaatcgcttgcacccaggaggcagaggttgcagtgagccaagatcacctcactgcactccaggcctggaacatagcaaagctccatctcaaaaagaaaagaaagtaaagggatggaaaaaataagaggactgaccctaataatctttatgcatcaaacaacaaccccagctttatacatggcaagaaaatatacacaattaccacactttcaaggagcagataacctgccttatatggattattctgatatatatagagaaaaaattcctgaagttcttttatgaggcaaatgtaaattataatttcaaaattaaatatgtgtatcatgaaaaagaaaaagtgtaggtcagtattgcatatgaacttagttacaaaaatccttccaaaaatgttactgagtttcaaaaagttattttctaatgttttagatttgctttaaagtaatatggagggaggaagtagatggtgatagccatggaacaagattgattatgaattaataatcgttgaagctgggtgatgggtacatgaggatttattatgttattggttctacttctatcatatgtttaaattttttgatcttaagactttaagtctgtcataatcaagtatgtattcaacagaattcaacatccagtacaccccgctgccaataggtgaaactctgtacattaacttgtaaaatatttgaagcattcacttaaaaatcatgaacatgaaaataataccttaatttccttttattcaacattatctggatatctggcttgtaaatggttactcatttgctattagacattaggaaagttgccttattttttgattctaagtttctgatctgttaaatgagtatcataatagtgcctagctgggcacatgggatataagtgatctggctgcactactctagcagaccccagcctagatcagccatctcatatgataaatacattgcttattgttttatacactgagattttcagttgtttgttttgcagtaataacaaagtatacatctggcaaagtcaaaattagatgttggcaattatatggaggaaaaagaggttctctcattgacgctgatggggaagtaaattaataaaattcctttggagagtaatttgacaatatctaattgtaaagttgaagatgcccatatcctgtcagaaattccacctctaaatgcattcactagagaaacacacatataagcaaagaattatttaaaagatgttcattgcagcatgctagtagtgaaaaattttaaacaacctaagagtccaaaaggagaataatgatgaataaattatatgtagtcatcaatgtatagtgggttgaatagtatcccaaacaaatccatgtccacttagaacttcagaatatgatattatttgggaatagggtcttagttaagattaggtcatgctagattagaatgggccctaaatgcaacaactggtatctttctaaaaagagaagtcacacagaagcatccacaaggaaaaaggccatatgatgacgcagcagaggttggagtaatgcagctgcaagccgcagaacaccaaggattgctgacgaggagagagttgtggaacagattctccctcagagcctccaaaaggaactaaccctgccaaaaccttgatttctgacttctaacctcctgaactgtaacagcataaatttctgttattttaaaccacttaatttgtggtatttttttatggcagccctaggaaatgaagacacagtggaatactaccttgcagttaaaatgaatgaaactaaaactaaaactatatgtatcaatatgggtaaatcttggaaacctaatgtccaatgggaaaagagtggatagcatgatacaaattatataaccccaaggcagacactggggagggaggaaactgacctccagtaagcaagtggtagtaactggacaaagtgactttgaagttacttcatcatagaaatgaatgaagtaacactgaaaacgtccaaacattgctgaaagaaattaaagaaaacttaaataaatggaaaaccgtcttatgttcatggattggaagacttaatgttattaaaatgacaatactacccagggcaatcatattcggtgcagtccccatcaaaattgaatctcaagggatccaaaaggaaaaaaaaaaaaacttgaacaagaacagagttggagaactcatacttcctgatttttgcaacttactacaaagctacaatactcaaaatggtgtggtactgacatacagacagatatgtagaccaataaaatagaatagaaagcctagatataaatccttgcatatatggtcaaacatgttcaacaaggctaccaagatcattcagtgtggagaagacagtcttttccacaaatggtggtgggaaaactgaatatcctcttacaaaagagtgaaattggactattacgttatagtatatagaaaaatttacaaaaatgggtcaaagatataaatgtaagagctaaaattataaaactagtagaagaaaacatagaaggaaagcttcttgacattgcaattggcaagttttcgtgtatatgacagcaaaagcttgggcaacaaaagaaagatagataacttagatttcatcaaaattaaaaacttttgtatatcaaaggataccatgaagagactgaaaatgggccaggtacagtggctcatgcctataatcctaacaattcaggaggctgaggcaggaagattgcttgagcccaggagttcaagaccagcctgggcaacatagtgagactctatctctaaaataaaaagagagagagagtaaaaatgcaccccacagaatgggagaaaatatttgcatatgtgatatattttcgtctcctcttcttcttttttttttttggacaaagtctcattcttgttgcccaggctggagtgcaatggcacgatctcagctcactgaaacctctgcctcccaggttcaagccattctcctgcctcagcctaccgaggagctgggactacaggttcctgccaccacgcctggctaatttttgtactttttagtagagacagggttttgccatgttggccaggctgatctcaaactcctgacctctggcgatctgcctgcctaggcatcccaaagtgttgggattacaggcatgagccacactgcagctggtcgatatgttttctatcatctatctgataaggggattaataaccacaatatataaagaagtccaactcaataacaacaacataactcagttcaaagatgagcaaaggattttagtagacatttctccagagaagatttactcatgttcagtagtcacatgaaaaggtattcaacatcaccaatcattggggaaatgaaaatcaaaaccacataagatagcactgcaaacccactagaattgctataacaataacaacagaaaaaaagaaatgtgaaggcatggagaaaattgaatcctcatacattgctagtgagaatgtaaaatgtctcagctgctttttaaaataggttggtggtttcttaaaaagttaaacatagagttaccatatgacccagcaattccgctcataggtgtacactcaaaggaactgaaaacagatgctaaacaaataacacttacagccatgttcagagcagcaccattcacagtagccaagaggtggaaggagcccagatgttcatcactagattgactaactatgctatatacatacaacggaacgttattcatttgttaaaaaaaagactggtagatgctacactggggatgaacactgaaagaagtcagaagcaaagggccacatgatataattccatgtttatgaaatatccagaataagtaaatctgtagagacacaatgcaaatatgtgttttccagagactagagacagggggttattgtttaataagtatagagtttcagtttgggatgatgagaaggttctagagatggacagtggtgatggcttgtacaacaatatgaatgtacttaatgccactgaatggtgcacttaaaattgtatactttaaaatagttggccgggcgtggcagcttacacctgtattccctgcattttgggaggccaaggcaggtggatccacctgaggtcaggaattcgagaccaatctgaccaaggtgatgaaaccccgtctctactaaaaatacaaaaaattagccaggcatggtggtgggcacctataatcccagctactcggaatgcctgaggcaggagaatcacttgaatccaggaagcagaggttgcagtgagctgagattgcaccactgcactccagcctgggcaataagagcgaaacaccatctcaaaaataatagtaataaataaaaataaaatagttaaaatgtcaaattttatgttatgtatgatttaccacaattaaaaataaaagaataagggcaggtttgtgacagccttgtgaactgggtaggaagtgggggctggatgggagcagtgtggtttgcccaggctgtagaaaacagataagacttccatcaccgtccatctctctccagaggactgtttagcagttcagtaacacagggctgacatttgttaaatactgttattttctaggaccttaatatatgtcttcaacttatacagccttacttcgtgtactcaaatgtatttccaccatcctgtgttgccaaacttttcctgtttcgagacactagtagtctctgttattcaccgcatgtttgtatacctgtaaataacgtttatagaactctcacacttgaagtgcatttagtattgagaacaaactctgtctgaaatccctctctcagataatatactcttcttgcctagcctagtttttggtgtggggtatgacagccgctcttaatactgctactgttattgaatggaagctttagtattccttcagaagagcaagtgaatttagtctgtatggttacatgccagaagaactgtttagtggtaaattcctgcccctctcagaatgcctagaatcttcctgtttctttctgtcattcattctgctaatcaaccagtcattcattcaacataattattgtaagcctgctatgtgtcaggcagtgtatgctaagatactcaaggaatttgtccatatgtttttacctgttgatacatttattgtatctagtttttattctcatgtattgaaacacatgaaagagtaacagtgcactttatttttttattattcaaattaaaagaactatatagactgatatagtttatattaagcttgtccaacccatgatgcccacagactggatgcggcccaggacagctttgaacgtggcccaacacaaactcataaactttcttcaaacattgtgggatttttctgctttttttttttttttaagctggtcagctattgttagcattagtgtattttatgtctgacccaagacaactcttcttccactgtggcccagggaagccaaaagattggacacccttggtttatatgtaagtaaaaagcatatcagaagccagaaattttaagacatagaatgaatacggaaggaagaaaatatgacaataactttttattgaaggaagaaaatatgacaataactttttattgagattaaggaaaatactcatcagtgatagaaaaatcggactaaatgttaagttaggaaaaaacactaaactaccctatgtaaaaatgtagttaaatgggtgggcacacatatatgagcatcatcaatggtgtcatgctgtggtttgatccatgtgtgagactggtttttatacttttgacatcactttccttatcccatcctaggaaccatcttacagatgtataccactggtcataaggagatctggttatttactgcctttaccaaaaagcagctcttaagctcataattcatctaagttttagttttctcctaaaaagctcctctaatagatttcgcttgtgattttgcagacttcagttcaagtctctttgaagtggcagagattaataaagacctaaataacacttgtttttaaaattgtcatgatttacaaattactcctctttattatgttttccctgcctgcattcttatcccttttctgtaaattacacagaccttctcttgttagtgactaatatttgaaactaccgaccgtggtagttttttcaatttaacatgtattaatattttctgtgcacctggtttatgtctaggactttgctactagataatataacaaaactgtaaaggaaattattttccaggataaaaatcacttatcctgatctttagaattttcaagccttgtcatgactgttctgacacctaaaattataatcctaccttaattttatggaactattcagaggtatcccacttcagcaatttggcttgatatgtttatcatcacataactatgatacaatatatatgtatgttcattgtcagtgacaatttaacacttgtatttctaacccaaaaaactgacagtggattattgggctaaaattgttaaggtcttactctagccctgtctttgattaccttgtgaacttaagaaaattttttcaagttttgtaggtctcagttttttctttcttaaaaacagagcataagactagatcgtctccatgtatttatttatttatttattttattattcatttatttatttatttatttatttgagtcggagtctcgctgtgtcacccaggcaggagtgcagtggcgcgatctcagctcactgcaacctccgcctcctgggttcaagtgattcttctgcctcagcctcctgtgtagctgggattacaggtgtgcaccaccatgcctggctaatttttgtgtttttagtagagatggggtttcaccatgttggccaggctggtcgcgaactcctgacctcaagtgatccacctgcctaagcctcctgggattatgggtgtgagccactgtgccctgccagttgtctccagttattgaaatgagtctgttctaagagaatataacaaaactaaacataactaaaaatgttacccttcatgctttcaaaatggtaattagattccagtatacatatatgatttcggttactatactaagagtcaggtaccattctgttgaataatatgacctttgataaatactggatgcgccatagtagaatatagtggaaagaacactgcaggtttctaagttccactataccatttaccggtgatatgtccttatacattttttcaatccttttaatttattttagtctcagttgtttttttttttttcctgaataggttaataacagaaaatgttctgcctgaagacagaatacttgttcccttgaggtcatatttaattttaagagctataaatctataaattaaaatgtcccttgagacataaaaatgtctgtttggtggacttctaactttaaagcaagaaatgttcattttgagtatcatgaatcctaggagaaatatataattattgtcatttctcacttgtatgtgagtaatacatgtctattaatatatctagaattttattttcctacctccaaagtggcctggtaggcttcccatcgattttctcatgggttcttctatttttcctcaaaatactcattcgacagtcattcattgactttataatgtgtttcaggcattgagaatatataagcaagaggcatagtccccaaactttaggagattataatctatagagaaaaacagttatataaagaagccatcataatataatgtaattttagtaaaactatataccactgtatatattgcatttttttctacaattcctggctcataactcacatagatgttgttacattcctttgttacaatattgaaggcaagagcaggcctgaggaaacagaatctctctctctctgacctcctgccctcctttcacctgcccaaagcaggactcagtctgatagtgggtcataagaccgtcattccagagaaggttttgccccatactctggaggaaggaatgctgcacagagagaccaagaagattctgaacagacaggcctggctgggtttccctactcagtctattagtataagatctttttatctaatcccatttttgcatgattgtcaatcttgcctacataatgaggcctccataaaaacccacaaggacagggttcagagggcttcaggatagctgaacgtgtggaggttcctggagggtggcgtgcccagaaatgatatggaagctctgcaccccttcacccatccctcactctaaacgtcttttcacctgtatcttttgtaatatcttttaagtaaaccagtaaaacatatttccctgggttgtgtgagccactccatcaagttatttgaacccaaagagggggtcatgggaaccccaacttgaaaccagttggtcagaagttctggaggcccaggcttccatcgggttggagggtctggggggaactcctggggactgggcccagagtcctgtgggatctgacactgtctccaggtagatagggtcagaattgaattggcagacacccaggtggtgtcttctgtagaattgattgcttgcttgctgttaagagaaatccccacatgttgtgggtcacagaagccttttgtatttattgtttttgtgtttgtgtgaaagtggaggaaaaacacagtttgaaagttttcccaggtgtatacccaagagagataaaacatacgtctacatagaaacctgcaggtttgtttatagcagcattatttttaataatcaaaaagtagaaacaacccaaatgtccatcagatggataacacagacaaaatgtggcatatcccccccagacatagaatatttttcagcagtaaaaagaaatgaagtactgatatatgctactacatggaccttgaaaacattatgctaagtaaaagactacatattatatgattccatttttatgaaatgcccagaatagggaaatctatagagacagaaagtaaattagtggttgcctagggactgaagcagttaggacaaattaaaggtgactgctaaaggataagaagtatctattcagaatgatgaaaatgcttcaaaattgtgcatgactttatgaatatactaaaaagcattgaattatacactttaaataggtgaatttatggtgtgctagttaatttctttttttgtttgttttatttgagacagagtcttgctccattgcccaggctggagtgcagtggcgtgatctcagctcgctacaacctctgcctcctgggctcaagcgattctcttgcctcagcctccagagtagctgggattacaagcatgtgccaccatgccctgctaatttttgtatttttggtagagatggtgtttcaccatgttggccaggctggtcttgaactcctgacctcaggtgatctacccgcctcagcctcccaaagtgctgggattacaggtgtgagccactgtgcctggcctatggtatgctaattagatctcaataaaaaaattttaaaaatcaatatcaaatgcacaaaatgtgaccatgccccaaattaagagattaaataacttctaaaggccacctcacatgttctgtgattctaagcttctataatttaaattatatcagtggtaaagcaatacattttaaaattttgaatttcaaagcgtgaccaacaagctagtagactactgcatgtcctccaaaactttttttttttgagacggagtttcccttttgtcacccaggatggagtgcagtggcgtgatctcggctcactgcaacctctgcctcctgggttcaggtgattttcctgcctcagcttcccaggtagctgggactacagatgcacgccaccatgcccagctaatttttgtatttttagtagagatggggtttcaccatgttagccagggtggtcttgatctcttgacctcgtgatcacctgccttggcctcccaagatgctggtattaacaggcatgagccaccgcgcctggcccaaaccttttttaaaaccaaacttttattgcttttcatcaggtcttaaagctagtgtcacattgtaaagtctttctattagtgtcatgttagtccttaaatacgattttgctttatcccaagtagtataatagtgatgcatctaactttggtttccttcaatttactcttctgcatttttctaaaaacaaggtttcagacagtgaattgtaatataatcttatgtaagacttttttctacctttcagtatttaaaaaacagcagaaaataagtaaataatgactgcacagagattttctagcatagatttagcagtgctcattttcaaaataaatcattttgaatctttttgaatagtatggcaaaagttgggtcttactcatttctttctttatcggggaacctgcccctgatagtcatgtaggttcttttctatttttcctaagcgtcggccaggttgagaaataaagggacagagtacaaagtgtaaagctgggtgtccaggggagacatcacatgtcggcagtttccgtgatgccccacaagctgcaaaaccagcaaatttttattagtgattttcaaaaggggagggagcatacgaaaagggtgtgggtcacagaggtcatgtgcttcacaaggtaatagaatatcacaaggcaaatggaggcagggcgagatcacaggaccacaggactggggcaaaattaaaattgctaatgaagtttcggcatgctttgtcattgataacatcttattaggagacagggtttgagagcagacaactggtctgaccaaaaatttattaggcgggaatttccttgtcctgataagcctgggagcgctatgggagactggggcttatttcatccctacagctagaccataaaagacagctgcacctaagggggccattttagaggcccacagggacacattctctttctcagggacgttccttgctgagaaaaagaattcagcaatatttctcccatttgcttttgaaagaagagaaatatggctctgttccgcccggctcaccagcggtcagagtttaaggttatctctcttgttccctgaacattgctgttatcctgttcttttttcaaggtgcccagatttcatattgttcaaatacacatgctctacaaacaatttgtgcagttaacgcaatcatcacatggtcctgaggtgacatacatcctcctcagcttacgaaaatgacggggttaagagattaaagacaggcatagaaaatcacaagggtattgattggggaagtgataagtgtccatgaaatcttcacaatttatgttcagagattgccgtaaagacaggcataagaaattataaaagtattaatttggggaactaataaatgtccatgaaatcttcacaatccacgttcttctgccatgggttcagccagtccctctgtttggggttcctgacttcctgcaacatttattcttaaatttttttgcagaatacattttttttcattaagagctttgaattttaatttggctcttgtatgaacttcctaggaggtcttaagaaaatcattacatctttttttgctggtttcctaatcttaaagttgatgatagtgttattgtttcaggaccagcaagacagaacgtaacttttatagagcactggaaacatgaagctaaaaataaaaaatgaggggaaaaaaaatacaaggactacaagtcatgataggactttctcatgtggtcagagtgttcgtagtatatttaaggacaaagatttaaataaatgtaaacatttatgtgtaatttaaaataactttattacaaaaactgctgtgatgagcatcttaaacaaattttagcatatcaccatgtttttcttacaggtaagaaaagtaggtgctgaaagaaggtcctcaaacagatgtacacatagtctattgattttttttttttttttttttttttgagacggaatctcgctctgtagcccatgctggagtgcagtggcgcgatctcagctcactgcaagctccacctcccgggttcaggccattctcctgcctcagcctcctgagtagctgggactacaggcacccgccaccacgcccggctaattttttttttttgtatttttagtagagacggggtttcactgtgttagccaggatggtcttgatctcctgaccttgtgatccacccacctcggcctcccaaagtgctggggttacaggcgtgagccaccgcgcccggcatttttttttttttaagagacagagtctcggccgggcgtggtggcttatgcctgtaatcccagcactttgggaggccaaggcgggtggatcacgaggtcaggagatcgagaccatccttgttaacacggtgaaaccccgtctctactaaaaatacaaaaaattagctggtcatggtgggtggcgcctgtagttccagctactcgggagcctgaggcaggagaatggcgtgaacccgggaggcggagctttcagtgagcggagatcgcaccactgcactccagcctgggtgacagagcgagtctccgtctcaaaaaaaaaaaaaaaaaagagagagagacagtgtctctttgctgcccaggctggtctcgagctcctgtgctcaagtgaatctcttgccatggcctcccaaagtgctgggatcacaggcatgagccactgcacccagctggtcaattgatttttgacagtagtgtcaaggcaatccaaaaggaaaaaggatagtcatttctttctttctagaagtcttgctctgtcggccaggctggagcgcagtggcacgatcttggctcattacaacctcctcctctttggttccagcaattctcctgcctcagtcacccaagtagctgggattacaggctcacgtctgcctaatttttgtgtttttagtagagacagggtttcaccatgttggccaggctggtctcaaactcctgacctcaggtgatccccccgcctcagcccaccaaagtgctgggattacaggtgcccatctaggatagggtattggaacaactggatatccatataatagaaaatgaaacttgaaggctgggcgcggtggctcatgcctgtaatcccagcactttgggaggccgatacaggcggatcacttgaggtcaggagttcgagaccagcctggccaacatggtgaaaccccatctctactaaaaatacaaaaattagccagacgtggtggcgggcctgtgatcccagctactcgggaggctgaggcaggagaatcgcttgaacctgggaggcagaggttgtagtgcgccaagttcacaccactgccctccagcctgtgcaacagagggaaactccgtctcaaaaaaaaaaagaaaatgaaccttgacctctgcctcatccttgagataggcaaagatttcttaggatactctaatcactaaccataaaaaaatagagaaatagatacattgaactttatgaaaatgaaaagcttctgctcttcaaaagacaccattaaggaaatgaaaaggcatatattgccaacaagtgtgaagtttgtttcatgctatatatggactaagccttccctagtttcatagatactgctggtagaaaacttaaaactcctgtgtcagagatagaggacagtttattactgatagcaatagcagttatcagaatatcagtatgtttctgccagctccccaaacctcaggtgtaacaggatgcattagcgattgtacagattccaccttggcccacaaggaggacatctattgcagtttgatcatcaagaacaacccccggcagagagttcaggcttacctgaatgacttctactaccatggtaggatggtgtcatggatcagttcaaatagtcagggagctatagtggctccatgccattaaacaaggcttaacattgtttttagttctgagcagcacagtactgtggcttgtggcttaatgtttttggctacccatgatttatatgagatggcaagaaggtcctcatgtctggcgccatctgtttcaatcttgagagctctttgacacagtgccctagccacagtgctttctagctgaggtcgtggagtttgcccctctgcctgactcaagctagcagtgtgacctttggtgagtctaccttaatccagagcatctgctttcccattactgagataaaatctcttaaatcctaaatttcaacataagggctagaggagttttccagagtggcagggctgactgcatagatttacgtacatttctttgagttactttctcattttctgtgaggttacttttgttccactttcactggatttagcattctattaataaatccaatccagggcagtaagagcctgaatactcttcaagtcgtcgtccttggtttcctataatacaagagtgtatctttctctgcgagatctccctgaaaggatgaaagcacccaggacccactttgagacattttgctgtcatttccaaatggatttaaggttggcataatagactacagaagaggttgtactgtaagacaacccacctgatcccattcttccctaagaagcattacacaccctgcccccttatctcccaagtgaaccagccattgttctaatgattggcctggtttgtgctcatgaatttctcttttcatgctcattatgagtgtgtatctctaattgttttctgaaagggagtagactttatggctacacaaaatgaatcttagtactgttacttagtacttgttacagtggtacagacctgaggctgaccaaacaggatggcaaggaagtcccctaacctggaagagatttaggaacaataaggatgcctttatagcagctgtgtttgaacctatttcctggtattcagcatgcagccacttccacaattcttccttattaatagacagtaaaaggaagtgacatttgctgcccaaccgacaatataacttaattagcatgttcgctgtaggtgcccagtaacttctgcaaatctctacaaggccctcattcagaaagaggaagagtctgtgagaatcccatcctcatcaccaaaactgtcaaaaactgtaaagagtttgagattttaccttacttgtgagcaaataaggtagcctgctacagtttcatgaatgctggtagaagacatgagactcctgggtcagagacaaagggcagtttattactcacagcagcagcagtagctagagtatcagcatttttctgcttgttctctgagcttagttcccacagagtaagagggccaactgactcctaaacaaccagtgcggtgtattacagatggggaatcctgaacttaggtaactcaaattttttacaacaggcaataaacatggctacccattcctctgaggaggcaatatcttcactatactggacaataagaatgtttgccctggctgggcgcagtggctcacgcctgtaatcccagcactttgggaggccaaggcaggtggtcaggagatcgagaccatcctggctaacacggtgaaacaccatctctactaaaaatacaaaaaaaattagctgggcgtgatggtgggcgcctgtagtcccagctactcgggaggctgaggcaggagaatggtgtgaacccgggaggcagagcttgcagtgagctgaaattgcgctactgcactccacactccagcctgggcgacagagtgagactccgtctcaaaaaaaaaaaaaaagactgtttgccctttgaccttgagggagacaatgtcctttcctattactgcctatccattgggccgcttgagcggcctcactgtttggcagttggcttcccctagagacaagtaacccaagaaagagcaaggcagaagctgtatgtgtatatatatatatatatatatatagagagagagagagagagagagagagagagagagagagagagagagggagagagagagagagagagagagacaagtaacccaagaaagagcaaggcagaagctgtatatatatatatatatatatgtgtgtgtgtatatatgtatatatatgtatatatgtatatatatgtgtgtgtgtgtgtgtgtgtgtgtgtatgtgtgtgtatatgtcttttatcatttatccttggaaaacacaccctatcccttccacagtatcctattggttttacatgtcagccctagccactgtggaaggagactgcacaagggcattaatactaggaagtgggaatcactgaggaacaccttggaggctgacttgttatcacaatggctgtatagttaacaccatagtttgctgaataaagagtatatgggaactctgtactattttctaaaactttctataaacctaaagctatttcaaagtaaaagttaaagaattttaaatgaaaatataaggtccaggagtggtggctcatgtctgcggaggccaaggcgggaggatcacttgagcccaggatttcaaggctgcattgagccttattgtgccactgtgctccagcctgggcaacagagcaaggctctgtctctaaaaaggaaaaaatctattaaaaaagaaaatatagattatagaccagaagaaaatatttggtaatacttatatctgacaaagatctagtatctacaaaatataaaaaaatcttaaaactaataagaagacaaccaattaacaaatggtcaaaagacatgaacacgtacttcaagaaagcattcacttggccagtaagcacatgtgaagatattcaagatcatttgtctggctgggcgcagtggctcacacctgtaatcccagcactttgggaggctgaggcaggcagatcacgaggtcaggagttcaagaccagcctggtcaacatggtgaaaccccgtctctaccaaaaatacaaaaattagctgggcgtggtggcgggcacctgtaatcccagttactcgggaggctgaggcaggagacttgtttgaatttgggaggcagaggttgcagtgagccaagattgcactgttgcactctagcctgggcaatagggtgagactccatctcaaaaaaaaaaaaaaaatcatttgtcatctgggaaatgcaaattattaccacagtaagatatatttcagtcccaccagaatggtcaaaattaaaacaactgaccatgtcaagtgttggtaaggatgtggaacaacaagaatgctcatgcattgctgggtagactgtaaaatagcacctctttggaaaaatactcctgtagtttcttacgaagttagacgtacgttttcccaatgaccttagcaattccacccctctgtatttatatgtgagaaattaaaacatgaccactgagagagttttacacaatatccatagcagctctattcattcataaactagccttatgaatgaaagctagcagcaacccaaatatccattaataggagaatggatagacagattgggatacagatctttcttctgatatgtgttgagaatatttgctgctagtttgtggtcttccttttcatttttaaaaatagtttctttaaaagactaaaagtttaattttggcaaaatccaaatatttgtggttttaccatttcaagtcattacttgcacacaactctcacactgataggagactgctaaatcctctgcagttaaggagtctgtgggagacacgcaggggtgtcagttgttttgcaatttggacagattccagaacctttgcttaaaaggggccccattcaaggtgagtcatttcgcaagtaacaacatatatgggcttaatacaatttgtaatgagaagtatgtttcctccagaacccaaaagagcctaaaagaaactgtgggtgctatgagagtcaatagctgtttcttgacagtgtcatggatggagttgccttcagtttacccaataatgttcagaaatacaaccaaggccttgctctgtgtgtaaggcggtgggtcaccccgtgagctcctttcatttgtatgtcccgagtgagtgtatcaaaggaatctcctcagcggaggaggtcatcagtgtgatgtcatacctgcattcctggggaaagtagggtgcagtttcaatcttgccctcgaagattgtatgttacagtgaggctgtttaaagtaccccgtggtagctgggtaaaactgtattgggtccctttggaggcaaactgcagtcaagagtgttgaaataggcactgaacaaaacatattcaccaaatctataataccaaaatatttaccagttgctggttagatgaagtcagtaatttcagttatattgggtatgggtccttagtgaagtccacagcattgaggttgaagtaatccaccaggaggcaccatacattcctcccaagtggaaaagctggtcaaattgggctgttaaatggacaggcagtggggataatcaccccttttctaaataggtcttgtatagtgggttttaatcattaaaggccctgttttaatttacatctggctgtattaactgttttcatggggaagcagtacgtccatggggtccattttaaaaaggcaatttgttagtgccaaagacttaaaattaattcatgactctttgggtcagagtgtccatgaccactatgggatattttagaacaatgggtgtgatgaccatagggaattaaggcaagacagaattcctgtggttagggcgaggcatgcatacttgtcctttatattatgttcaataactcccctaagattatagggggacccttgtttaaatttaggaggatcgccaatattgattaagggcacaaaggtttgccaattggtatatttcagtagatgttaattcagagccagtgtcatagagggacaaaagccaattcctgcccttttatctatgtattgtataaattcagtgaattttgaaaaaccagttgggccaaattgtggacttctgttttagtttttgtttttttgtgtcctgcctattctgaacggaattgtgtgcccccaaattcacatgttgaagccctaactcccaatgtgactgtatttaaagctagggcctgtaaggagataattaaggctaatgaagtcggaagggtggggccctaaatcgatagtattggtattcttaaaagaagaggaagagagacaacagactcccccattccccccaccccgccacacacatacacacacacatgaaaggccatgtgaagactgagcaagaaggcagccaactgcaagtcaggaagataggcctcaaaaaagaatttctcttcctaagagtaaaaagacatttgaggttatttagtttttaattttgttgttgtttttataccatgtatttatatatatttgtcaagggcatgcctccatttttaaataggaaaggaaaattatatagctgaaaactgtgcactaaattaaatgcactaaaagtgtttatagaacttgagggtaagagataattagattattagacatccaatctcatcccatcccatctaatacatattagatatatacatctaatatgtgtatatatatctaataatgtgttatgtatatctaatgtgttatgtatatctaataatatgttatattattatgtataataatgtgttatatattaactgggcaatgcgatgtaagaatgttattttcttggataaaatttctgagaatttatgagttgagctgaatctaataaaaatagttgaatccaaaattttagcttctgtatttatataaataattattattaataggtcatttcaatagaagtattgctcattagagagtttcagtatctatttattagatagaaatgagccttttgtcattaaagtataaaaatacaataaacaagtacattaaaaattttttttaatttggccataatttttagtgccaaataaattatatgatgctttctaattaacattttatagtccaaagctgtgagaggaaaagtccatatagattactttaaaaatacagccctaccccaagaatatagaggattttcagagacaccaaatctttgaacatagtgggttttatggcaaaaatccatcccaaaggtacatgatttgggaatataatttaagttttcatatcagttcttactttggttgctatattttgaggtcattacattacaatatttaataatttgaaaactttttattttgtattcagtatggagatttattcccagaatgggcttttctgatgcaaaattggagtgcttgtatagtcacaacagctgtctccacaccatgtggtatcttccattactttactgtagagatgaatatttggcccggtgtttcggtaagattggacacacatggttttaagtggcaaagcagtatgcttatgcattcatttgactttcacagctacagttggctccagattagaagagggagagtacattcacaccatggccaccctcatggctgctgtagtagctggatcacaggaggctctgttgcttctaaagacacaactaactattgccgaggaattacacattcaccaaagtgccttacagctgtaggagggagaataatgcattgctaaaagggttctctcagatttcagattatggccctagtcactatcgagcctctttaaaaatattaataataaaaattatggccataaaataactatgaaacttaagactgtcatagcagtaggtgatttttcaggaattcaatccaaatactttatataaaatttttatttttcagaaaactactatgcttttacacactcattaatctaattaaaatcagatttgtttttaatgtcaatgtttatgtatgcagagtatttgggaagttgatctgttaaaaatagaaattattttaaagacttagtttactacctgaaacaatgatttatattttagacattgtagacaatttttttgctccaaaaatgttaaaataacatagaaattaggtaatttgatttagtgtgatttcgtacatactgtatggtttgatcagtatatatctttatgcaatgatcaacttcaagctcttcatgacatgatcttttactgtaagcttatttaaattctgcctaaaacttaagtcttttgcatttctgaaaccgattggtctacttattaaagctttttagcaataaaactatgattttgttgaaaatccaattatatttctctaaattgtagctgaataagaataattcttttttccttaaataaagacaaggagaaagaaaaaaccctccgtgtaaatttttaagtcatctgatatgaagaattggatttctgatattcattaaatatcaaagaaattccgaccagacccaatgtgggctacctttttatataagtgaatttatgcatgtattgtagaggctgtactgatgaatatgtttgaggctttcagctcttagtggatacaaaatagaatgattgataaaatcctccctactattggctattatttactgactcttaagtggcaggttgtatttatgccaatttatctgcttcagcgaacattcttgatagcagaacaaagtgaataaaagtagtttgctttgcaaatgaatgcaaatgggagagcctttcggaaagccctttaacaggggcaatgcactttgattatgagtgaagctgccatttggacatggtgaaaagagcacgcttgaaccattgattgggggagacagtaaaaagtcaggaagggccccgttaagcttgcagtgaggcaggcggatgtcagtgtggttagagcacagtgggagaatgacagggaggattagtgtcagggagaagctttgctgtagctgtggagatagtccctggggtcactcacctctgactgttgttctgtgctgatggttctgtaatgcaaactgcctgatgtatgcctgttcattatcggaaatggtgattagaaaaggtatttgcctcaaaggtttccttctttccctctttctttttctttattctttcattttaattaaaggaaaataaggtaggcttcctcagtctctatgctggctactggagtattgtttaataccagagtgctttattgcctctggtggagaatagttcagtactaaagtgtaatgtgaaataattgtaacgtggttatttgttgtttgataataatttatttctctgtgctcactttggggtttgactactgctagtgctgagaaaaatgcagagaatatgcttgctgttagactttttgcatatgcgtgtttataatctctaaggtatttttaaatttagtttaatcatttagtcaaagctaaaagttgaccaaaatgaaatggtcaaaataaaatgaaatgctgctttacatggacttgatggtttgagtcttggccacaagagtttctaattttatttctgttccgaagtttaaaaaaaaaaaagagtgacatttgacaagctaaacttcttgaaaaaatattattttaaaattgaatatcgttacatagaatgatcataaagtgtcattgcagttctgatttcagaccagtatatttacttgttcacatttcatttatacttgtaagttttttatttttatttttgctttctttaaagtgtgtgtttaaaaaaaaaaagagagagccctttaatagtaactttatgtgaggcatttatgagcagcactgcattttatagcaaggatgcatttcataagctttgagaatggtttctcattttaattcaaagctgaatggtcttttttaaaaaatgtctgcaaaacctggttttgcaatatttatgctttcttagttagtatacgtaggaaatgaaataggcttctagagctttgcattccagtgttaaatatgcagctcaaatctttattgaaactattagatacaatttagtattgttttttacagaaagcatattgccaataatttgcttcacagcaattatctctcaattatctttttttattcttccaattatctttttattttctcccaattatctttttttattttctttaatgttttgcaggcacctgaatggacagaagaggacctcagccaactgacaagaagtatggttaagttcccaggagggactccaggtcgatgggaaaagattgcccacgaattgggtcgatctgtgacagatgtgagttcactgagatttgcattgtatagagagagaaaccagaacaagtcagctatgtagaaggcagacatagatgggttccacagtatctttggggaggggatacaacaatccttttaggacctgaaagtgaaccattaatgcaataagtgagaagcagatgtgagccagtcccctggtccacagttaacagctgtgtgaggaattctagtgtttagagacttaagctactgtaacctaatcaaaggaaaacaatgccagtttttatgtttatagtgacccctttaactgtggaaaaaatagttctcaaactgatcagaattaggagggttgtatttcagctggatctttttaacattgaagtacagattgcgattgctatttagacaggtggttctgattaattaaatgagcaatatacccataatgcaaatggtgttggcctttttgtttcaaggatgatagcaacagttcgtttgataagtagtttaaccagaagaaactgtgtgtgtgtgtgtgtgtgtgtgtgtgtgtgtgtgtccatacgtaacatttaaaagataaattacttacttggaaaggttttgacttaatgctttagatgcttttattgaggaaatttagagcagaaaattttttagaaagcacctagcacagtgcctgatgtgtaatatactaaatacacagtaaatgtttaattgaaattgagaaaaaatattatttttatcaaattgatattttcatgagggatagtaaatatgctttactaaatttactttaaataaatcctatagatccaaaaatacttagagggttactgaaagcaaagatttaaatttccccttccattctgttagtatacctttaggccttttatagtactgatagttttttaaaacctgcaaaatgattactgaacatggctaccaaaaggagcttataaatgctgtaagttactttcaataataaacttccactttttagtttagaaagaaacgtacagaaattattacagttgcgcatctctaatccgtcacgttggcgctcaagttgcagatttttgagcaatttcagacttttggattaggtatacttgacctgtactgtcaagttttgtattgttttgttttgtttttgcaatggacctgctttgagaattttaaattatatatatgaatattgttactactgtataggtcatttaaaagactacaatctggatttttataagacgtttagcaatatttttgcttcagagttgaagtttgatcataggggaaaatagctgaagtattttgtaactttttttttttttttttgctgtgtttcatgagtagactagttatcttgagttactagaaaagaaccataaggataacttttcttcagctaaacatgttactggatggtgtgttttattatctcggttttaaggttgtttgtaaaagataggttaataatgacatatcagtaaatatctgaccaaattaaagacattccatggtttttgatgttttaagtactatgacctactaattacatagctgctattaatacagtgattatcaaaagaaactaaaataattttttaaagttataaaacattggtttaaaaaggccctaaacttttagttcaattgcttaatgaaaaataatagtaatactaatgtattatctcctttgaagactgcaccacatttaacttctaagataatatttctataaggctctacatttgatgctaaaggcagataggaaactgagtaaagcaatattttaatttgttgtcattaaaacctggtaaatttttatctgtatttttaagaggagaaagatgaaaattttttaaatgccaagaatacacaggatataaccaacaaagcctcatagatcctagtatatacttaatttactagagtagtcttggtgctgtcaaaagcatctttttaaacttttgcaaattcatcccatatgtctcctttttttcctccctagacttacccaaggcagaatgattccgtgtctgcaatagatattttttccctttatcatggaagtggaaaacctgacattgtgaagtgattttttttttgttttttgggttttttttttttttggccaagtattagttctgttttcataataacaaaggtaccttggaaataaatatgtaataaatctaaacttttgttgtacaaaaaaatgccattataacttttcttctatgtcaatatatatatagacccacactgcattttcattctgtaagcatcatctccatggctggactattcatttcaataactctcctgtcccccaacacatgcatatgtccacacacacacacacatacatacacacacacacacacacacacacacacacacacagaaaatcactctgtaaaagagaacaggtgtctgtagaatcagtaactcacagggatgacttgtaaattacattgaaacagctaaaatggttcagctagtattgtttctctagtataatgttaagtgaaagttaaccacactttaaaaagaccacttgtgcctccttttggcttatggtgttaattagatttgttttcattaagtattcgattatgaaaaagtagccaggttcaattgagtgtcatcagaacctctgcatactgacctgatcacctgcctagttctccctggctttgcacagctgttctttgaccgggtttccttgccaaatttgtagcttcaggcttagttctctttccttcaagaaacaattgaccttttgggagagaggtgagtgtgtgccagtggtgggatttatgtgattctttatttgggttgtcggattacagttaaaaacctttttattcctcaattaagaaagaaattaagtatattaattgtcataattagcagagttagattgctaaattgtactctggataaacacaagcaatatttttttaagctttttaaaaaattgacaccgagtatattttaattcagatatacctaatctgtaaggcctactttattatggattaaatattttaaatgttgatatatgcctttcagcaaataattttggtaatcacaaaggacactcaaattgtaaaaataacagcggaaacaaaaactgtctcgcatgtaaaaccaactttaacatgatgattaactgcaggtttcctaaattaaggtcagggggccccagatttcttgcttgtgaagtaatactattcttttgcctgaaaggatgtaaactgattctgcttctctccctggtcactaatctcttgcattctggttgtgataacagactgataggagatttttctgcctctttggaaaaggcccaggtaggcagcaaaacaaaagacaggtggctagatttaaacaggcttttataattagcttagtgccatagtgtgaggtaaggggtgtgtagttatatatgtagcccattatgcaagtgaagaggaggaaggaaaatcataaaattcccaattcatttgtatagctcaactgcaaggagattcctattgggggaaatttatatattgttattatgctggtttcaaaaacacgtaagtggactgttccatggaaaataagcattatggtttatcagtgaactaaatatatagttattatcttggcaaatatattgttattacttttagagtcaggccagccctacacaaaattataaacatgataaggactgtccttttggtttttctgccttcgtcctcactgccgctgtaccagtttcctgctacagtagttctcttggtctgagccacatctcatactcctctcccttccttctcttaccctctcaaccttacaacttttaaagatatttaaattttagaaaacatgtgcaggtttgttatacaggtaaactcgtgtcacaggggctggttgtacagattatttcatcacccaggtattaagcctactacccaatagttattttttctgctcctctccctcctcccaccctccaggccccagtgtctgttgtttccttctttgtgttcatgagttctcatcatttagctcccgcttacaagtgagaacatgtggtatttggttttttattcctgcgttagtttgctaaggatagtaccctctccagctccatttatgttcccacaaaagacatgagctcattcttttttgtggctgcatagtattccgtggtgtatatataatcacattttctttatactatctatcattaatgggatttcggttgattccatccctttgctgttgtgaatagtgctgctgtgaacattcacgtgcatgtgtctttatggtagaatgatttacattcctctgggtatatgtccagtaataggattgctgagtcaaagaaagggtagttctgcttttagctctttgaggaatcgccatactgctttccacaatggttgaactaatttacactcctacctacagtgtataatcatttccttttctctgcaaccttgccagcatttgttattttttgactttttggtaatagccattctgactggtgtgagatggtatctcattatggttttgatttgcatttctctaatgatcagtgattgagctttttttcatatccttgttggctgcatgtatgtcttcttttgaaaagtgtctcttcatgtcctttgcccactttttcatgggattatttaagctccttatagatgctggatattagacctttgtcagatgcaaatattttctcccattctgtagcaaaccaacatttatattttcaattgctttggtgataatattgattattccattattcatttttgtagtattttacgcttttcaaaacatttaaatatacttttatttgttttttcataatgacacagtgaagtagataggcaaccattatttttccctattttacagctgagtaaactgctgttaagatatttgttcaaggtgacacagttgttagtagaactgggacaagatcacatattttgattccatacttatatgtttttacctctggttaattctgctttactgatgtttgtatggaaaatactttaaatttgtctagagatttatatcattaactcttttttgataaaactctatgttcatagcaaaaagaaaacatcaaagaatacacttaagctaaatttttttctaatcaaccataattttaaagagatctctgtgaacatttctgtgtaacattgtataaacaatgtataaacgttgtatatcattctagagactttagcgtttctctgtatatgtatggatatgtataattttaataggattaatctactttctgtccttttcacatagctctagaacatgagcatctttcatggcaataaataagatccacatcatttttctaaagagttacacgatagcccatgctgccatgatatcattaaagaatatcctatcggttgacatttaaattgcttcctttttttgctatttcattgagatggacatggtgttttaaaaaattgtcttttcactcatatctattttattagcttgtgtgcctagaactagagattgcattcctagaagctgcttagttcaagaatatgaatgtttttagagcctctgagggctctgaaattggcctgcagagaggttataacaatacacattcccactagtggtatatgagaggtcacttcctcatactctcataaaaaccaaacactacatttttcaccattgcccatgaagtgaaaagtgttatagtattgatctttgttacttgcaaaagaaaacacagagacttggtacaaggggtccacgtctgatgaggggttctagtgtgggacagagaaaacaggggcaagatcattgttcagtaaataatacagttaagttttcaggatttggggacacctgaaacaactttgtaagagtctctcaaaatcaaggaggagacatggaaaaggtcttggggatatttatgaacactgagcatacacagatctttaaactttctatggataagatgtctccaaagtaaaggaaattggaatgacacaggtccctcagcaacactagattctgtgggatgagggaacagtgccttcacagtgctcaggggaaatggttctgaatctagaactgaccaagtgtgatggtaaatacgtggggtgagaactcgtaccctttcctagaaattttcctgaggttgtactccagcaacaaaaggaataaatcgaagaggacaacatgggatccaagaaatggtgaatcaggagaactaaggacggcatgatagggaccctgggagggagggaggtttcatagaatagatagtatggctgagaacttggaaaaatgcctatgtaaaaatgtggaaaagaaaaaaaaggcaaagtgcagcaactaatgcctgtaatcccagcactttgataggctgggacaggaggatcacctgggaccagaagtttgcgaccagcctgggcgacatagggaaaccttcatctttacaagaaaaggaaagaaaaattagccaggtgtggttgcacacacctgtgtgccagctatttgggaggctgagtcaggaggatcacttgagcccaggagatcgaggttgcaatgagtcatgttcatgccactgcactccagcctgggtgatagagtgagcccctgtctcaaaacaaaaaaacaacaacaacaaaaaacagtaaaaagcaaccagaaattccacaaagaacatggaaaccacacgtaaaaagacatagtttaaatttaattatactacagagtagattggtagaaagagcacttgtttcagtggtgaataatatttaccaggtcataattatgtaatatcttacatgatggttttttatattttaaacattttatatgttttacagattatttttcagtttttaaaatccacacattgtggaggactgtggcatgttgttcaccaaagtaagttctctccttcttctctagcagtagattgttggtcaggcacatatgtgcacaatgacattgcattcccaagcctcccaaactctgatatggctgtatcactaatttcttttcaggagaacataaagtaatgtgtgttcatatgagcccttatttatttttccctcccactgagctagaatactaatatgcctgcaactaagttgcaaccacgcaagcaaagatagttgccctaaggagctgtggagaaacaggctagaaagaacccagatgcatgcaatgaaagaaaattcttgggtagtgacaagtaacatgaagaaaaataaagcagggtaagcagatagagactgatggagctgcattttaaaatagggttctgaggaaagtgttctcggagaggtagtatttgagcagaggtacaaagcaagtgaaggagcaaggttgtctgagaaggagcattgctggcagaggaaatagcacctacaaagtcctggaggcaagagcatgtctggggtttgcaaggcccaacaaggaggtccatatggctaaggcatgagtaggagaaggagataacaggaaatgagtctgagaagtagtggaagaccaggccatattggccctttttggccaaggtggaaattttggattttaccctgagcgagatgggaaagcactggaagattctgagtaaaggagtgcagtgatctaaaagcattgttctgactgtttggtggggaagtttgaaagcaggaaggaaggccaggtaagaggctatttcagttgtcctttcagaacacaatggtggttttggactagaggttgttggtagaggtgggaaagagattagatgcaggatgtggtatacaaaggcacgttaattagcaatgtatacttgtaaccttgtaaccttcagaagaactgtgagcggaaatgattgcctgtgtgtgtaaggtgcattgttttctgtcataagaccttgtgtactgcttttgttaaaaagctatgtacatgcatgaccttgatttttaaaagcgactttttaaaatgtgaagaaacaaaacatttgtctttgaatttttttcatgacagtatatataggcctacctcattatctgagtttgttctgtgctggtgtaacagactacctgagagtggataatttatgaagaactaagatgtatttcttacaattctggaggctgagaagtcaaggggcccacgtctggcaagggccttcttgctgcgtcatcccactgtagaacacagaaggacaagagagcacacaacatacaagggaaaaagaaaggaagggagctgaactcatccttttatcaggaactcactcctgcaataacccactcccgccataaggtcattaacccattcatgaggacagaggcctcctgagctaattgcttcttaaaggtcccacctctcaacacttttgcattggggattaggtttccaacaaatgaactttggaagacacattcaaaccatagcactcatttgttttaaaatttttttgtttaaaaaaattattgatttacagaactagaaaaaccaatcctgaagtgtatatggaattacaaaggacccccaatatctagaacaaccttgagaaagaagaataaaactggagataccacatttcctgatttcaacatatattagaaagttatagtaattaaagcagtatggtactagcataaagacagacacatagaccaagggaacaggaaagagaacccagaaataaacccacacatatacagtcaactaatcttcaaaagggtaccaagaatacatatggggaaagaaaggtcttttcaccaaaatggtgcttggaaaacttaatgtccacatgcaaaagaatgaaactggacccttacttacaccatgcaaaaaaaaaatttttttaatggattaaagtcttaactgtaagacctgaagccataaaatgcctagaagaaaatataggagaaagcctcatgacattggtcttcacagtgatttattggattataacaccaaaaacacaagcaacaaaatgaaaaataaagaagtgggactatatcaaactaaaaagcttctgtacagcaaagaaaacaattaacagagtgaagagacaaaccatgcactgggagaaaatatttgcaaaccatttatctgataaggtgttaatgtccaaaatatgtaaggaactcctacaactcaagagcaaaaaaataacctcatatttaagtgggcaaaggacttcaaaagacatttctacaaagatgacatagaaatggccaacaggtatatgaaaaggtgctcaacatctctaatcattagggaaatagaaatcaaaatgacaataagatacttcacacctcttaggacagccatcatcaaaaaaacaaaaacaaaacaaaaagaagtgttggcagtgatttagagaaattggaacccttgtacactgttgctgggaatgtgaaatggtacagttgttacagaaaacagtatgaagattcctacaaaagttaaaaatagaattatatgacctagcaattctagaaaaacttctagatgtatatccaaaagaagtgaaatcaagatctcaaagaggtatctgcacttccccgttcattgcaccattatgcacagtagccaagacatggaaacagcctaaatgtccattgatggatggatggctagagaagatgtgggatgtacatataatagaatattattcattcatgaaaaagaaggaatggccgggtgaggtggctcacacctgtaatcctagcactttgggaggctgaggcgggcagatcacctgagctcaggagtttgagaccagcctggccaacatggtgaaaccccgtctctactaaaaatacaaaaattagctgggtatggtggtgcatgcctgtaatcctagctactcgggaggctgaggcaggagaatcgcttgaacccaggaggtggcggttgcagtgagccaagatcatgccactacactccagcctgggcaacagagtgagactctgtctcaaaaaaaaaaaaaaaaagcggaaatcccaccatatgtgacaacatggatgaacccctgagaacattatgctaagtgaaataatcttctcctataaggacagatactacatgattccatttttatgagttatctaaaataaccagattcacagaagcaaaaaatagaatggtggttgccaggagctgaagggagggagaaatagagagttgttgttcaatggatataaagttttggtaatatggatgagtaagttctagaggtctgctgtaggatgttgtgcatatagttaacagtattgtactgtatacctgatttaagagagtaaatctcatgttattttagtaaatttgtagagttgtgaaatcgccacaatccagttttagacattttcatcacccgaagtgttccctcaatcccattagcaatcatttcccactcctgttctctcaggctacactgatctattttcttttcaggatattacatttaaatggaatcttaacagtatttagtcttctcctgttctctcaggctacactgatctattttcttttcaggaaattacatttaaatggaatcttaacagtatttagtctttcacatatggctgctttcacttggcgaaaggtatttgaagttcatccgtgttgtagcatgtatcagcagttcatttcttcatattgctcaatatttgtgtgcataaatactgcattttatttattctatactaattggtcatttgtcttatttccactttggtgctgttagaataatactgccatgaacattaatctgtatagtacttattagccattcctacgtcttatttagtgaaatatctattcataatttttgcccatattttaatttggttgtttttcctgtcataagagttctttatatataggttagacatcccaaatctgaaaacctgaaatttgaaatgctcaaaattccaaaactttttgaccaccaagatgacactcaaaggaaatacttattggaacatttcagatttcagattttcagattcagaatgctcagctggtaaatggaatacagatattacaaaatgcaaataaatctgaaatctgaaacacttttggtcacaagcattttggagaaggaatactcaacctgtatattatggactcaagtctttcatcaaatatatgatttgcaaatatgttctcccactgtgtggtttgtctttttgttttttttaatggtgtcatatgaagtacaaaagtttacttttagtaaagtccagttcatcaatttttttcttttatagattatgctttttagtgttatacctaagaacttttcctaacccaggatagcaaagaatttctcctacattttcttagaagttttatagttttagatattacatttaagtctaagatccattttgagttgattttttgtgtttaatgtgagatttaagggtcaagttcattttttttgctcatggatgttcatttgcattgactctatagatcaatttggagagaactgccatcttaacaattttgaatgttcaaattcatgaacatgaaatgtctttcattcatttagagcttttacaagttctgtctacagtgttttcaatatgcaaatctggttcttcttttattaaatgtattatttttttcagcttatagagaagaaccattttcttttctctctctctctctctttttttttttttttttttgaagataggaacttactctgttgcccaggagtgcaatggcatgatcatagataactgaaactttgaactccttggctgaaggaatccttccacctcagcctctcaaatagctgggaatacaagtgcatactaccacacccaactagtttttttgtgtgaagatggaatctcactatgttgccaaggctggtctcaaactcctgacctcaagcgatcctcccgcctcagcctcccaaagtgttgggattacaggcgtgagccaccttgccctgccagaattgttttatttatttatttacatttttatttattttctgacagagtctcactctgttgcccaggttggaatgcagtggtgtgaccactgctcactatagcctcgacctcctaggctcaagcaatctgcccacttcagccttcccagtagctgggactacagggatggaccaccactgcccagctaatgttttaattttttatttgtaaagacagggcctcactatgttccccccaggctggtcttgaattcctgaggtcaagagatcctcctgccttgacctctcaaagtgttgggattacagatgtgagccactgcgcccagccagaattgttttcttaattacactttcaaattgtccattgctggtatgtaggaatacagtggatttttatatactgggttttggagcctgtggacttaactaacattgatagtttaatagttctgtggataaaaagtttttattcttcctttccaatctggatgccttcagtccatttatttacttaatatcttgttgcactggctaaaacatctagtacaatattatacagaagtggtgagtgcaggcatacttgccttgttcctgatcatggagggaagacattcagtctttcaccattaagtattattttagctgtaggtttttcatagatgcttttctttcccggccccccaacccctgagatggagcgcccagttgcccaggctggagagcaatggcacaatctcagctcactgcaacctccacttcccgggttcaagtgattctcctgcctcagcttcccaagtagctgggattacaggcattcaccaccacgcccagctaatttttctatttttagtagatacagggtttcaccacgttggccagactggtcttgaactcctgacctcggatgatctgccctccttggcctcccaaaatgctgggattataggcatgagccaccgtgcccaggctcatagaagctttttatctaaggaacttcccttctatttctagcttgagcatttttatcatgaatagacattggattttgtcacatgattttgcttcatctattgagatgatcacatgatttttatcctgtgttttattaatatggcatagtatataaattgatctttggatgttaaaccaaccttacattcccacttgatcatgttgtatatacattttatatggtgctggatttggttagctaatttttttttttttttttttgaggtgttgtctcactctgtcacccaggctggagagcagtggcacgatctcagctcactgcaacctctgcctcccgggttcaagcaattctcctgcctgagcctccagagcagcagggattccaggcgcctgccactatgcctggctaacttttttgtattttcagtagagacagggtttcaccatgttggccaggatggtcagaaactcctgacctcaagtgatccgcccacctcagcctcccaaagtgctgggattccaggcataagccaccacacccggtcaaggttagctagtaattatggatttttgtttctttgttcatgagagcgaatggtctatagtttccttgtgatgtctttgtctggctttgatatcagggtaatgctagcctcatagaataaatagaaagtgttccttcctcccctaatttctgaaagtttgtgaacaattgttattatatcttctttgagtatctgatagaattcaccagtgaagccagctaggccttggcttttctttatgggaagacttttagttactaattcatttgtttttaagttattacgggtctattcagattttctatttcttcttgattaaattttagtaatttctagggatttattcatttcattcacatcagcggttgtgctctgaaagtgcttgaataataaaagtgtggctgatattctctccaaagaagatttttttttgaccacagatttcatttctttaatgatgggtgaactatccatgtttttcatttcttttggttacgctaagctaacggtttatcaattttgttgatcttttcaaaaaatcaactttttgtttcattgatctttggtatggttttttcagtttcaattttatttctactctgaactctattattcctttctttctgctaactttgggtttggtttcttgcttttctagtccttgaaatgcatcattaggttatttatttgaaatctttctccttgtttatggctataatcttgcctctaatattgctttttctgtattcagtagattttgatttgttgtgtttttaatttcgtttgtttcaagaatgtttttaattttcttttaaatttttttattgaccaattggtcgttcaggagcacatttaattttcatatatttgtatggttttgaaagttcccttggtattgatttctagttttgtttcactgtggtcagagaggatacttgatatgatttctactttttaaaaatttgttgagacttgttttgtggcgtaacatgtggtctgtcctggagaatgttccatgagctgatgagaagaatgtgtattctgtagctgttggatgaagtgttctgtaaatgtctgttagttccatttggtctaagatgcaattcaaattcagtgttttcttgttgttgatttcctgtctgaatgatctgtccactgctgagtgtggggtgtcaaagttcccaactgttgttgtattggagtctatctctccctttagatctaataatatttgcttttatgtatctggtttctccaatgttgggtgcatatatattcacaactgtgcatatatattcacatcttgctgaattgatccttttatcatcatataatgaccttttttgtctctttttgcagcttttcacttaaagtctgttttatatgatataaatatagctatgtcttctcacttttgttttccttttgcatggagtatcttttttcttcctctactttcagtctgtatgtgtctttataagtgaagtgaatttcttatacgtagcatatagtatagttgactcatatttttaaaaattttattttgccagtctatatcttttaagtgaagaatttaatctgttcatattcaaggttattattgataaatgaggacttactcctgtcattttgttcattgttttcttgttgttttaggtatctttttttcctttcttcctctcatgtcattgtggtttggtggttttctgtaatattaagatttgatcctttttctgctttgtgtatttgctataacagtgaattttatacttttgagtgttttcatgatggtgattatcatctttttgctgccagatgcaggacttccttgagcatttcttgtaaggccaatgtagtggtgatgaattctcttagtttttgcttgtctgggaaagattttctttctcatttctgaaagatagttttgctgggtacagtattctttggtggcttttttttttttggcaatttattgaatacattgtttcattcttttgtagcttgcaaggtttctctggagaaatctaatgggaatcctcttaaatgtaacttgacatttttctcttgccatttttagaattttctcttcgtctttgcctttgaaaatttgatcataatgtgcctctgggaggatctttttgagttgaatctatttgggggtctctggatgccccagatttgggaagttttcaactattctttgattaaataggttttttatgcctttttccatgtcttctccttctggaacttccataatatgaacacttgttcacttaatggtgtctcataagtcttgtaagctttttttttttacttttttgattttttgctttttttctttctttctctaactgggtaatttccaatgacctgtgttcaaactcagagatttttttttcttctgttagatcaagtctgctacttaagctgtttctttttttttttttttttttttttttttaaagacagagccttgctgtgttgcccaggctggagtgtagtggcttagtcttggctcactgcaacctccacctcctggattcaagcaattctcatgcttcagcctctctagtagctgggattacaggcgtgcaccaccctgcctggctaatttttgtacttttagtagagaccaggtttcaccatgttggccaggctgctcttgaactcctggcttcatgtgatccacccaccttggtctcccaaagtgctgggattataggcgtgagccactgcacctggctgtattttttattttattcattgaattgttcagctgcaggatttctatttgattctttttcatgatatttatctccgttgaatttctaatttatatcatgattttttttcctagttttgttgaattatctatctgtacattcttatatcttggtgagtttccttaagttcattaatttctatactggcaacttgtggatttccttgtcattagggtttgttattgaagagtcgtgttcctcttgtgatgtcatatttccttgattttcatatttcttgtgtccctgtattgatgtctgtgaaacaatagcctcttccaaactttctagagtggctttcatacatagagaaagactttcacctgcagttgggtcttacagtgccagttgggaagtggatggtaactctttccaggtaggtgcagtggtatagtctctgtgcagctttttcatctatattcaacattagtaataaatgtgactgcctcagtggcctaggttgtagacattcgtggttgtggcagcagcagcataggttgttaattctttggttgtaggggcttttggagtccttttctcaacttccccacggtggggaaacctagccaaggggatccctcttgctgtcagatctggcatggcctacaagcagctgccacagtggctaaattccaggtgcgggtgctcagagcagctgtggggctggagtcctaagctcagggtcttatgaaccttattctggcaccagggtcttggggtgcaagcttgctctctgtggcagggttggatgtaggttgctcttagtgctgggatctgtgactctgaggcaccttctagcagctcatgtccaggaggtcaggttgtagctgtgatgctacccctggggagcagttcacagctctggcctgactccagggaagaaggtgtgctctggaggtttgagcctaggccaggatatggctttgattcaggagcttgaaccagtagggctcagtgacaactcaggacgctggatgtgaggcaccatgtagtggtaactctacaatctgggatggtagggctcagcagtatctcagtctctgtgagtccaagtgcagtggcagcaagtagcccagaatggccgaacatggctgtcgtttgggccatgaggggcagaaaatggcagagtgataacactactccacaaacagggaggtgtcttaacagcccagaccatagggtgctggtccagctccagagaagcagggtactggagttgtttggcctgtagggtagggtgtctgagcttagccactgctttgtttccctgagacaaagggtagtacataagcttagccctgggatgcacagcttctcagctcagccaaggcatgagttccccagggggcaatgtgctgctatagctctggcctaaaggggtgtgactgcccaggcagcccagggaccatggatgcagggctccagcaaagccctctttccagcggaggcagtgcacagttccagctcaggcttgtaggggcagagcacagccgcagctgacagaggtaaatggagctgttctgtcaaagcaccctttcctctggagggagaaatggtgcttaagctccagcccaaggcaatgggaggtggaggatggaagttccaccactgcttggttccacagggaaaggtgctcacagctgagccacttgtggatgtcagaccactgagcagaggtgctctgatggtggggtagcctcagggatgaagggataccatgactactagcccccagagcaagactactccagcattagttccagttacaagatggtgtggcatggtggccatgcaggccacagcgggaggaacacagtattggctactcctctgggggagcaaagctgtgcagcttcttggcagctccctcagctgggcttagtgcctgtgaggactgcaggtgaccccagtggtgaggcctgtaggtgtctaaggtgttggtgggggctgctgggatcctcttgcctaccttttcatcaaagacagaagtggccacctggttcccagctgatcctggctgggggatggagtggcagaggcctggcatttccttcttttcatgatgtggctatcctgagtttctgcactcaccagggttgctgttacttctttgacatgctccagcactctcctttggttatttctgttaaaatgtagtggtttattcattgtttttggctgtctttgtggaagggatgagcactacgggtctctagtcagccatcttgctgatatcacctccccaaataactctatttcttcttctccttctcctcctcctcctcttccttcttttcttctttcttcttttttctcttcctctccttcccctccttcctcctcctcctccttttttctttttttgtgacggaatctcactctgttgcccaggctggagtgcaatggcatgatctctgctcactgcaacctctacctcctgggttcaagcaattctcctgcctcagcttcctgagtagctgggactacaagcgcctgccaccatgcccggctaatttttgtacttttagtagaaacaaggtttcaccatgttggctaggctggtctcaaactcctgacctcaggtgttctgcccacctgagcctcccaaagtgctggaattacaggcgtgaactaccacacccagccaagactctgtttctctctgagtaaattttagaacattagatttttctaggaatatatcccattaaactaaatcttgaaataaattggcataaggttgttaatattatttattacatactccctcctttattgtaaaatataaatatgtaaaacagctcaatgagtagctatacaacaaacaagattataattttcattagtacccagaaaataacattaacagcaatatcaggtagggatagatggtaattggatcgatagaaattcccgttttagtccaggcacagtggctcatgcctataatcccagtgctttgggaggccgaggtggatctcctgagatcaggagttcgagaccaggctggccaaatggtgaaactctgtctctactaaaaataccaaaattagccggtgtggtggcgcacgcctgctacgcgggaggctgaggcattagaatcacttgaacccaggaggcagaggctgcagtgagccaagatcacagtgagccactgtactccagcctgggtgacagagtgagactccatctctctctctctctctctctctctctctctctctctctatatatatatatatatatatatatatatatatatattcccattttaaaatcaaaacctcaacattagatctgaaatgaattttcaagagattgttatgggtgggaaatctgaaggcacccaaatgttagattaaatacctgaatttacatagtaaattcttaattcttcttaatgtatgatctggaattactcttttcccttatctttatcatattgtaactcaggtgtcagatggacctctctgcctcttggagatctagaaccaatgggctaagaccaacaacaactctatagtccgtgaacatctaaaaatcttcccattatgtgtgttaattcccaaggtgtgcactcttcttgcctcacgcgcctgtatcctagtgtgtcccctttgtactatacgacagtgaatttctcaaaaagaatctactcgtccaaaagcattaatgagcaggagtggatctacgttaaatggagcctgaagtatatacagtgatcaacattcctagtgatcttataggggaaatggaggaacgctctataacaaacaatttaaaatccatacattacatactagttatagatatcactgtggtccagtgcccttcttagtcgtacaatttccagttgcttttctcccttcccctcctccttttccatcttttttcatcttctctgccttccatttcctgtcactttctctcttccagattaaccctcaacctgggttctttcctgtgttcaacagagtactttgccttttcctctgatgtccaggtggcagttgccatgtaggcccaggagggcagggagagcattcaacttccacttggaacacttgccagactatcccttcaacaaagacagttttatttttcaaaggaattctagagccatctctagaattttgttatattttcgactgcctactctcccctgtcaaaggacatggaaagctaattcaaatgttctggtaaaggagtaacaactacttgcaggccttggaccagagaatatcctccttcagttttcttcttccacagaggacacaccttgaagaggagcaaaggcaatagttgagagagaggaacgagatatctaccaagcctgctggattctttcaatccttgcaaattagtagagtggcaatatcactggcagatacatctgatgcacactggggaaattgaagtacaaaggctttgcatcctgactgcctccacacaatgggaaattggcagtaatgcagcttaagaggatagaattggcctctttcttgagaggtgaggccagaccctcaaactgccagtgcacaaagctgtttggattgctgtttccttgctttggccactattgatttataaataagacttttttaaagcaagaagctgattttttttcttttttcttttattattatattttaagttctagggtacatgtgcacaacatgcaggtttgttacatatgtgtccatgtgccatgttggtgtgctgcacccattaacttgtcatttatattaggtatatctcctaatgctatcccttccccctgccccccaccccatgacaggccccggtgtgtgatgttccccttcctgtgtccaagtgttctcattgttcagttcccacctatgtgtgagaacatgcagtgtttggttttctgtccttgcgatagtttgctcggaatgatggtttccagctttatccatgtccctacaaaggacatgaactcatccttttttatgactacatagtattccattgtgtatatgtgccacattttcttgatccagtctatcattgatggacatttgggttggtttcaagtctttactattgtgaatagtgccacaataaacatacgtgtgcatgtgtctttatagcagcatgatttataatcctttgggtacatacccagtaatgtgatggctgggtcaaatggtatttctagttctagatccttgaggaatcaccacactgacttccacaatggttgatctagtttacagtccaccaacagtgtaaaagtgttcctatttctccacatcctctccagcacctattgtttcctgactttttaatgattgccattctaactggtctaagatggcatttcattgtggttttgatttgcatttctctgatggccagtgatgatgagcattttttcttgcatctgttggctgcataagtgtcttcttttgagaagtgtctgttcatatccttcgcccactttttgatggggttgtttgattttttcttgtaaatttgtttaagttctttgtagattctagatattagccctttgtcagatgggtagattgcaaaaattttctcccattttgtaggttgcctgttcactgacagtagtttcttttgctgtgcagaagctgtttagcttatttagatcccatttgtcaattttggcttttgttgccattgcttttggtgttttagatataaagtccttgcccatgcctgtgtcctgaatggtattgcctaggttttcttctagggtttttatggttttaggtctaacatttaagtctttaatccaccttgaattaatgtttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtgttatttctgagggctctgttctgttccattggtctgtatctctgttttggtatcagtaccatgctgttttggttactgtagccttgtagtatagtttgaagtcaggtagtgtgatgcctccagctttgttctttttgcttaggattgacttggcagtgtgggctcttttttggttccatatgaactttaaagtagttttttccaattctgtgaagaaagtcattggtagcttgatggggatggcattgaatctacaaattaccttgggtagtatggccattgtcacgatattgattcttcctatccatgagcatggaatgttctttcatttgtttgtgtcctcttttattttgctgagcagtagtttgtagttctccttgaagaggtccttcacatcccttgtaagttggattcctaggtattttattctctttgaagcaattgtgaatgggtgttcactcatgatttggctctgtgtttgtctgttattggtgtataagaatgcttgtgatttttgcacattgattttgtatcctgagactttgctgaagttgcttatcagtttaaggagattttgggctgagatgatggggttttctaaatatacaatcatgtcatctacaaacagggacagtttgacttcctcttttcctcactgaataccctttatttctttctcctgcctgattgccctggccagaacttccaacactgtgttgaataggagtggtgaaagagggcatccctgtcttgtgccagttttcaaagggaatgcttccagtttttgtcaattcaatgtgatattggctgtgggtttgtcataaatagctcttactattttgacatacgttccatcaacacctaatttattgagagtttttagcatgaagggttgttgaattttgtcaaaggcctttctgcatctattgagataatcatgtggtttttgtctttggttctgtttatatgatggattacgtttattgatttgcatatgttcaaccagccttgcatcccagggatgaagcccacttgatcatggtggataagctttttgatgtgctgctggattcggtttgccagtatcttgttgaggatttttgcatcgatgttcatcagggatattggtctaaaattctctttttttgttgtgtctctgccaggctttggtatcaggatgatgctggcctcataaaatgagttagggaggaatccctctttttctgttgattggaatggattccttctgtttcagaaggagtggtaccagctcctccttgtacctctggtagaattcggctgtgaatccatctggtcctggactttttttggttggtaggctattaattattgcctcaatttcagagcctgttattggtctattcagagattcgacttcttcctggtttagtcttgggagggtttatgtgtccaggaatttatccatttcttctagattttctagtttatttgcatagcggtgtttatagtattctctgatggtagttagtatttctctgggatcagtggtgatatcccctttatcattttttattgcatctatttgatctctcttttcttctttattagtcttgctagcggtctatcaattttgttgatcttttcaaaaaaccagcttctggattcattgatttttttgaaggattttttgtgtctctatctccttcagttctgctctgatcttagttatttcttgccttctgctagcttctgaatgtgttcgctcttgcttctctagtgttttgcagtggtagggtgtcaattttagatctttcctgctttctctggtgggcatttagtgctataaatttccctctactcactgctttaaatgtgtcccagagattctggtatgttgtgtctttgttctcattggtttcaaagaacatacttatttctgccttcatttcgttatgtacccagtagtcattcaggagcaggttgttcagtttccatgtagttgagcggttttgagtgagtttcttttttttttttttttttttgagacagtcgcactctgtcacccaggctggagtgcagtggcacgatctcggctcactgcaagctccgcctcccaggttcacgccattctcctgcctcagcctcctgagtagctgggactacaggcacccaccaccacgcccggctaatgttttgtatttttagtagagacggggtttcaccgtgttagccaggatggtcttgatctcctgacctcgtgatctgcccgcctctgcctcccaaagtgctgggattacaggcgtgagccaccgcgcccggcgagtgagtttcttaatcctgagttctagtttgattgcactgtggtctgagagacagtttgttataatttctgttcttttacatttgctgaggagtgctttacttccaactgtgtggtcaattttggaataagtgcgatgtgttgctgagaagaatgtatatgatttggggtggagagttctgttgatgtctattaggtccgcttggtgcaaagctgagttcaatttctggatatccttgttaactttctgtctctttgatctgtctaatgttgacagtggggtgttaaagtctcccattactattgtgtgtcagtctaagtctctttgtatgtctctaagtacttgctttatgaatctgggtgctcctgaatagggtgcatatatatttaggatagttagctcttcttgttgaattgatccctttaccattacataatggccttgtctcttttgatctttgttggtttaaagtctgttttatcagagactaggattgcaacccctgcttttcttttttgttttccatttgcttggtagatcttcctccatctctttattttgagcctgtgtgtgtctctgcacatgagatgggtctcctgaatacagcacactgatgggtcttgactctttatccaatttgccagtctgtgtcttttaattggagcatttagcccatttacatttaaggttaatattgttatgtgtgaatctgatcctgtcattatgatgttagttggttattttgctcgttagttgatgcagtttcttcctagcatcaatggtctttacagtttggcatgtttttgcagtggctggtaccagttgttcctttccatatttcgtgcttccttcaggagctcatttagggcaggcctggtggtgacaaaatctctcagcatttgcttgtctgtaaaggattttatttctccttcacttatgaagcttagtttggctggctatgaaattctgggttgaaaattcttttctttaagaatgttgaatattggcccccactgtcttctggcttgtagagtttctgccaagagatcagctgttagtctgatgggcttccctttgtgggtaacccaacctttctctctggttgcccttaacattttttccttcatttcaactttggtgaatctgacaattatgtgtcttggagttgctcttctcaaggagtatctttgtggtgttctctgtatttcctgaatttgaatgttggcctgccttgctaggttggggaagttctcctggataaaatcctgaagagtgttttccaacttggttccattgtccccgtcactttcaggtacaccaatcagacgtaaatttggtcttttcacatagtcccatatttcttggaggctttgttcatttctttttactcttttttctctaaacttatcttctcacttcatttcgttcatttgatcttccatcactgataccctttcttctggttgatccaatcggctactgaaacttgtgcatgcatcacgtagttctcttgccatggttttcagctccatcaggtcattgaaggtcttctctacactggttattctagttagccattcgtctaatcttttttcaaggtttttagcttctttgcgatgggttcgaacatcctcctttagcttggagaagtttgatcgtctgaagccttcttctctcaactcatcaaagtcattctccatccagctttgttccattgctggcaaggagctgtgttcctttggaggaggagaggcgctcagatttttagaattctcagcttttgtgctctggtttctccccatctttgtggttttatctacctttggtctttgatgatggtgacgtacagatggggttttggtgtggatgtcctttctgtttgttaattttccttttaacagtcaggaccctcagctgcacatctgctggagtttgctggaggtccactccagaccctgtttgcctgggtatcaccagcagaggctgcagaacagcggatattgcagaacagcaaatgttgctgcctgatcgttcctctggaagttttgtctcagaggggtatgtggccgtgtgaggtgtcagttggcccctactgggaggtgcctcccagacaggctactcgggggtcagggactcacttgaggaggcagtctgtctgttttcatatctcaaactccgttctgggagaaccactactctcttcaaagctgtcacacagggacatttaagtctgcagaggttattgctgtcttttgtttgtctgtgccgtgtccccagaggtggagtctacagaggcaggcaggcctccttgagctgcagtgggctcaacccagttcgagcttcctggccgctttgtttacctactcaagcctcagcaatggcaggcgcccctcccccagcctcgctgccatcttgcagttcgatctcagaccgctgtgctagcgatgagcgaggctccatgggcgtgggaccgtccaagccaggtgtggaatataatctcctggtgtgccgtttgctaagacggttggaaaagcgcagtgttagggtgggagtgacccaattttccaggtgccgtctttcacagcttcccttggctaggaaagggaattccctgaccctttgcacttcctgggagaggcaatgcctcgccctgcttcggctcacgcttggtgggctgcacccactgtcctgcacccactgtctgacaagccccagtgagatgaacctggtatctcaattggaaatgcagaaatcacccgtcttctccgtcgctcacactgggagctgtagactagagctgttcctattcagccatcttggaacactccccaatttttttttcttgtaagtacagttctaattaatctgcagtctcttgaatgaatatgcaagtaaatagcccaattgtaagccccttgaaatggataggataataccttgcatatacaaactaacattctcagtacagtaatgtactaagtcaatacttaataaatctttggtatttgggatatttcattagtaatgtgacatccagtgacccacacgatatttgaactaaaaggaaatcatgaatgcaatccttttgttttatgggcagagatgtaaagtgggaagaaaacagtatttaaaaggaaacctgccttaggtgttctgactccagtatatgactttgcaggtcctcatattgctctgagcttcagtcagttttctcatctgtaatatcagcatttttttttcttttttgagatgaagtctcactctgtcgcccaggctggagtgcagtggtgtggtgccatcttggctcactgcaacctctgcctcctgggttcaagcgattctcatgcttcagcctctcaagtagctgggactacaagtgtgcgctaccacacccagctaatttttgtattttttaatagaggtgtggtttcaccatgttggccaggctggtcttgaactcctgacctcaggtgatccacccgccttggactcccaaactattgggattacaggcatgagccaccatgcccagcctgtgatatcaattttacaaggtagttggggatgaaatgtgacagtcttatgaaaatgttttgttaatatgagtgaaccattatgcaattgtaaatcacattatcacttttgttacagatgtgagttttaaaaagagataaagtaggcccaaaaactagttaatgtcagtccaggcctagaactcgagactattctgactctttcttaggctatgttgcccttttggtttagcaaaaacatgatttcaaaccctgcatatgtggcagcactgttctttgtcataccttgatctgataatatcttcaaagtgaaatcacttggtttcctgaggtgctgggctaaaggaggataaatttgagagcaaggtgtttcatgtcctgagacactggccagtttatgtggctatgctcctaagtgattctgcaagcagtggctctcacaggtacccttttgaatatttgaaccacagaaatatccaaggactcattatgctctaatggaacactttttcatcttctttagtgattcattaaggcaaagtatatttgcagattacaggaaaccttttctttctatatctcctatttaagattcttatatagtctttggatcctattaggtgttctatgttactagtatactgaatttgtaatttgtacttactcatcagagccctatatcttacctaaagaatggtgtctactttaaaccctgtatctaatttaccagttataatcacatacactttgaatactattaatgatattcattaaagaactggtttagctcatagtctgtggtctggtgatgttatcatactgcctagtaagcatttattttattactctgatttgtacatagcaccttattatgtatagttaagaatgcagcaagtcaatagaatggtgatacctgagctattacatgttaatgcaatttaaaattgcctccttgtgttaaaatttggggaaaccattaaaaagagaataatatggtgaatatgtgttatgttgttacggtgttcactggtagagtaacagtatctacaagactacacaattgtctttttgcataagtgttttctcccaggaaatagctatccgcattgcttatagaggtaatcagttaatcaaagaccttcgcttttaaaagttaagatgaacattattatcatctcatatttttctatctagacagataatccacagaaaagtttaaagacattagagaaataacaagaatgagcaccactgctttctaccagttggaaacattttttcaggtggcttatttaggaggagaagggagaggagaaaaaaataatttttcaaagtggtttatttaatgttcaggtaacagaacatgccttgtatttgaacgctgtagtagttcttacttgtaatgagggctaaattcaagtggaaagttgaccaagagtaaatttaacaaatgaaaataatgaacttcacagttacataatttttgttactagagtaatacttaaaatatcactgacagccagaatttgaaaaatatgacttaaggttattttccagattaagtacttattttatgagttacctgaaggtgccagaaatatgaacatatactttatatagctcagaaagttggaaaattcttctttacgttgaacagaaatatgtaaccatgtaactgttgactgatcctagctctggcctgtgaactatagttttcattttgctgatttaattttctgttaatttcatcagtgtttttactagagggaatgcaacctacagtgtttttagtagagggaatgcaacctattttagttttttttcattcactctacccttacctatcataaatcacaaacttacatcataggtccccaattgcataagcattctaaagataaatttgggcattaggaagaggagttagaaagtgttttctgcttggaatcacaatgtggtgaaacatattccaccacagttacaatccatgtgactatttattaatacacattggactgtccaaaagcccacccaagccagtagcccacaatattagttcctcagataccaaagaagaagagggaggcctcatctgtgtgaaacctatataggaataaatgtcttctcccaagacgaggctacaaaaaagtcctatatcttctgaaactgcacatgatataaaaatagaatgactagctgaaaaatgtattatgtactatttgagaaaataaacactaaacattttgagagtaaattggtacccactttactgaaagtcattcagatctaaaggagagacatcaatctggtgatgaccgtggtcatggaaagatgaatttacttccccaaagtgacttactatcttactgagtcaccctaggcattgagctttatattagaccactacttattaggaaacttctttatctacctagaatcataaatgatcatttgaggatgccaaacctgcccacaaacaaaaatattttgccatcatctgccatggatatggctcttcccaagacaaaatctagtgagaagggaaattctaaaaaaaaaaaaaaaaaaaaaaaaagccatttgcagttaacgtttttatgaaactgtcttatgacagcaggagatgtagagtttgcatagtaacttgaatattatcattggaccacacagaattggaaaatcgactgtgctttgctgctatctaacgaacctgttgtaagttgtaagttgccttttaagtgagaaaaaaaaaggtatggctgcaaaatgacaatagcgacatcacatcgtttccattatttgacaataatgatctgaaggactcagattatgtgtgatggataagctaaattgtgatagatgctgtattcagaatctactaccagcataaggcgactcttaactattctcaaactgagtccttgactctgtagaaacaggaagtttgttcttgacaatgtatcaggaaaccttaagtcagtaaaggctatgttctaatactagaatatcagtgctaggtgaatgattctctaaggtaattcatccccatgtgccattggaatttgtttactgggcaggattctgatgttaggaatctatttgtctgtaagaaaatatattaatatgtttaggccgggcgcggtggctcatgcctgtaatcccagcactttgggagactgaggcaggcggatcacgaggtcaggagatcgagaccatcctggctaacatggtgaaaccctgtctctactaaaaaatacaacaaaaattagctgggcatggtggtgggcgcctttagtcccagctattcaggaagctgaggcaggagaatggcatgaacccaggaggcggagcttgtagtgagccgagattgcgccactgcgctccagtctaggtgacagagaggagaaaatatattaatacgtttaatatgttagtttttcatataagatgaaaaaacaatgtgtatgaaaggctgtagcatgactttaagatgttagagagttatatgaatctcaggttatgagattctgaggtcacgtgtatttgtgactttgccagttgacctcaaatgaaaagtttatatgaattctttgtgtgatcatatatgtcacaacttatggatccaggcaggaagcagagaaaaatttaaattctacaagataaaccgtaagcttttcttagaattatactactgtgcttgatttattatttaggtaaaatgcaatatattctgtatctttatacatctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctttatacatctttatgtgtcctctagtaatctttatagcaaaaaaaaaaaaaaaattaataaagagggacatttataaaaaggccatttcaggaagatataacaattataaatatgtgtgctcctgataacagaacaccaaaatacataatgcaaaaactgacagaattgaaggaagagatggacagttaaacaataatggttggaaatttcaatacctccctttcacctaacatatttctaaaacacgccatctaacaatagaatatacgtttttctttacacatggaacattgtccaggatagactatatgctaggacatcaacaaacgtcaataagtttaaaaggatagaaataatacacagtatgttctttaattccagtagaatgaaattagaaatcaatatcaggaaaaaaaaatctgggcaaatcaacagatgtttgggaattaacacactcctaaataatcagtggatcatggaagaaataatgagggaaattggaatattatcagagatgaatgaaaataagacatgatgtaccaagactcaaggaatgcagctagcacacttcttagagggaaatttgtagctataaatgcctatgtaataaagaagaaagatctcaaatcattaacctttccaccttaagacactagaaagagaacaaactatacctaaagcacacagaaaaaagaaaataacaaaaagcagggcagtgatatggtttggatctgtgtctccaccaattctatattaaactgtaatccccagtgtcggaggtgggtccttgtgggaggtgattggatcatggggttggatttccccctttggtgctgttctcgggacagaggtctcacaagatctggttgtttaaaagtatgcaccatttccccctcgctctctgttcctcctgctctggcatgtgaagtgctgcctcctagtttgccttctgccgtgattgtaagtttcctgaggcttccccagaagccaagcagatgctgccacgcttcctgtacagcttgtgaaaccatgagccaattcagtatcttttctttataaattacccaatctcaggcatttctttatagccatgtgagagcggactattacaagcagaaatggaagaaatagagaacaataaagaaatagagaaaatcagtgaaaccaaaagctgattcttggaaaatatcaagaaaattaacatgcatttaagtaagtaattaaccaagaaaaaaagagaaaggactcaaatttctagggtcaaaaaaaaggacattactgccaatcttatataaataaaaaggattataaaggaatacaatcgtgaataaatgtatgtcaagaaattagatggctatttttctaatagaagtgaaatgaataaattcctggaaagacacaaactgctaaaactaaatcagaaacagaccattttaatagatagacttataattagtaaaaaggttgaattagttatcaaaaacctatacataatgaaaagtccaagtccagatagtttcaccactgaattctaccaaacatttaaaaaattccagtgctctcaaaaaaaaaaaaaaaaaaaaaagaagaggggtgaatatttctcatctcattttatgatggcagtattaccttgatgcaaaaccaaagacatcacaagaaaactacagaccaatgtttttataaatatggatgaaaaaaatctcaaaaaataccaccaaactgaattcggcaacttataaaaagaattatcaccatgaagctgggcatggtggtgtgcaactgtagttgcagctcctcaggaggctaagcagggggaatcccttgagtccaggaattgaaggatgcagtgagctttgatcacaccactgtacttcagcctgggtgaagatttatctaaaaacaaacaaacaaacaaaaaacatttattaccatgatcaagtggcatttaaccatggaacacaaggttggttaaacatctcaagatcaattaatgtaaatacctcatgtcaatagaataaaaagcagtatcacacgatcatctcaagagaagtgtttgagccggactcagtggctcccacctgtaataccaacgctttgggaggccagggcaggctgatcacctgaggtcagcagttcaagatcagcctggccaatgtggtgaaaccctatctctactaaaaatacaaaatatagccaggtgtggtggcacgcacctgtaatcccagctactcgggaggctgaggcaggagaatcacttgaacccagaggcagaggttgcagtcagccgagatcgtgccattgcactgcagcctgggcaacagagcgagactgcgtctcaaaaaaaaaaaagtgtttgacaaaacccaacacccttgcactataaaaacactcagcagactaggaataaaaaagaagtatctcaaccagataaaagaccatactaaaaacccacaacaccatgtttactggtgaaagaatgctttcctgctaagatcaagaacaaaacaaggatgtctgctcttgcttcttctattcagcattgtattgaagtcttagccagggcatttaggcaagaaaaagaaataagatggaaaaaaagaagtaaaattatctatttgcagatggcatgattttatatatagaaaatcttgagaaatgcactaaaaaaaacattggaactaataaatgagtttagcaaggttgcaggatacatagcaatattacaaaaatcagttttattttttatacatttacaatgaacaacttgaaaatgaaattaatgacattcataattgcatcaaaaagaataaaatactcaggaataaattaaaagaagtgaaaaactttaactttgaaaactatataacattgttgaaagaaattaaagtctaatttaatttggaactcttaagtcttcctgaccttagatttggcagaggattcttagatatgacaccaaaggcacaagcaaccaaaagcttcaaaattaaaaaaaatagataaattggacctcagcaaaattaaaaacttttgtgagtcaaaggacaccatcaagaaagtgaaaaagcaacccaaagaatgggagaacttatttgcacatcttatgtctgataaaagtatatgtacccagagcacatcaagaatcttacaactctggccaggcatggtggcttacgcctgtactcccagcactttgggaggccgaggcgggcggatcacctcaggtcaggagtttgagaccagcctgaccaacacggtgaaaccccatctctactaaaaatacaaaaaattagccgggcatcttggcacatgcctgtagtcccagttacttgtgaggctgaggtgggagaatcacttgaaccttggaggcggaggctgcagtgagtcgagatcgtgccactgcactccagcctgggcgacagagctagactccatctcaaaaaaaaaaaaaaaaaaaagaagaaaaaaataatcttacaactcaataataaaaagttaaatgacccacataagcaatggatacaggatatgaatagatattcctccaaggaagatacacagatgtccaataaacacatgaaaaaatgctcagcatcagtcattaattattaactattaagttagggacctgttagaaagtgttatattagtttggtcaagtgagaatgaaggactagtgcaggtggtggaggtctgagagagaagggaacaaatggaattgaactgtgaagcaactcgttggggaaggagagaaaaaatccaaaaatggactcgttagattttgagcctaagtgacttggatgataaaactattaagcaatggaggaaaagcagagaagttgttttattggaaaaactgatgagtttaggccgggcgcagtggctcacgcctgtaatcccagcactttgggaggccgaggtgggtggatcacctgaggctgggagttcaagaccagcctgaccaacatggagaaaccccatctctactaaaaatacaaaattagcctggcgtggtggctcatgcctgtaatcccagctactcaggaggctgaggcaggagaattgcttgaacctgggaggcagaggttgtagtgagctggaatcgctccattgcactccagcctggacaacaagaacagaaactctgtctcaaaagaaaagaaaagaaaagaaaaactgatgagtttagtttttggtttggttagttttaggaactaggagacctctgagagatttaatggcagttagaaagtgaagccatgtagtacagcagaaagagcacttggcttgtttcttcttctataaaatgaaagatttggatttaaaaggtggttatgttatagtgatagagagcaaaaattttagatccctgcttgttttagcttctcactaactgtttaacttggatatattatttattctccctgggcctcagattctgtaaaatcaggataaccattctatgcctacctcatattgctactgtgaggaatatgtgcacacacacaatttatttagaacagtgcctattgcatagtaagcttaatgttacgtaggtgaagtccttttcagatctgaggatccattgttgcgtggtcagtttctatgagactggcattccaaggtagaagtcagggccagagacctaggttaatcatttcttttctaaagtattatcgaatagctgggatgagataccagagtagaaagtggaaagaacatgaatggcaagggtagaatgttgaggaacacttctattagggaacaagaggcaggagtatataggagaggccagtggaggaacattcagagaaagaaggaaaactaggacatattctcatgaatgccaagtggaatagaaaagataaggtcaagggaagatttagagtagactacttgagctaagtttgaagatttatgggatgcatctcatggacaggggaagttgaagatgaaagcaagtaattgatggagcatagttctgtgaggattcaaggggcagatttagcctcaaggggaaggaatgcatttatttctttgaattaggataaaagaaggaatggatatatggtggggcaatcaaatttttgagctgggaaattcagaagtcaaggaagctcatgttggataacttcagtttgtttacattaaataggaagcaaggtcatctgtagagagagtggaaggtagggaacaaaattgaaaagtgtttccaagcagctttaaatgttctaattctgctctttgtatgaatggaaaacaaatgatctatttcaattataacaggtaatatttactgagcctttactgtctgccaggtatcatgctaagggtttgtttcaaactgaaaacatccgtaagaggcaaatggtagtggtatccacacattacagagggtaatatatgaaacagagaaggatggaaaattgctgtctgttacccagctgagaggtggaaccaagactgaagagcagatctgcctgactctcggctcttaatgatcatgctttctgacattttactttcaaatttcattaaagccatgaagtgttggttcgagaatatacatggattaatgggatagagaaatatagaaaaatataatagcacatgtttacagccaaacataactttaatgaaattcatattttaaataaatggaaaggatggcttgttagataagtgcattagggcaattaactattcatttgaaaaaaattaataactttaaccccatatttcttaaaaatatacaatagaagtctgaacagtggttgtctgtggcaggatagagattgcatgaagggcacaagggaactttctggagtaataggaatgttctgtaatttttttttttttaagatggagtctggctctgttgcccaggctggagtgcagtgacgtaatctcagctcactgcaacctctacctcctgggttcaagcagttctgctgcctcagcctcccaaatagctgggattacaggcgtgtgccaccgtgcctggataatttttgtatttttagtagagacaggttttgctatattgaccaggctggtctcgaactcctgacctcaagtgatctggctgcctcggcctcccagagtgctgggattacaggcatgagcgactgtgcctggtcaatattctgtaatttgattgtgatgttggttacataggcagagatttttggtcaaaactcatcaaattgcacatttaaagtctgcacattacactctgtaaattttatctcaattttaaaaaagaaagccaagtgcagtggctcatgcctgtagtcccagctactcaggaggctgaggtgggaggatcatttgagcctaggagttacaggccattctgggccacatagcaagactgcaacatagcaacatatctttaaaaacaaacaaacaaacaaaataagttgacagagaaagagaagataaaagaaaaataaggcaattctgtatgtagatctcaaagacattgttaaatgaagaaagagcaagctatagaataagacgtgaaatatgataccatttatataaagaaaaaaaattaccaccagaccaaattctttctgtggatccacactcatatgtgtaaaggtatcatggttcttgggtgcagctgccccactccatcaacagattcttcctccaatgtcaatctcagatgctcttagggttcccttccaggttgcagaaaggaaggacttttatcttataacactattagcataaatgtcattttccccactgattgcaatactcagtggtagaatattctccagtgaagaaagatattccatttctggaaattctaggtttaaaaaatgacctgtttgcataatgaaagtagtatcttttttttttttttttttttttaggcagggtctcactccgatgcccaggctggagtgcagtggtgcaatgtcagcttactgcaacctccgcctcctgggttcaagcgattctcctgcctcagcctcccgagtagctgggattacaggcaaccaccgccttgcccagctactttttgtattttcatagaaacggggtttccccatgttggacaggctggtcttgaactcctgacctcaagtgatccacccaccttggcctcccaaagtgctaggattgcaggcatgagccaccatgcccggccttgaaagtagtatcttttaagaggcagcccccgttgtgcatatgtaccctagaacttaaagtattaaaaaaaaataaaaatgaaaagaggcagcctcgtataacggaactgtcattgaactagaaggagtctagggatgtgagttcttgtcctgaagctgctgctgagtggatgggtgttttggagctatccatttaatctctctgggcttcagttttcttgttaattacattaatggatgcgacagacgactgagggtctttcaggcctaagatccaatgaactgtgttcattcacatggagcttacatggaatcgtttcactcagcatatagtaggtacatggaaagtaagatttttgcttttatgttttgaaacaggtgacaaccaaagccaagcaactgaaggattcagtgacctgctccccaggtgagttcatacttcctctatctcattaatctaaagtggtttcttctaaattaatccctttttataataacttctttaaatacaagggtctagaagttttgcctaatgaactctaaatctggtcatatctccaaaaagggttgaaatacgggcaccagcaagccagtccagccctgcacatactggtgccgagaagatgtatttaattaataaggttaaataagtatacagatcgtcttctatagtttaatttgtggggacggggaacacaggagaaagcccatctgcacaccacgcaaatgctatgtgcacactgtttccctgcactgtccacccctgtcactgccgcacttgcagagctgccctttgggataaatggctaacagctttcccaggcatttatgtttccttttttttgagacggagtcttgctctgttgcccaggctagcgtgcagtggcgcaatctcggctcactgcaacctctgcctcccaggttcaagtgattctcctgcctcagcccccgagtagctgggattacgggcgcccgccactgcacctgacagatttttgtatttttagtagagacctggtttcaccatcttggctaggctggtcttgaactcctgacctcttgatcctctcacctcggcctcccaaattgctgggattacaggcgtgagccaccgtgctcagccccatttatgtttcttaaaatcaatttcctccaagattaactggaattttgttagagtctccatattctttgcttagaaccaggaaataagaacatgcttcagaaactttgcaacctaactcaaatacaggtcccagggagagtaatgcagatgaacaagccaacaattagcaaacccagagatctcaaaaagccaccccagccgggcgtggtggcacagctatagtttcaactactctagaggccgaggcgggaggatcacttgagcccaggagttcaaaaccagcctgggcaacatagtgagaccccccatttctgaaaaataaacgtaaaaaaaaatttttttaaaagaattcaacttggagttctccaggctttagcaagaggaaatttctggatttctttttctgccaatgaagttatttctgtgggcatggaggcagagacggggcaatgggatgttatatgacagaagcctacttcaagacattctccaaaatcataccattgaaaaggcagcgcagctcagagtaaggaactgacgtagatcttcctggagcttggtggaggggggtcagaagtatgaagaaaacaggaaatgtggagttgaatatttaagtgcatctctgaggcaacacctgtggctgagagaaggcaccagaagcagctttgagcagagagcagatccagcatcaggacagagaggaaaagaggcaaatccgatgtgatatttggccacatccaaacatcctgtgactctctaaaagcaccataaggtctttgtcacaaatatattcattaaattatgtgttttattttgttttttaatagcctttaagaagccaaagaattttgaaataaaagtatttcttctgattatgttcacaaattaacaaagaatccgtaagcagtgtgatccatttaagccataaagctgtgcttctgaagtattattagaaattctaaaattgtttcctaagattttggatacctttcaaagtgtttgaaatggatggtttagaaaacacagctggcttaataggctagcacaggggaaaatgaccttctacagataagaacacacccagatggaggtatttggctgtttcttaagagagttgctttagtgagcatggaaagaaatgttcgctaatagaaactcaaaaaaatacagataaacaaaaggaagaaaataacaatcacatgtaacctaccaattgttgttattttgagagagatatttcttcagacttttctgatgcacatatgtgcatataatatttttacaagaatgggactgtaccgcaatactgttttacattttttcactccgtacactcatatgtctgtatcatcttcttaatggctccatagtagtccatagtatagatgtctgccccatagtttatttaacaagtttctattgttggacattttgtttgtttccattttttttttattgttctgaagttgtggtctccaaagtgaggtagacaggatgattctttggaatataagaagaccgtatttgaatttctgttgatctttgtttttatcttaaggcagtgagagaggaattaaactttctcatctttgatattccgacttatgccagcaccctcactgtgcccattagcagagcttatgtgttacgtacatagggcaccaacgtttcccaagggaaaaatgggatttccacagcactcacaggctgatggtggcctcgtcacttggcatcatcccatgttctttcactctcaagatattgcaacaagatacccagttgagtgaatgtatagataaccccagagtttcagtgacatctttttataaggtggaaggcaaccatgggaatatttcctattacacagaggcttcctagtattttgacaaagtacttttaaaagtttttgaatttaaagatcctcaattttatacttttcttttaccaaataaataaataaattcttggcgtagggtctaaaaaaaaaaaaaaaaaacaacctgcacacacttaaaaaattaaaacagtacaaaagggaatgcaatgaaaagtgtctgagtctgggttcctggcccccttccacagagggaataatgaattggagtgtgagggcgtacacgtctagaagtataactagtcttgcacagactgtctgtatttgcctccctctttcttatgttaatagcagcatactcgctgaagactaatatctttaatcattttattatattaaaatgtttttacaaaataaagatggatttttaacaatgaatgtgaaagtgttttgaaagatatttatgctgtagaaaggacgtttgaaagtagatgcttggctgggcacggtgcctcacgcctgtaatcctgacactttgggaggccaagatgggcggatcacctgaggtcaggagttcgagaccagcctggccaacatagtgaaacccggtctctactaaaactacaaaaattagttgggtgttgtggcccatgcctgtggtctcagctactcgggaagctgaggcaggagaatcacttgaacccgggaggcagaggttgcagtgagccgagatcatgccactgaacttccagcctgggcaacagagcgagactggctcaaaaaacaaaaaaaacaaagtcgatgtttgaaagtattttctttgttatgtgttattctatggccaaaacaatgtgacctataaaaactcttatttttacggatttaaaaatgttgaaaatagaattttaacctgtaaatctttcaaacaaagtgaactcatttgttaaaaatacagccaggcgtgatggtgtaggcctgtagtcccagctgcccaggaggctgaggtgggaggatcacttgagcccagaagttggaggctgcagtgagctatgatcacaccactgcactccagcctgggtgacagagcaagagccccatctcagataaataagtaacactttctatttagtttgcaagaacaaatgattggcttggggaagatttttatgaaaatgttttcataatttgtattgcacaatgaataccagagcatggtaaacttggccagcaggacgctacatgtggatagatgtatccttttgggtcatcttttccaactaggatggccattcaaagttaggtgccaaaataaagcaaatttggagccagacctttaattgagtattttatccagtattaagcaatttttcaatctcattgtttttaatattaatattttcattagaatgtttcatgtcacttaatgatgtttttagattgtggtggatataattgaataagtaaatatacatatattagaattgcattttcggctgggcgtggtggctcatgcctgtaatcccaacactttgggaggctgaggcactcagatcacgaggtcaagagattgagaccatcctggccaacatggtgaaacctcgtctgttctataaatacaaaaattagctgggcatggtggcgcgtgcctgtagtcccagctcctcgagaggctgacgcctgtagtcccagctactcgagaggctgaggcaggagaatcacttgaacccaggaggcagaggttgcagggaggcaaaatcgcgccccttcactccagcctggtgaaagagtgagactccatctcaaaaaataaaaataaaaaaaaattgtgttttcaaagatgttttattgatggggttcataataaaaaatatggaggagataatgattatgaaatgccacttgttagtagtaacaaaagactaggacctggaactttagtgagctaatacagaataacctccagggagtttgttgccattaacgtaagaaaggagaaggctaatgcagctacatagggtgtgtgacactgtttctagacgttcacacactcacactccaactcatttttgcctcttacagagcagaccaggaatgcagactaagccacttttcattgtattcctttttgtagtttttatatttttaaaaattatatctagattttttttttttttttttagacggagtctcactctgtcgcccaggctgtggtacgatctcagtacactgcaacctctgcctcccaggttcaagcgattctcctgcctcggcctcctgagtagctggaattacaggcacgtgccaccacacccggctaatttttgcatttttgtagagacagggtttcaccatgttggccaggctggtctcgaactcctgacctcaggggatcccccctgccttggcctcccaaagtgttgggattacaggcgtgagccaccgtgtacagctgggattttgttttttattaaataaaagcctactataaagaggaaacattactgtagaaaaggaaataaaatattgcccccttttttgttgttgttttgagacagagcaagactttgtttcccaggctggagtgcagtggcacagtcttggctcactgcagcctctgcctcctgggttcaagcgattttcatgcctcagccacccaagtagttgggatgacaggcatgcgccaccatgcccagctaattttttgtatttttagtagagacggggttttgccatgttgcccaagctggtctggaactcctggcctcaagtgatccaccttgccttggcctcccaaagtcctggaattacacgcttgagccacactgcacctggcctaaaatactgcctctttgtagctaaatttgtatatacatctgtaattatttccataggagaacctcctctaagtaaaattacagagtcacaagtaaatacattcttaaggttcacctccatttgacaaattgttctttaaaaaggctagacctgtgctgtctaatatggtagccacttgccacatgtagctatttatattaaagtttaaattaattagaattaaataaagttaaaaacttaattcctcagtactacaccaagtggtttatataattgtatcacagcatgtttcattggacagctctgggctgggccagtttctgctcccacgccccgtgtccaaatgtacctatttccctgcattttgccagcactgggtattgtcatactttctaatctttgccaatttaataattgaaaagtagtgattctttgttttagttctctgatactcatcagctactgtagttcttcctttgtgagctgtgttctttgtccttttatcttaatgagttgtaactgctactgtattgaggatatcagtgctctgtcatctattctgtcctattaaaaggtttaaagcttttgttattaattattattacttttagagacaagatctcattctgttgcccgggctgaagcacagtggcgtgatcatagctgactgcagcctcaaactcctgggctcaagcagtcctccctccttagcctccctagtagctaggaatacaggtgtataccaccaggcccagctaataaactttttaataaaatgtttcttttccatgtttaaaaattcttactgtagctactatttgtaagtgtataatttactcatacacttgccttccagaggcagcacagttttaaggtttgaccagttgatttttgtctttccagtggagccagtgaatcctttcttatactgagtagcaggttattccctctcaaagagatgtttgcattcttgttcacaatctgattctttatatacccattattcctcagagtagagaaagggacaaaggcttggaatcagacagaagtgggttcaaatcccactctagtgctttctgagtcttctttttctcatctgtaacattagggtaatgatccctatctttctagaatagagtagtgtggaaatgaaattaaaccatgcatgcaaaatgcctagtgcgctgcctgctctgtgcccggcagctgctgttctcaccgtctccttaattcaccttgcccttcacctctgtgtggcacaccctctttcctaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggtgagtgatggggaaagaggcctctgcacaggtgttagaatcccaccagaggagccacagcttgtctgcctgcagcttcttccctcattcctatctactgacacctgccccgtgatttcttctttcccatttatcttccagtatatttctccctagagcgtgtgaatctgtgcattcaggtggttcatgtgtgtagatgagctcaagattctaagtttcatcatcccacagggcagctgcttatagaaacttcacccacagcacctgcctgcctttttgagaactcgcccactccggctaggttttaagggcacatgggaggctcagccggcgctgcctcaccgtgaaatgcagcagctgggaagggtcaggatggaaagctcctttgaaccaggctgagggttcataaatcacaaggcccattggctgtgtagcaaatctttgaccaaagggatagctggtatagatggtattaccgtgatcatcttcgattctgccatgtgaataactttggactcagcaggtacacctggtggctgtccagaggccctgaggccatctccgtatgtggtcagtgccaggcgacagctagggttcggcttactttccacggccgtggccgtttgtagttggcctttctccctgctggtagctcttggtgcctgctcagatatttctgagatggtcctcagatgggaggagggggcgggagtgccctgtggagagcccacccaccgggcttgggcggcctctttcctgtgatctggccatgaggcgctgcagagagccccagggtgtgatcctaacacagtgtctcttgaggcttctttccctgtagctagattgttagtcgaggaaccaggaacagtgagaatcaaaagccccgatctcttccgctgtctgtgcctccctcagtcgcctctgggcacactcatgctcatttacattcttattttttttaattgaaattctatgttggaaaatccagctcatggccatgcatgtccctgagtgtacaggtgtagttttctccacctactttaaaatgattaaagttgagagttcctggggagaaaaataaacggttagctgttgatatatttgagaagcgcagattctcccagcctctccgactggtttgcagaagtaactattctacccgaatttctctagcatctgtcaggacacaggcagacgtcttcatgtgtgatgagtccacactggcttataaacgaaggggctggagcttggattcctaaggatagaacacccagaaactcatacctggggggctggaaaccttccggttttcaaccagcaatgagcagggcttcttcagcctgcgggtgttcccctcaagccttgacttgagagcgaggcagggctgagcttcctgctgtcccggagcctgggcctggctgccgtgcacggctcagctcagagctccgagcacactgtccttctggggttaagtgctgggtctggccacatctggttttggcagtatgttgttagggacagcatagctactaaggaaagactgatatctttaaagaccttaggcaagtaatctttggggatgcagaaaaaaaaccctgagaagagactctcataacaccactaagctaaaatcctaggagagtaaacatcctttctctgtcccaggcagctgataaagtcactttgcactggacccttagtcagcaaaagctacagaaccacagggtcattatttttggaacagaaacagaatagattctggaaagttcctgtgatcaatgtgagaataatgaggcctctccccaccatcaccccacctctgctttggtcctgagctccagcccagggtgtgacagctgtggccagctgaggtctgaagtgggcggctctgcagcctgtagggtgggatggaggtggggccaggaggagcaggaatgagtattccagcacaagttctgccagtgtcctgggggctggctccccacgggaaaggtcttagcagcgcctagggaaagccagacccacggaagaagactaataggctacctggccccagggtttttgatttctttaaagtagcatgttgtgataaaagagtgaagtgttaacatgaaaataagagttagcaggctgaaagacccgattatgatgctagtacgcctcacaaacggccgccccagcccctcactccacgccaagcaccttccctttgggctgggcttgcaggagcccttctcgcactgcccagaccggtctgccttgtgagcgactggactccaggacatcccgggaactctgggcagagggactggacgtgaggctcttcatgagcagaagccagcagaccggccacatgatgaccacactgacttgtgcaagtgactgttctcacctctctttttttcttcctacaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaagatgagtgttgtgcta

SEQ ID NO: 560 - DNA, 29260 bp, Homo sapiens
acctggctccgccccccaggacgccgagcctcggccgggcggtaaaatcggcgcttaccctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcaggtacttaccggagacggggggcgtggagactacaggccccaggaggcccagcggcggctaagcgtaggctggcatgttgcgggcgcgcggtgcctgctgggatttgtagtgggtccggcgccggcggtttagggcggggtcctttgggcccggggaggctctgggatctggagcggggtgctggatagctggagttgtgggctggcctggtggggaggggttgacttcactggtatagtgagattgtgcttcccgctcttcgcactcagtgaaggaagcagtgagattagtcgttggtagttgtcaatctgttggacgctggcgattaggtccgcctggagcattgccctctgacctccctctgtcacccacgtgggtggcctgtaggtgtcaacttcaccaacttatagctgagttcctttcacgtttatggagtttttttgttttggttttcctataggagtgatttaaagtcagagatacaaagaacgagtgtattgttctgcatttccctctagacctaatttagtgtcccccacgtagtaatagaatgtacgaaggaatgggcaaagagtacatttgtccagaaatggaaggccttgttattttcttaagcatgaaggaaacagtccagagtaacatttctgtcaagagagtgccagttttctgaaggttatctgtattcaccaatttctgatttaaaacttcaatcagtggcaggtcagatagcaagatctggcattaatttcagccctttacttggcctatggataacattttcttgtctttccctgtcttcactgggtgttacttcttggtttcctttgctggttccttatcttcctgacttttaaatgttaggatgtgccttgggaatcagttataggaccttttctatagactctccctagctttaggtggtctcattcattcagcctcagggctttacatactttctataaactggagattctgaaatataaatataaatatcttcagtccagatctgtctccctatttccagatttgtgcatccagcagttacttgaaatcacgacttggatgactaagagtcatcttcatcttaacgtgtccaaaactgaatcccctttccccctttgccttagaagtgaatagcaactccgttattagaggagctgaagttaattgtcggagtcatcttttatttttcttgtttttctcacaccccacaatctgtcagcaaatcctattgactctacttgagacatatatccagaatacaatcccttttcattctccattgcaagccattatcactgcaatctggttcctttccatcttttctctagacagctagagtgatccttttaaaacctacatcaagtcctgtctttcctctgtccagaatcctaccatgtcttcttaatgagtaaaatccaagtcctttcagtggcctgcaaggcccctgctgcttctctgacctcatctcctactactctccaacttgtaccttaggctccacaatgagatccttgctgttacttcagtgcttatctggatctctcctcagggcctttgcacatgttgtttctctgcctgaggaagataaccgtggctcagttgtttacctcctaaccttcttcagatctctgcccaaatgccgtcttgttgacaaggccttctctgatggccgtacataaaatagcccgtccttcactccactcccttatcccttatccttcatttttctttctttctttcttttttttggagacggagtctcgctctgttgcccaggctggagtgtatatggcgcaatcttggttcactgcaacctctgtctcctgggttcaagcagttctcctgtctcagcctcccaagtagctggaattacaggtgcacaccaccatgcccagctaatttttgtattttagtagagacggggtttcgccatgttggccagactggtcttgaactcctgacctcaggtgatccacccgcctcagcctcccaaagtgctgggattagaggcgtgagccactgagcctggccttatccttcatttttcttgctacatattaccctttggtatttattagtctgcttcccctcagagaataaggctccatgagagccgttcaccactgtccttgttacctggaatagtgcctgggacgtagtaggtgcttatatattaactgagttgttggaagtaattgggcacttgctgtgtgctgggcactggggtacaatagtaaataggactgaaaaggtttcagagcctgtgaagacatagaggcacgtgttttaaggggtgtaatatttgatagggtgttccacccagaaaggcctcagagaagacatttgaagaaattggaatactgaggagccagccagccagctttgggtagatctggctctggagacaaccttccaggaaggactagtaagtgaaaggctcagaagtaggagctgggaacaggaagaagactgggttgccagctggcacagggtcagctgtagggtgaggattagtagatgacagcagggagatagccagggctgggtgtagtaaagctaagatggaaaggtgggttaaagctagatcatagttgagccttgtaggtcatgttaagaggtttgaactttattttgagggcactatgaagtctttggagccttgtgaacaaaggactgacagattgccccgactattctgtggagtggactttgtgtgtgtatggagggggttgaaggaggaagggctaggtgatgagatcagagagatgaatccagttaggaggccagagagatggtggtttggatcagtgtggctgtgaagatagagaaaagggcatagacttggcagaggggacgagattacagccgaatggatataaagagtgaatgggtgaagcgagcaggactgaaagatactactgttttcacaggagcagctgagtggatggcggagcccttgactgagatggggaatggtcagggatacctgggttgggagtgggggctggtatggatgaagagttaggttttggctgtgctaagtcttgagatgcttttcaggcatccatgtggcgaggccaagggagcagttggatataaaaacatgactctggagtgcagctggaattgcatactgttctgtgtttattactttactaaatatttgttggctgagagaatgttgtgtactttgtccctggtggcttgttgggtaatgtgtggtcatggggagcaatggtggcatattaatgtgtgagaaggacctggtcaaaaccggcttgttgtccctgttagcaaaatcctcacttgtgtagtgacactagtgactacacgatgtaaataagcacattgtaaagaagcaatgtaaataagcctaacaggctgcgggtgtataaggttaaaagtggtgaactgattaaaaagagtaatcgttcttgtcacatcttccacaattttgtcatcttccctgtattatttcttctcagctgccagcaggaggcaggacagtgtactgcccaggtgtgaaaagaccaacagctgtaccttgtcttttcttcctgttactctgattcttgcctattttggacacatgtaactttcagacccacctggaggaactcatttgcaaatgaagcagtcaaggaaaaactgcatttgagaggctgctgtgcacggacagtgtgcggtgtgctttagcagagttctgctagaaagttccttttttccttagaagctgaatctttcacaacttacaaaaatgggggagtgattgatttagaattgtgtgctcatgttggaagtgacaagttatttttcctcctcagctctagattcttgtgtgtagcttgttggtttagaacgctgaggtttataatgttatttctttagtttggataggttgaaacaggtgtgtgttaagactcattatactgttgtctacgatttctccctattctgagtccctcagatttatgttcatcaatcaaatagttcacaataatgaaatgtcttcatattaatcgttgattaactacacaagaggtggcaattcctgctgcctttgtgttttctaaggttatgtctcccagggccgcctgcatggctatatttcttcatttctttggacaaaataacatcaccctgttacaacttccctgaggtcatgtcactgaactctgacagtcatcctgagataagtgttacccccattttgtagacagcttcagtttcagtttctatttcgttgagtcaaggatagttctaagctgttttgtttaactcctttgcataatatctacgaaaaaaataagtatgtagcaaaacatttttgaaggtgatttcttccaaatcaatcatagcaaattgtttttccttttctattcgagtagaaaggctgttagatttcaagtagttgaatcatggtctcaaggcctggctcagtcccctgctagttgtgtacccttaggcaagttatttatcctgtctgagcctcaatttctttaggatctgaggataatatcatagcatattaactttgttctaagactccattgattatacgatgcaccatcaatttaatgcaacttttttgggggacaggggagtagaaattacattcaacgagtgtattgattgtaagacactctaatttcagaaacacaggaacgagtaccttcaaattgaggaaatatgttatctacttcttgcctctagtatgtagaacacatagaaaaatgtttgtaatacccaataagtagcctgataaataagctattcaaaaatagttgcctcctacgtggttggtatgggaaaaaaaatagttgccaatttttatttatcagccaatactttatgccttatttccttctctcctggacagtaagattctaattttaattagtaattgcaattgaaatgtaactgctggatgattattctgctttgtcttcttaaaagcatcctgacttgaaatgggaagatgtgaactcttgatttctctaatttatttccaggaataagaaatggtaccaaccaattctgtgactcagccttgtgcttatatttgccaagcttttgcttatatatcacatttaacctgatgacagcaaccttaggagactgatttaagggtgtattggggaagagagacgtttcaacatagcagggaggagaatgaacttggactataggctgagcatagaagttctatatccatcaaggtttggctatagaactctagtggcaagtgttctggtacgtaatttaagatctttccttagtagtcctgtccatgttgaacagttctgctgtgttctgtaataatgttgcccattagattgtggctttttaaaaaactttttattgagttacaatatacaagcaggaaagtgtatgtataataagtttatagcttgagtttttaaaaattcaaaacatgtatacagccagcattcagatcaagaaacagaatctctaaaagctttctcctgcttccttctggtcactgtcctctctaagggtgactatgctcttgatttttaataccatgtattgttgttgccagtttttatgctttttataggtggaattatgaagtatgttctcttttgtgtctacctgcttttatcaacattatgagagtcacccatattgttgcatgtggttataggttgctcattatgggaccataccacaatttatttactcattcagctattaatggaccttttgggcagtttccagtttggctattatgaatggtgctgctatgaacattctaatacatgtcttggtgaacatatgtacttcttggtgaggagaaatagtaatttctgttgcctatatatctaggagtagatttgatggcttctaattgctctttttaaagattaagtgcctttcatttgtttaaatgaatggaaggggccttttcttgcctacccgttgtgtctccccacccagcaaaaaaggccacagtttactaaactagcatttgtcacacaggtgctcatcatctttcttgcttggtgactgatatatacttaagtccgaatcaagtgatccttattatttcagacaaatcctcacttttcatactttaaaaaaaaaaacactagattctggatggcaaattatttcagtagcagattgtttagaagattttagctaaaggatggctgcaacctacactctgaagttgttggactaataactgaggaacaatgtcttatgtcttctttaagggtgtatatagcagtgagcacatgggctacatgtccttgttaagtgaggaactctaattagggcccagctttcctcctgaaaaaactgggatcattatgggcctggccttgaggttgctgtggacttaaaatgagatactcccccacgagtcctctcagtaagtgtgaggcaggcagtcctctgtctgcaagtcgtggctctttgtgctgcagttggctgcctcttaggctttccagggttgaaaatgggcctcttcactcctggcactgaacgtaaagccagttccttctccttactgtttacatatcaggtcgaggaaaaaatgggatttagttggatacttacaatggggatttccgaaatatgttacactgtgtccttctaaagagataagctgtcttctggtgttttcagattataattttaaagtaacacaaaaataatattaagtcttttagatcaatgaaagcaagtataactcaagggtaggcttaatgaacagggaaaagaagtgagatattttgacagacactgatttccaaagaacaggtgcaaacagtgactaaaaatagtcttatgtcatcagcattagagaaaatgtagtcagacaaaaacaaggtttcttttccaaaaccaggccttgagtaacttataggaatatgggggtagttgaaatatgaatttataaaaactggttagcgggtgtttccgaaaagattgtgataatacaattaacacacccacacatattaattctttttgcatagtatctttttaattcactttcttaattccaaccttttacaaatcctgtaagataaggaaggcagaagtcataggataatgtcattgggtagatgatgaagccaatttgacgtccatacttttccaagggtccagggctacctagagggtttgcttctggtctttactcccagtccttttcttaagcacagagaattaattagtaggtttactctgagtctatttcaggattacacaagtgtctgtagtagtgaacacttacactaattgtaattgtacctcataatactgacgccatttgtgagagggattgtaaaaataggggcttagtatcacaaactctggagtcagactgtctgggataaaattctagcttcaccacttactggctgatacttaaccttttctcatcctgtttcctcatctatgaaatccgtctcctgaatcagtgcgtgtaaataagctgagtagcacattaatttattgatttctttaaaaaaattaactatggaaattgaggctcggaagtggtgacttataagcaaaaacttaaacccaggtcttctcaagtcatctccagttccctttccactaaactatcctgtttctgtgataaagttgtgaatgaatcaaaccaaatgttaaactattttatttttctggtttaatacacgtttcttggaaagtcacttttttggtatgcacattgcatttccctctacaaggaattaagctctgagggttacattcctgtacttggagaatggaactggccagtctgtatgtggccagtccccgtgactgacgtcctccattccagccacacttgaattgttagcagtacccattcagttattgtgctcttgcaattcttggggcctttgtaacaagtccacatgtcccctcccttgtgccaaccctttcttcctttgacagccttccccactactctgaggaattcaggggccatgtcttttgtgcttggtacatgctagtgtgcaatgagatagacacatatctctcacaccaaaagccagcattttgctgccatttccaaaagtttaggaaggccatctgcttcaatcactatttagcattgttctggtgggggtgccagccagtgaattagacaagaatgaaataagatacaaaagtttatttacagctagggttgtatgcttggaaagcccaagaagctcaattttcttttttgttaagacatagtttcgctcttgttgcccaggctggagtgcagtgttgtgatctcggctcactgcaacctctgcctcctggattcaagcgattctcctgcctcagcctcccgagtagctgggattacaggcatgtgccaccacgcccggctaattttgtgtttttagtagagacaaggtttctccaccttggtcagcctggtctcgaactcccgacctcaggtgatctgcccacctcggcctcccaaagtgctgggattacaggcatgagccactactcccggccgaagctcaattttcaatattgtaggcagtaagatactcagcttttgtggttaagtataaaaaggtagaaagagatagctctatagacaactctaaaagctatgaaaaacttcttggctgggaattatatcaatatcacatggatataataaaagaatggttctaattcatttagaaaaataaaatattgagactaaccaagaaaattgtgacaattgttgaagaaaaaaagggggagatattatttagctgtttaactttaccagctattaaaatatgttataaaaggaatagaaactaggctaggcccagtggctcatgcctataatttcagcactttgggaggctgaggtgggagcatcatttgaggctggtagtttgagagcagtctggacaacataggaagagcccgtctcaaaaaacaaacaaacaaaattaccaggtgtgatggtacatgcctgtagtcctagccacttgggaggctgagtggagaattgcttgaacccagaaatttgaggttacagtgagctgtggtcaaaacactgcgctccagcctgagcaacagactgagaccttgtctcaaaaaaaaaaaaaaaaaagaaaatagaaattaaaataacttgatattggcataggaaccaattccaaacagaatggtgttaaaatagacctacatgtaaaagagactagagtataaacgttcaatgaaagtagtttttcaaataattggaaaaaatgtgggttactctgtaaatggggttgggaaaactgggtgactatttagaaaaacagttggatctcttcctcattccttggatgcaccttgaaagtgctaaaataaaaccatgaacacttacattcttggagcgaaaagactttctaaacatgacacatcatggatacatatgcctacatttaattaaacttttgtatgtcaaaatatggcaaaaacaccatgaaagtctaatgacatcagaaaatgcttgcaatgatgagaaagagaaatttcataatgtatgaggaaatgcagccaggtgcgatggctcatgcctgtaatcccagcactttgggaggccaggacaggtggattgcttgagctcaggaatttgagaccagcctgggcaacatcaggagaccctgtatctacaaaaaatataaaaattagccaggtgtggtggtgcatgctggtagtcccagctacttgggaggctgaggtgggagaatcacctgagtccaggaggtggaggttgtagtgagctaggatcatgccactgcactccagcctgggcatcagagcaagatcctatctcgggggggaaaaaaaaaatgtaaatccagaaaaacaaatgaataaaggaaatgctcaggtttttaaaacgtgaaaaggtgcttgacttctcataatgcaaataaaaattagttttcagattggtgaatatataatacatgaaatggtgagagtatggagagaagacaggattcatctactttttaggaggaagtataaattgagcaaacatttttgtaggcatttggcagtatctaccaaaataaatggttatgtctgttgctctagcagatttattgacaggaacttattctgtatatgcacatataaagaggatatacaagaatattcattgtggcattgtaacagtttaaacaaaagtttagacattcacatacaaggaatactatgaagccaattaaaatattttgtagggaatgaaccaaggtataaaacagtgccgtatagagtaggataaagaagaatgagtaatagtaacatgtatttcttagaggaaatacaagacactgatcagctgttgttggggaactgggagactggaggttgggaatgaggcttacttgttactttattatttaatttattttaattaaattaaatttaattttttgagacggagtttcgctcgtcacccaggctggagtgtagtggcgcgatcttggcttactgcaacctccgcctcctgggttcaagcgattctcctgcctcagcctcccgagtagctgagattacaggcccccgccacctcacctggctaatttttgtaattttattggagacagggtttcaccatgttggcctggctggtcttgaacttttgacctcaggtgatctgcctgcctcagcttcctaaagtgctgggattacaggcatgagccaccgaacctggcctgcttgttactttagacccttcttatgttttgtttgttttttcagggaaatgtttttaaagaaaaagtgcccctattgcctatttagtgcattggtttgaataaaaaattgttgttttacttctgcctttgaatgtggcatttttggacaaggtttgtcattccagaatattctttccctaaatagaggcattactgtactgttggaaattaagcctttgtaattcattttttgatgtaggcttaattgtatgcctgatctcagcaaagactaaccatatactcatatagtattgattttgtttcaacttgtttagaaatatttgttgcttattttatgatgtcgttttattccattgatttgcaaagtgatgtgattgtatttggtgtgaacacttttcttcagttgttttcttgagttgtgttggtaggatcactttcacacctctcattgaggaggatgctttgttaattttgtttagttagaagggaaagaaataaccaggcttacagaaactaacagctgtgtttattttgatctggacagatttggaggccaatcactgccaccttttatttccctgtgggtccaggaactggatttctttatttggtcaatttatatttcttatatcagtattctacgcgacttgaaacaggtatgttacccatagttgttttaagcattgtttctttctcatttactaatccatgtgtttactttggaggaatttggagggcagttagcattacaaaaagaaactgcataaagatagtaaatgcttagtgactgtgccaggactgcaccaggcacttagcttactcaatttttaatcctcacaacatcctgaggtataagtagcagtgttaccattttatagatgcaaaaagtagcagatcagaggttgacatggcttgtccatctccttagtggctgagctgtgtgcctttcatttattttgagggtctcactcatttcttttgcagcagtccttgtccttcagtgcagaattgggctggagtatatatgtctcctagattggggttgaaaaacatcaatttatgtaattaaaagcctagatttattctctaattgaaaaactcaactctaaaatacagtatatagccaagatttaataatatatggtagtttatcaggtatgagtaccaatgtaatattttattttatttatttatttattttttgagacaatcttgctccgttgcccaggctggagtgcagtggtgccatctcagttcactgtagcctctgcctctcgggttcaagcaattctcatgcctcagcctcctgagtagctgagattacagacacctgccaccatacccggctaatttttatatttttagtagagatggggttttaccctgttggccaggctggtctcaaactcctgacctcaagtgatctgtctgcctcagcctcccaaagtgctgggattacaggtgtgagtcaacgtgcccagccaacctatgtaatattatggataagttcgaaaaatcttttcgtaaaagtgtcttactgaattgtcatttatttcctacaataccttatatgctgtctgagtcacttatactaaagaaacaatacatcaatacactgtgttacaatatggatataattttgttaaatttaaatgactttgaaaaggctgactgacttcagagactttataaacttgctggctgttacctcaggatagagaactctgaactacccttaagtgtatgtaagtcagtgctcatatggttgagaattgcgaatcagtctcatcactgcagggaaatagtaggatgggtatttgatgtcaagtaacatttttccttaaattggcatttgcttttaggttctttttaaaaagaaagaaattgtattaatacaaagtgtaaggtcatagactattatattactattgggaggaacctagtttatttcctgagttttaccaaaagatgaataggagattcaaggaagtaaagtaacttggcagaaatgaaactgacaactaggcctctcaccaccatattaggggtttgatctttaaatctaccagaatatgtgatttttattctcctttgttccagttggacccataatgatactgagtgcttagcagtctgcctttctggtataacttaattgagcattaatttgttagagtaattttttttttttttgagacagggtcttgctctgtcacccagactggagtatagtggcacagtcatggctccctgcagccttgactgccggggttcaagtgatcttcccaccttagcctccctagtagctacaaggatgggtgttaaaccgccacacctggctgacttttgtattttttgtagagatggggtttcaccatgttgcccagcctggtcttgaactcctgggctcaagagatttgcccaccttgacctcccaaagtgctgggattacaggcgtgagccactgtgcccagctggagtaattattttatattgatagtaaacgttatatcaatagtaaaatagattaagtgtggatcatttatgatcagttatttaaaattttattctggaaaattttcaaacatatgcaaaagtggagggaaaagtcaatgaaccttttttctttttactgagaccaaattcacataacataaaattcatcattttaaccattttaaggtgtacaattcagtggtctttagtatattcacaatgttatgcagccatcaccacaatctaattccagaacagtttcatcattccctaaaaaagccaaagcagtcactctttacctcccactttccctcctcccagcctttggcaaccactaatctactttccgtgtatatggatttacctattcaggacatttcatatgtcctttggtgactggcttctttcactttgcacaatgtttttaaggttcattcctgtcatagtgtgtgtcagtacgaacccctccttaaccatctaatggttatcacctctaatagttatctcatagccaatcttgttttatttatatctattgctgtcctccacccctgattatttgaagcaaaatgccaggcatttcatttgtaaatatttcagaatttaactctgaactataaggacttaaaacataattctaatgctattattaaacctaaattgcaataattccatggccacttttttttttttttttttttgagatacagtttcactctgtcacccagtcgggggagtgcagtagcgtgatctcagctcactgcaacctctgcctcctgggttcaagtgattcttgtgcctcaggctcccgagtagctgggattacaggtgcatgccaccacatctggctaatttttgtgtttttggtagagatggcatttcgccatgttggccaggctggtctcaaactcctgaccttaggtaatccacctgcctcagcctcccaaagtgctgggattacaggcgtgagccactgcacctggccaatggccacttttatttttaattgccttcttgtgctttgaatccctttacccaaccctattacctggtcaggtaatacaacaaattgtaatgttattctctctgaataccaatttaggacaaatttgtgggattattaggtcactggtctcttttatttgctttgatttttataagttgcctcctcattccctactcaacaactacagagcattttgaaaggcttgagctgagaggcattttttaacagctttattgagatgtaattcatgtacggtacaacgtacccatttaaagtatacacaattcattggtttttagtatattgacagagttgtacagtcattatcacacccatttttataatatttcaccacccccaaaagaaaccctaccattagcagccattctcccttttcattcaatcccttcctcccccacacccttaggagaccactaaattttttttttttttttttttttttttgagacagggtctcactctgtcgcccaggctggagtgcagtggcactgtcttggctctttgcaacctctgcatctcgagttcaagcaattctcatgcctcagcctcctgagtagctgggactacaggcacgcaccaccacatctggctaatttttgtatttttagtagacaggttttcaccatgttggtcaggctggtctcaaactcctgacctcaagtgattcgcccacctcagcctcccaaagtgctggtactacaggcgtgagccactgtacctgaccaaaaccactgatcttattgactctttagatttgcgtgttctgggcatttcttaaaatcatacagtatcttgttgccttttgtgacttatgtcttttacgtagcataatgttttcaagattcttccatatagcctgtatcagtacttcattccattttattaccattaagattccatcgtatggatatacctcattttgtttattcagtcatcagttgatagacatttgacttggtttcattttttggccattgtgaataatagctgctatgaacgtgtagagaggaacttttgagatcattctatttaacactcttatttcatagataagaaaacagtgatctagagtggtggtgacgtgtcccaaaagttgcagagctctttgagttaacgcagttaggactggaacccaggttcactgatccccagttttctgtcaaccacacagctttaagttaacatcttgacaaaatgtttgccacctgcacattttcctgcctggctaaattgttagttatatagcagagttggcttatttgaggtttctgatttgaactggaagactgtaatttgaaaccagttaatttgtaaattctcagttgcaagcatgtcagataatatagtgctgtaatttatatgattacaatattttaagtactcagtctaaagactccttaggaatcagacagccaaagccacatcaaaagaagcacagctattattaaaatcgggaaattgtgttagaatttcagctgtgattcatcattgtgatcctctagcattaggcctgcttaacactgtggctgaagtgtgctttgaggtatcaagggagaaataaaggagagtagaagacacttttgctggaaacctattttcttttaattatatctttttgccttactgacacttgttgggtttctttttttaaattgactagctgtatcatgtaactgtgagggggtgtggaacggggagggaaagtaactttcaagctagagtgatcttacagtcatttctgtttctttttttttttttcttctgttaaagtcttctaactgaaggcattaggaattatgcttacacgggaggccgttgttgattattctgcccaataaggcatatggcgcagtgacaggagcactgtgctagtaatttgatgtcactctggttctaacaagctctgtgactttggtcatgtgactttaactctgcatctgtaagaagcaggtcgtaggtctttccattctcccttccagatgcagtatgaggactgagtcagaggctatggaaaggtttggctgacgctttattccctccttcccccacattgttttcccttggtagaatgtacgtctctggaagacagagactttctttttcagtatctaaggccagtgtggtacaggtggttgtgtgtgtgtatgtgtgtttctaataataatggtaagtacctcccagcatagccatgctggaggagacacaatggagacaaaacaggcatggttcctcctctgacagaacttaacggtctagtggaggaggacagggatcaagcatgtaatccagaatgcggccatcaggtcatggcgagagccaagaaggaaaggctgacaggctgggagggagcttggggggcctcactggtctttgggatacagggctcagaagctgtggaattgactgtactttctctgggtctgttttagcctgtggtagtcagagcatgtcacttactggaattcagttaggagagcatagattaaccttactcaggtaactttgattcagggctttattggggacgttgtttagatatttttaaaaattcacttttttagagaggagtggtttttaaaatgttctcattttggctttttctgtaactttttgaagtgtttctctatgtagatgttactttgttgtgaaattctgaaccatgacatttggcttgtttttgtttccaggagcttttgatgggaggccagcagactatttattcatgctcctctttaactggatttgcatcgtggtatccttcagtctgtgattttgggccagaaataaaccagtttttttccaggtttggggaaatagaccatattctgtaaacgtttcaaattacaatatttgcatcttggttgactaccgttaataagaataattatagttttttaaaaaaaactgtagtaaatcatatagcccttgagtgatgcattctcttaccatttgtgggatttttttccacctttggttgagtagttttatgactgttccctcttcttgttcccagttctctgtgttctcatgtgtgacagcttgttgactgaggcacaaagagagtccgtgccatgagacagcttttgaaatctgtggtccttatcagaaaattaatttacaaccagcatccttttctgacttcattgctgtccttctcttggggtcctacatagtaattcagtccctctgtgaagtacccagctctgggaagggacacagtacgtttctctgctttgtatcaatagcagttgtcagcagccctccaactgcaggactcttacagatggtgagagcagcagcagctctcgatgtctcaggtcctgtgcaaaattggtgagctcaaaattgcctttgggctcagctgccatttaaacttggctgagggccagaaaatgtggcactgtggatgccctttcccccctcctttgagggaaggaaaaaatattttggactttaaccatgctatagagtcctgagaatgtaagtagaatgattatttccttcaaaggctacaggcatcttcatcctttatttgaaggagagatgttaaaatgcaatagcagagaaaaaggatgccagatgaccagactaagtcatatgcggaagctgttgatttctactatgtccttgtcatggtatcgtctaatggaatatgcataatgaagattagatacctttgtgttgtagaatgttttaagcaatctgaactatagaaaagtattttccttcagaacactggaattaacttaaaaatttttttaattaaaaaaatatgtatataaattagagatggggtcttgctatgttgcccaggctggtctggagctcctggcctcaagcagtcctcccatcttggccttccaaagtacagagattacaagcatgagccaaattacacctggccaagtgaacttttaaatgggaggaaaataaccacatcagtcttgactaggtacagaatgcttttttatgtctgatctttaactttacaaaccaagattactggcttagcaatggatatgcaggtaagtgtccatttaaactatctatttgcccttttatttgtttcaaatatactattagtggcctttgtcagaagttgaaattgcattaactatggggttaattatgtggtattttgaaattatggaattacagctgttttatttatttatttatttatgagatggagtcttgctgtgttgctcaggctggagtgcagtggcttgatcttggctcactgcaacctccgcctcccgggttcaagtgattttcctgcctcagcttcccgtgtagctgggattatagatgcacgccaccacacccggctaatttttgtatttttagtagagatggggtttcaccatgtcaccaggctggtcttgaactcctgacctcatgatccgcctgcctcggcctcccaaagtgctgggattacaggcatgagccaccgtgcctggcctatagctgttttattttgaggatcttaagtcagctaaatctttgaagatcttacatgagctatctaaatcattgctttccttgctcatttctggcctctttttggtgtttgaacattgacaataatggttgtctagtattttctaggcatgtgacaacagtggttgtctagtattttctaggcatgtatatggatgttttttaaaaattgagattatatggtaatgctttgttgcttactttttgtaaataacagagcttgactcttacatttctgaatccatctaaaataatatagttttgttgtattttattataggattttgtaatatttattgtatgataaataataggatcaatttataattctgatcagttgagtttccctttacccaggtgaggattgttgtgaagaggaggggtaaaaagcatagtagatgtacaccttttttaagtgcctctggagcctggtttttacatgtcgacttcttttgcagttgctgatgattcctctgatcatgtcagtactttatgtctgggcccagctgaacagagacatgattgtatcattttggtttggaacacgatttaaggtactttgccttggttggaaaagtgtccttttcatttgtctgcagaaatccctcttcagtccagagatgtactttctgactcatccagaaggggtcactgcagagcagtgtaccataggcaagcccctttctgccctcctcaatcccagctctatttaattagccagcctggagtccgttgctggcctttgtttcttcactccctctgtacctcgggcccctcaaggttatgtccctgagtgatcttatgtgtctgtgttagagagaaggagagataactcatgtgaaaccctgctttaaaaatctgttcttatccctccctcgttccctgttatttgctttatactgtagctgaaacagattgtttttgcccccaaacacttctctttgtacattctttcacaattttccacctgtaacatcttgattctcttctttgtataaatcctacccattcttaatttgagttggaactgaacatatttcctgaatctcctgcctagaattagtcttacgtttgggctttttcaatactttgtgtttctctttagtacttagcacatgtagctgtaaagttatttgagtataaccctctctttcctagtttgtgaagtttcttgcaactcctttagctcttggtatgatgtcttggatttggtaaggggctcaaatgttgagttcatctggagagctttcttatttgggagagtattagtttaagatatcaatgcataatgagataaaaattcagaggaattttgcaagatatgtaaaagaagaacctaaaaagatggggtatgtttattttatttgtagcaatttgttggctggaatcttagtgtgattctctcatgggccttgcttttagtagcatctgtaggacactcatctgctttttgaagctgtctgtttatagcagttcagcagggcctgtattgcatcagacctgtgggcaaagtactgtgtccttccagttacaaatacacaattaagtctagttttagataggaaggtttaagtatagtgggaataatgctagattgatcctagaaattttgcagtgaccttccagaggatttatataaagcccttgtcagtgtatccttacccactttagtccccgtagtagctgtgtcctcgtcaggtgtggctactcacatttgcatatattcattccatcctaggcctgctatttaccctgggttatccttggattcaactatatcatcggaggctcgtaagtgatattagatttatttaattggaaactaatccttggaaaatttccattagtttttatctttctctaacctttatacaactttaaagaatctcaacattgacgcattagaaccctatatttatggaataatttcacttcgattgaattgattagattgcagggctttaagcatatttaaccttgaatggttgtgattttgttaacttattgttacacacagtatgttcctatgtgtatagtacaggaataaatatgtatttctggattcactattctgattgggcaaacagagacctaatttttgtctgagttggctcctctaagagctatgtataaaattactatgtcttatattcttaaggcatttccagaatgccttggaaactgcctatcggtcatagaaatccagattcttagataggatataattttgcaagtggtttgatgatacagaacttttttttttttttttttgagacgaagtttcacttttgttgcccaggctggagtgcaatggtgcgatcttggctcattgtaacctctgcctcatgggttcaagcaattctcctacctcagcctcccgagtagctgggattacaggcgcccgcctccatgcccggctatttttttttttttttttttttgggatttttagtagagatggggttttgccatgtttgccaggctggtctcaaactcctgacctcaaatgatctgcctgccttggcctcctaaagtgctgggatttcaggcatgagccaccatgcctggatgataatacagaacttttggccaaccagggtcaaatatctagtctattggtcaggaattagagctagacataggaatagctttaatttatccagtcagaattttaaagggaggataccaagatgcaacttctctaagaactcccatttcttcattttttctgtttatttatttacttatttattttttcaagatggggtctggctctgtcaccgaggttggagtgcagtggcgtgatcttggctcactgcaacctctgcttcccaggttcaagcaattctcatgcctcagcttcccgagtagatgggattacaggtgtgcaccaccacacccagctaatttttgtattttttgtagagatgaggtttcgctgtgttgcccaggctggtctcaaacttctgacctcaaatgatccgctcaccttggcctcccaaagtgctgggattgcaggcatgagccactgcacccagccagaactcccatttcttatactacaaactacttttaatatttcaatccatttttatattgctggttcttcatgtgtctgacatatttgctctgtgtgatcctaacttcttctgcatattgctggggagaagtgaatggatggagcagactgtttagagcaaagcatgttctgaacttggcaaagctgctcttccacccaggaaggtgaagtctgaagtagttgcaggtgttgatttgcccctgacgggaatcatgttgcaggtgaagacaaagaggatttgtaatagtaacagtagatctatacactcttgaggtgacctgtatgtaagccaagggaaaactgaagaaggtcagcgttgatttcagggtgcaagtcggctttcctaagtgatctctgtggtgtcttacactcaaggatacaagaggcaagggagaagtgcttaatggctccaggaaagggggaacaggcatttattgttcctcttttccttactcccacgcttctctcttggtagccttcatgtttgcccacattttataaatacaatattcatgactgaaagcattcagaagcatgctttgcaacttccccaactcttgaggcaggaagtagcaaaaacaatattttgaggatgggctggtgcttgaaagagaggtcagaggggctgctggccttgaagagtggcaggcctcattggttcagcaggactgatttcccgtctccctcagaatgcatttgccactcagactacaaaagtgctcattgtcagctctcacagactcccagggactaaatgggctgccttgaaggctctcttccttatgctattagttaaaacttggtgcatctctattgcttgaatgtctttaaactcatttggctctctttgcagggtaatcaatgagcttattggaaatctggttggacatctttattttttcctaatgttcagatacccaatggacttgggaggaagaaattttctatccacacctcagtttttgtaagtgtttttgtcctgtctcatctaacattttactgcctgtgttcttagtgcatcctaatgagagctccatgaggagtatgatttacccctatgccccatctgctggagaaacctgaggcaacaagtgacttaccctagtcacacagtcacaggaagttagggattaaagcttaggctcagttgccttcctgttactcttttagccagggaccactgacaactagattccaacattacaggaggcatctcagctctctgagcctgctgagggacctgatgcaactccagagtgcgaaacagtaggctggtgaatgggcagagtcacaggttagtggggtgtcttttcttggcccatcagtttttacccatgattttgcccaaggaagggtaagttagcgtgttggtcagcaattttaaacatttttatattaaatactatggagtagacattttacaggactgttcagagttaaaatgagagacttgaggtttgtataggcccaaccccctgggagtttgtgctctttatctgcttttagggtttactgaagtgggctggtaagggcaacagctttgatttttgagacaaacttggatttgaatcccagtcccctcagatagcagtttttatactgggaaagttacttaatcaaacctccaagcttcagtttgcaagcctgtaaattgtgggagaagcccctgtctcacaggactgcatgaggtaagatacactgttgggaagcacagtagcgggttctcggtaagtaaagctagctgccatattcctaaaggtgggggtaggagagcaggattttgacgatctgagaggagacgcgcacacacccagaagcatgtaatagtcgtgtgaccgttctgtcagtgaggcaaaaggctgtcgaagaacgggccagttaaatcaccatctgggtgtcacagcctgcctgacaatcatgcctaatctcatatcagggatatgcagtaatagcttgcatttgaaagctttaaaaaaacaaacaaaccaaacccttccacatcttgctaattttaatgttttgcagttctgtcattcctctaagggatcagtgagggcagtaaaacttgagcaggcctcctctttctccccttccttttatagggtaggggtatgtttttcaaagacttttcaaattgtgaactgtaatatacagagatataccatattggtggttgtggtgtgtgtgtttttctttaagagaataaaaagaaacttgtttctcttctgagccttgaattgccttcaggctaaaaaaacaaatgaccaatctggtttctaattatcaaaggacataataacagcaggtttggctttctgatctaggtttatcaagtaggatggcagatgcatcaattaaaaaaagcttggtgcttttggggggcagccaacagttactttactttaaatggccatattctaacttaacggcttgtagctacttctcagttgtgggcaacacaggatacaagattctagtggcaaaatcagcgagccctggagcctgccttccacttgaactttctctgttgggggaagtccttctgctaaattttgcataaagatcagatgacaaaatacagctccttgcaaaagcagtaactgctttgaaattaccataaatttttgttgattatgtataattgggtatctttttatactaattatttgcatttaatttcactatctacttaagcagtggagatggcttccatattgtcttagagtgagtagcaaagcaagacagccctagcattttctccagcaagtgttctattttattatgtactttggaggaatattattgtaccagaaggcatggatgttgagaaaccagcacttggaaaatacattttgatttaatggtaaagctgtatttgtttaaaatggaggaggtgagtataggaaggtataactgcttttctaaatggaatgctgatacatttgtatcaccattttccattccatttagagtagttatatcttctctgtacacactaaattttgtgtttaaaaggggtttttggccaggcgtggttgctcacgtcggtaatcccagcattttgggaggccgacgggtggatcacgaggtcaggagatcgagaccatcctggctaacatggtgaaaccctggctccactaaaaatacaaaaattagctggacatggtagcgggcgcctgttgtcccagctactcgggaggctgaggcaggagaattgcttgaacccgggaggtggaggttgcagtgagctgagatcatgctactgcactccagcctggtgacagagtgagactccgtctcaaaaaaaaacaaaaaaacaaaaacccgagttgttgtctgttttgggaagaggcatgaaggtatcgagtatgatgtaaacagactccagtcactgactgctgtcccttcccaggcaggatgcatgtagtataacaagtagtgcagggcgcaggctctggaaccaggctgactaggttggaatcctgtcactttcgaagcgcttcactcagtgttggctcaattttcttgtttataaaacaggagtaatagtaatgcctacctcatggggttattgtgaagatcagatgaatttataagcaggcagcacctagtgtaaggcaataatcactgagtaaattcacatagtaactgctctagtataaggtcaagtataaagcctgtcctcttcagggtttctgctgtggacaagtcacctgtcatgacttactcttgctgccaagaagggtttaagcggaggtatcagatcatgctctctgccttcaagcaaaattttaaacattaggatctgctaagtggaataggtttaaacacattctcagtttactaataaaagagtcaaagatgggaaatagttggaaaatactattgagagtgtaggcttgggtttaagttctcttagctgttctgtgaactcttagtttattaattttaaggtgggaaatcatctaaccgtctggggccccagctctcccaccatctgtgagaagggaagaatgtacctggaaggcagattctgaataaattttaaaacatacccatacttccaacatagaaagccttcttcccctgtctcctttgatgggctcagctgagagccttttagaaatgctgtgcaaggctcaaacatgcaggctgtggatttggcctttgaaagtgaatgtattttgtatcctttgatccagtttgagccatatttagatataccaagatgctatcagtcattctttggttgctgggcttgtgggtgtaatatttttgtttccatactgttctgcatggattacttttataagcagagaaaaaaacgttcagagtgtgaatttagctgaaatctgaatacatttaagaaacatgaaaaacgaatgccgtctgtggtcaggtcatggggctgagtacagaaaagacaaagttaaataagacgtccctcgctgccttcaacatgacaagtgccatgggaacagcaggagagggaggtgttctcggaggtcagataactatgtggaagtgactttgttctcttctctccgtttgtgtccccgtctttctgcaccaggtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaaggttgtctgtgttaagtttccatgtccctgctctgctgtctcttagatatcacataatttgtgtaaccaattatctcttgaagagcatttaggaagtacccagtattttttgctggattaattcctggatgcagaattcctgggttttcattttaatgaaggaggatgcttgctaactttga

SEQ ID NO: 561 - DNA, 1646 bp, Homo sapiens
gccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggtgagctgggcagggcaggggctggtgggggaggggtcatgtggccccaggtcccacctgctgggccctgggggtggggcggggctgttacaccccccttcctttcacatccacaggaatcccctccataacccaggcctggggactgtgggtcctcttaggggctgtgacgctgctatttctcatctcgctggctgcacacttgtcccagtggaccaggggccggagcaggagccatccggggcagggacggtgggtgaaggacaacagggatgggttgactgagagttctctcttaccgagaagtccccactcatcccctaaactctgcgttgcagctctggagagtctgtggaagaggtcccgctgtatgggaacctgcattatctacagacaggtagggagctggcagagaggaggggcacagaggccaggtcctgggtggctgggatgggggcgtgcaggaggaaggacaagttgctgaccagattcctgttccccgtcccaggacggctgtctcaagacccagagccagaccagcaggatccaactcttggaggccctgccagggtgagtcaactgtggctggagaaaagggggagggaaggaagtggggggcttttcgggcttttccgagggtccagtgaacttctaacagccttgcatctccaggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtg

SEQ ID NO: 562 - DNA, 25172 bp, Homo sapiens
agaaggttgtgaatccatgctaaaggtaaacaaactgcaacttatatctgcaatttattttggtatagacaagaggtatgccagtagcacactggtggcttcagaagaaattctcaacacctagctcgccagagagtctatgtatgggattgaacaatctgtaaactaaaggtatgaaaaaatttgtaaaattgggaaggtgagggaaaggtgtgacatttatttttgggtgcagaaacatctaatgcccatgtataaactagggatctggggtgaaaggtgcttctaggggagggtaaattttgagggatggaaagttttagaaaggcagcattcaagcaatctgatgttaaagtttaaagttccaagttaaaagagaacttggaattccggtgcaaagagaaatgttaagatgaatcatggaaaaatactgataaagcctgaaatttttttaagtaagaaatgttttaaaataattcttttcaagcttgagggggtgctagaaagcctgctaaaacagaaaaggaggacatattaatagattggcattaatgaaacagaaaaactaatttgcattcaacaggcactgtaatgatgtggttctcagtgttaatatttgctggagtattttgtgtctgcccttgagtttaagggaatagaacagggaacctgataggtgacaaatagtctggagacttcatctagacacgagcaagcttgcatccttcaggcccttaagctgctcgatttcttaaagatcacagtgggctccatgaattatctgttctgtagaatgtacaagcagatagctaaaagagagcacctgggagataccaagtacagcttgcgggggtgaaggtttatttctgggagttatttatctgaggctaaaaagtaatcatgagccaaaaaaatttcaaatgtttcccatgtttgtttgcttttctgttttgttgtatgtttttgtgcttgtttttgtattgtctcttgtaggatcctaatcatgaaaataagtatgataaattataagtcactattggcactgttgtttatattagcctcctggatcatttttacagttttccagaactccacaaaggtaggaaatgctttatttatgtggtttacagaagcttatttttgcttattacctcatctgttctaggaaaggctaaactacaagacttgtagattataggaggggagtttgaatagctagataccaaacaacatacctgataatcattaagcaatatgtgagaggataaatactgtgtgtgtgttcacacatacacattctttctttgtcacaaataaatgcattgcacctatcttcttcaatgcttagctcatctttttactttctttaagggaacatctgaagaacagaatatctatatttttggttttcatttgtttgtttttaatttttaatttttgtgggtacaaagtaggtgtatgtatttatggggtagatgagatattttgatacaagcatataatacatagtaatcatatcagggtaaatggggtattcattgcctcaagaatttatcctttcttgtgctacaaacaagacaattatactcttttagctatttttaaatgtaaaataaattattggtgattgtagttaccctgttatactatcaaatgctagatcttattcattctgtctaatcatatttttgtactcattaactaaccccacttctcctccatgcccccaccacccttcccagcctctggtagccatcattctactctctaactccatgacttcaattattttaagtattaacttccacaaataaaaacgaacatgcaaagtttgtcttctgtgcctagcttatttcacttaacataatgaccttcagttccatccatgttgttgcaaatgacagaatcttgttctttttataactgaatactactccgttgtgtatatataccatattttctttatgtatttgtctgttgatggacacttaggttgcttacaaatcttggctattgttatcagtgctgcaataaacatgggagttcagatagctcttggatatactgatttcctttattttgggtatatacctagcagtgggattgctggatcatatggtagcctatttttagttttttgagaaacctccaaactgttctctatagtggttgtactaattacattcccaccaacagtgtacaagtgttcccttttctccacatcctcactagcatatgttactatctgtcttttggataaaagccattttaacaggagtgagattatattacactgtagttttgatttgtgtttctctgatgatcaatgatgttgagcaccttttcatatacttgtttgccatttgcatatcttctagtaagtgtctattcagatcttttgcccaatttttaattggattgttaaatatttttgctatagagttggttgagttccttgaatactctggatagtaatcccctgtcagatggatagtttgcaaacattttctcccattctgtaggttaactcttcactcacttgattgcttcctttgctgtgaagaagtttttagttttatataatcccatttgtctatctttgcttttcttctctgtgcatttgaggtcttatccaaaaatcctctggctacatcagtgtcctgaacagtattccctaggttttcttctagtattttcatactttgggtcatgcatatcagtctttaattcattttgtaactgagttttgtatatggtgagagaaaatggtctaatttcattcttttgcatatggatattcagtttctccagcaccatctattttaaatacttttgttcccccattgtatgtttttgatgactttgtcaaaaatccagatggctgtaaatatgtggattcatttctgtgttctctattctgttccattggtgtatgtgactatatttatgccagtataacactgtttactataactttgtagtatattttgaagtcaggtaatatactgccttcagctttgttctttttgctcagaattgctttggctattctggatcttctttgtttccttacagattttagaattgtttttctatttcgatgaagaatattattggtattttgatagggtttgccttgaatctgtagattgcttttagtagtctgaacattttaacatttattcttctaacccattaacatggaatatctattttgtgtgtgtgtgtgtgagtgtgtgtgtgtgtgttctccaatttcttgcatcaatgttttgtagttttcattgtagagatctttcacctctttagatcaatttattcctagggtttttgtagctactgtaaatgaaattgcttttttgatattttttcaggttgtttggtattggtgtatagaaatgttactgatgtttttatgttgattttgtatcctgcaactttactgagtttttaaaatcagttctgacagtttttcactgaagtctatggagtgttctaaatataagtttatgtggtctgcaaacagggacaatttaatttccttctttccaacttgtatgccctttatttatttctctgacttaattgctctggctaggacttccaatactatgttgaataaaactggaaaaagtgttcaaaaatatcttgttccagatctcagaaggcttttgactttttcacattgaatgtgatgttagctgtggatttgttatacatgttttttattgttttgaggtacatttcttccatgcctaatttgttgagatatttttatctgaagcaaagttgaatgttatcaagtgtcttttctattgagatgattatatgatttttgttgaatgagaaggggccacctgacaaatggactttcaaaaaattagggacataatataccctggtcaatatctcagataatccttgcatcaagggctgtcagtccagacatctcctgttcacctacagatttgtaggccactacttttagcaaacatcatacaggggcctggaattccatgagggggcatggaatttattgttttgaggtatatttggtgaaggattttaaggactttccattggctggaggctggaaagtacagcttgccatattctgactgtagtcatcctgagggctggaaagtataccctcgagaaatggcccattctatttttgcaggggagtactgaggcttaatttcttttatgaagccttcccaggttagaggggcttcaagttgatgtcatgaggctttcttgctgctgacttggctgcctgatctgctaacttgtttccttcagctatttcatttgttcccttctgatgtcccttacaatgcattactgctacctctcatggaaggaaaactgaggataataacctgttaatttcctggtggtaatttatagtagattcattagtagtaagaaagtgtctttccttccaaatggtagcatgagcatggagaattaagaaagcatacttggagtcaatgtaaatgttagctacctttcccttgcttaattcaagtgctcttgtaagagctgtcagttcagctagttgagcacttgtgcctggatagagaggtgcactttcaataacatcattcagagtgactactggatattctgccttatggacttcttgctctacaaaagaactgccatctgtgaagatggtccagtctggattttccaggggagtttccctgagatcctccctggcttcatagatctgtaccacaacttgctcacagtcatgttcaggttccccagttttcttggggaggaaagtggctgggtttaggcaagaacaagtttttaacagaactgctgacccttctaacagcagagcctgatatttaaggagccaacggactgttagccaaaggttccccataaaagacagcaatcctgctacattgtgtggggcataaacagttaaaccatttcccagggttaatttgatgacctccagtaccagtagggccaatatggcaattgctcagaggcatgctggccatcctttacctgcaaatcaagtttcttactcaggtagcccactagttgttgagctggtcctcaggcctgaattaaaattcccatgcccattcctttcctttctgatacataaagattgaaggccctccctacagaggggctgagggctggtaccttaagtaaggcttgctttcactggctaaaggccttttgagctttaggtttccaggttaggagatgaattttatccacttgagtttcttttatgaagtgatatagaggatgatctatctcaccatacccaggtatccatagcctgcaaaatcctgtaatgccccaaaatcttgtcagttgcttgaggattttagggagggggaaggaggaaatgggcttaattctttcttcccctaatgctctggtcctttcagaagcactaaaccaaggtactttaccaaggttttgcaaagctgggccttagattttgaaatcttatatgctctgtcagctaagaaattaaaaagagtttcagtgccttcccaagaggtttcctcagttggggcacagagcagtatatcatccacatattgcaagaccctgacctgaggatgggaaaactcagagaggtcctttgacaatgcctgtccaaacaaatgagggattatctcaaaatccctgaggcagcaccatccattttaactgggcagtttggccagaagcattcttcaaaggcaaacaggtattgagagtcaggatgtaacagtatgcagaaaaaggcatcctttaaatctaagactgtaaaccatttagttccctcaggcatttggattagcaaggtatagggattaggtactaccagatggattgagactatggcctcattaatgaatctccattctgcattgggtttttgtgctcctaatattggggtgttgtagggactgttacagggtttaaggaggccctgcatcttcaggttattaataatggcttctagccctttcttaccctctggctttaggggatattgtctccgattaggaaaaaagtgggatcattaggatagatccagactggcatagtggttacaactcaacctattcttccttgagttgcccagacttctggattgatattagcttccactagaggagaaaaagagtttttcctggggctataagtatgctggcccacatgcaagctagaacgtctctacctaataaagaagtgggactttcaggcatgatttaaaaggcacatgtaaataatatgtccccccaactgcacctaaggggttgagaaaaacatatcagagtgtttatgagacaccccacacccctcatgctatgggaaaaggggaggcctcgattatagaggagaaaagaggctggctctggtgtccagaaggaggtccaccttccttccttcagtttccagaattacctgggcctcctgtgctgtaatgggaatttgagccactggagccagggcttgagcaccaggacccatcagtcctgctggaccatctttgagactggttctgaacctgttgaccttcatctctgggggcagtctgatcaccagtggtccccaccacaggctagagagggtcgaggtggcttcttcttgcttcctggatatcctttttaaagtcctctgacttcccacatcaatagcaactcgcagatgcacctcagggatcccagactttgcaagcctgcaaagcagctaccagagcctcagtccttctcttgtgtttcctctctttttcctgggtctcctcctggtccctactataaaagactaaggtggccaccctcaggaggttctccaaaatgctatctggccctatagcctacttctgtagtttccttctaatattgggagctgcctgtgtaataaacttgtcatttaggatgagctgtccctctactgaatcaggggacaagaaggtgtgttttattagtgcttctttcagcctttccataaaggctgtgggattcttacctggattttggtctaccatggacagtttagagtagttaagaggtttggccttagttcttcataggccccccaatatgcacattaaaaagtgtttccttttctattcatctgtgatgtcactggggttccaaacaaggttgtcaagaggtagtgcctctcttcgtattgggaatgatggctcccctatttcttcattttctctatattcttttttcccttttggcctactataggagacatattgctcatctttgaatttctcccctgcctgcagagctgcctgtttttcagctgcagttagggtttggcttaggagcagcataacatccctccatgagaggttagacacctgagttaaattttggaaagcttttatatacttatcagggtcatcagaaaattggcctaagtctccctttatttgtctaagatcctgcaataagaagggaaccctagtgacatcacctccattgagcatttcctgtaaggataagagtgaagctaggggagtggggagttttggagatggtggagctaaaggacctgatggcacagctggagggggccccagagagggaggacaagaagggcctggacactcaatagctgcctcagatagttccctggaggttgcttctctagttttggggaatcattccctttgggccctcctgatatgactgctgaaagagctgagctgattgtgcaatgcttgcaaagttctgggttgtctcacagggcaaagaaagcctgtacctaagagacctctgaccatttgctgtcccatctacagaaaatatctaattgttggatagtattaaaattaaggctcccctctgcaggccaggatggttcaagatggtaagaaggccacacccttatgcaaaagaaaatgagccactttttcttcagtctcagggtcaaaggaatcccagtgcttcagaaagcactccagaggagtgcagaccaaagatggtctgttattcatctagaaagagaagcaagaaaaaaggtgtccctttagtcaccttcgtttcctttggaaaggcctagggtggaggggaagacagtgggggcatccccccaactgttttccctccttggcgccctgagccctggcatcttttaaggtgccatccattgatgcaagcataacccatagcaatgaaaccagaggaaccaatggattgggattagtcatgctcacccatgtgactctagtcctttgctggtgatttccctttgactttctagacttgtgtgatctgcatgactctccaatagatggatcttgagagagacttcgttacagttacatttgggtaatgccctttaatagagaatgcaggtttgagctgtacaatttgctattatgtcctgtactaaagtatttattcttaggcagtggctctggttaacttccggaattaaattcctcttactatttaagtaccattttaattggaggcagaataggtgccttaaaagaacgtaggaaccaaatggttgttttcctgctgatgggaccatgttcagactaaaatttggttttggaggacctttttcccctcattgttgaagacagagttttcttgttcaaagaaggagcataaagcctggtctcttgtagaggggcaaaaaaagcgagaattaggaagttaagagtgtttccgcaaagggccaacaatatgcctcatggaatagggttcccgttccactaggtgatgctgttgaccttgaaataccatgtgctctccagaccaagggtaaagagagagatgttcacagggggtgtggggagggaaggaggacctctgtgcctagaaaatcacaaaaacggcaatcccatgagctatattcccaggcattatggcatttccttatcttgcctaagaggattacttcaccgaactgtaaaaatttttaaagcattgcatacagagagtggataggagacatggaagttgcggataggaaaggagaaaatttgcaatagaaaaagcttgcagatcctgttgccatcacccatcaggctgttggaggctggaattagtccagaaaccttcaggtaacaccagggtgtctccctggcaaggaaccttcagtgcctctcaacctcttccagccccacatgacagcaaggctctctgtaaaaggaaaccaattagaaacaaagccaacattcccagcaccctgaggacatggggggattagctaagttctccctggcaagcctgtcccctgagtcttgtaaggctggtagccacgctaactttttaaatggctgattgggggcccagtatttggtttgatttttaaatggagagcagaaggccttgaaataaaaagaaggagttggggtccacttctatactcccccttctatgaatcttcctcggatcccaggtgggctcccataatgaaatggcatttttcatctgggataatacccgaggttcattgtctctctccaaggaaatcaaggacatggacatacaaggagtgagtttaagagcagaggtttaacaggcaaaagaaagagaaaagctctcttctgtagagacaggggatttaagtgggtcttttggtccacagtgaagtgcaggagattttatagatgagcttgaggaggtagtgtctgatttacacagggcaaaaaagattggtcaccccaggtgtaacatttgcatagcacacaaagaactggttaggactcggtgtgccatttgcatagcatatgaagaagctggctgtcccactctaatctttcattatgcagatgggttctctacctggccagctccatgttgcctgcttttttactgtacacatggtgacaaagaaaagggaagatggagcctccatgttgaacatgcctggccctcaggtagcccttttctattgacacagccgccagcattcacccatgcaagttttcagctggcttatctatgtttgcagcttgatttttcaggctgctctttgttagaaaagaaatgatttgggggctcctttttgttaaaaagggaagccttgccaaggactcctttaccctcactgtctacctaaataatttctttctagttcctgtttcatttcctttatatatttaggtgttctaaatgttgaatgtatatacatatatatacacacacacacacacgtacatatatttgtcattttctcttgatgaattgatctctttattattacataatgaccttctttttctctttttacagtttttgacttaaatccaatttatctgatataagcatagtgactcctgctctcttttggtttccatttgcatggaatatctttttccattacttcactttcagtctatgtgtgtccttaaagctgaagtgaatctcttgcagaaggatagagttaggtcttgtttttttaaaatctactcaaccattctgtctttggggtagggagtaatgaaatataccattttattacagagtctcacaaaaataaaaatagtatctcaaaactcccccaattctgcaggtggaggatggcaggagactagactaccatcctccacctgcagaactgggggaagacagatggcaggcagtgtgagttttttggctcacttgaggccagtgagaaggtatgagaatggaaccaatctaaaaatggctgatgttacttaggagctgaaaagaacagggcaaccttgaagacccagacaccccttttagaaggtgcaataaaggcacctttccaaagctactaagcaggcacttggcatttcaggattttgtcttctgtttgcacaaaagtattcccttcacccagacctggcgccttttatgcttcagagttaagacctgcagagggataggtggcaaggcatttcctagaagagatcacccagcacagctgccctgggctcagggtcttaatttctgtctagtccctggaactatttatatttaataaattttatatgaatacctggagaaatagaagacataaaatctgagggtttgggagagaaagattggggactaggcaggaagccagagcaggggaggttccctcaggccagcttgacctgctccttgacctctttggctcctggcttctcctccttcatttttctcctcttctgtgacatttcttcatctctgagtctctctttttcatcctgttttaatcctcttggcttttttgaagatgggagagatcttgcagccacgctctccctcctcatcagagtcgaagaactcttcctcacaggtaattcatctgtcagagaaacggatggagatgagcttgtcagggtcttcttcattctcatcgccaccctcttgagggacagcatcctcagaatcacctgcatttggactgcaggtggatgggcctgcattactaggttctcaaacagccactgtttaatcttctccaggtactcattagtgttctggttagtcatattggaaggactgatgtagggcttgaaatatggtccaaagtattcaaagtaatcattgtatgaaggctcattagggatctccatatccagagccacagctctttcttatttccagggcactgagcaacattataaatggtgtaaccaccttctgccatcaataacataggcaggttgacactcttgacagattccacacacttggcatgccctttgatgatcagattaaagcaatctaagtgacccctagacaaggcatctgagccatgctgtaagatcaccacactagacaggaacatctctattactttggacatgaccagtttgaaaatggcctcataggactcatcatcaatcccatctaggagcagatagttaatagcataatatctgcctttgccagccccaataacccataagtccccatctcctgggaagtactctccatatttatgaaaggacacagtcctggcctagcctgtaatatagaaggcctcttccatgccatcatcatggtgaatatcaacgtcaacatacaacaccctctggtgatactttagcagttccaaggtggcccagattgtatcattaacataacagaagccagatgccttgaacttctttgcatggtgcaggcctccagcccaattcacagcagtgtccatctgctgctcattaagtttcacagcacttgccacagagccaccagtagacaactgacagaagtcaaacaggccatcaaatgctggacagtcctcactaacgttgaatctctgcatccgcttgctgtgctcagacacgtaatctggatagatggagcacaagaatttaatgtagtcatcactgtggtacttggtcatctcctcagcattggctttgtgagggtgatgggtttccatttttcagtagaaaccatagttgagcagcaaattatgagtcacgcagattcagtgaggattccttgggtgggcttgtccataatagtaatttccaacacccctatcgtagtagtaacagactttcctcctggtgccctgcctttgcgccatcttgctcacttcctgtccctctgtctctcctgtcagtcaatctccattctatgcctttttattggagaatttaaataatattgataatagtatgtaaatcaatattcaaaatcacaataagtaaaaatgactaggaacatgttaatttcatagcatgttacacttcctgtcatttcagttcagatatgctctaaatttatccatctcatgtcacatttgctgtcatttcaggtttggtctgctctaaacttatccatctccctccattactggaacaactccacaaagtccttattccctaaaacaccactgatatcattaaagccactaacagagactgaactcagaataaaggaaatcatagagaaactagatcagcagatcccacccagacctttcacccacgtgaacaccaccaccagcgccacacatagcacagccaccatcctcaaccctcgagatacgtactgcaggggagaccagctgcacatcctgctggaggtgagggaccacttgggacgcaggaagcaatatggcggggatttcctgagggccaggatgtcttccccagcgctgatggcaggtgcttcaggaaaggtgactgacttcaacaacggcacctacctggtcagcttcactctgttctgggagggccaggtctctctgtctctgctgctcatccaccccagtgaaggggtgtcagctctctggagtgcaaggaaccaaggctatgacagggtgatcttcactggccagtttgtcaatggcacttcccaagtccactctgaatgtggcctgatcctaaacacaaatgctgaattgtgccagtacctggacaacagagaccaagaaggcttctactgtgtgaggcctcaacacatgccctgtgctgcactcactcacatgtattctaagaacaagaaagtttcttatcttagcaaacaagaaaagagcctctttgaaaggtaaaaataattacttcttgagactacctgtgcaaatattgtgatttggcctatatactgatccaaagaaaagtcttgtgagtgtattaattttgggtgtctttagtaagagcctttggggaaaggatctgtgaattcatttagagacagtgcccattctctagtaatccacaaactttttgaacatttaattcttatcaatgggaaaaaaatatatacagaataaaaactagaagaaaatgagaaatgcacatgtgtgtatgtgtgtgtgctctaatacattatttctgcaactcaacaaattctcttgcataccttctgggtaactgtatcccatagcctaataggcaaagaaatggaaatttactaaatggcctgaaactgtaggcataataattgacttatctctaagaaataactgaggcactggataatctagtttctgtatgtttcctgatttgaggccacctacagattaatttctgtatttgtgtctttaaggtcaaatgtgggtgtagagattatggaaaaattcaatacaattagtgtctccaaatgcaacagtaagtactcctgtgtttggtgggtggtgcctagttctagacccatttaaagggtttcttctttctactggatttgttcactgtttcagtcctatcagcactctgttcatctggcttatctaaggttggccaagacaccagttacctaggtgagtgaataattcaatcactggaatatcataagcctattttagtaactgtaactctcatcatcagtctatttgtcagtcagtgaattccctgcccattttatacaacaacctttaaacgttaactctttcccaattctatacccacttctttacctcaccacaacacctctcttcataccactcccatcacctcttcccatatcaccactagcccatcaccatctagaggtttccaacctgccatctgagtgtcagtttattataacccctccctcttgatctttgccacctttcaaacaattgttagcataaaaaatagaacttgcacacttatatttactaatttctctccaatttctttgaatccaaatagcctaggaaattcttatctaaaacgactcaaggcaagagcttttatgtctctgcaagttcagcattaaaaccttgctaatcataaaaaaagaaagaaagccttgctaatcactaataaacctatttacactgaagtgtaaatatgtacctagatgtagaaatgttatttttaccacacatacatgagtacactcatcccacttattaaaatattaaactacttctctcagttgattaataatcaaacctgccacgggctcctcaccattgtggctacctcaacctgtggattcccagactcttctaaaccagtgactgaggggttcatctttggcccatcttggacctctaagacactctccagcctatagctatattcatttggattggtcagttcccaagccaaactagttgttaatattttttatatcacctttatttaactcaaaggatttatattttgatggtgtcatttaagacacagtgtgacaaacttaggggtaaagtgagctaaaatgataggataattgagcttccattcctatgcaagaattgatgactttagtttcatagaaaagctggaaaatacttaaattttcctccagaaagccattttttttctgggaagaaacatatactcttataacgaacattaatgaacattatttaggaaattcacatcagagaaaaatttttattaaaaaaacagctgttccattaagagaatacttcagtaatactttttccaccattaccaccaccttaccccctcttaggatacttagaggatagaaggctcttaatacatactgacgggtaatttgatgttttggaagatcctatctcattgattctttggcagaagaaacagttgcaatgaaagagaaatgcaagtttggaatgacatccacaatccccagtgggcatgtctggagaaacacatggaatcctgtctcctgtagtttggctacagtcaaaatgaaggaatgcctgagaggaaaactcatatacctaatgggagattccacgatccgccagtggatggaatacttcaaagccagtatcaacagtatgcctcagtctaagctataattcttacccctttcagaaacttcttttccatttcaaaggggagaagggaatatgggaaattcctctttttttcatattcttcaatcacaacacaccaaaatttttcacaaggcattgttatccttcctttaaaaaaacaatacagctatctaactggaaggaaagcagtgtagaaaaaggtttattacatccctatctctgcagaattcacacttcagtatgtacccagtaggctccaaaaactattgatggaaccaaagataatgtaagatattaaattgtccagcttctagaaccagcaaaatgattaagggtatgattctagaaccagacaacctgggttcaaaacctgacttctctacctcctatctgggtgactttgaacaagttacataaccattccatccctcagttttctcatctgtcaactgaagatgaaaagagtttctacctagtaaaatgaggtaatgcatacagtgcatttagaatattgtttcttacataacttctctttggtgtaaggtatcattactgtcatcattacctaagagaacagatgtcagaagtgaggtagactttgcatcaggtagacacaagtaaagcatgggcttggggtctaacagatctaggctatgctacttagaaacaatgactttgggcatgttatttattttccctgcctggtgtttctcaccaatcaaccaggaataataatagtgatatagtttgactgattgtcccctccaaatctcatgttgaaacatgatctccaacactggaggtgggacctagtgggaagtgtttgggtcacggaggtggatctctcatgactggcttggtgccctccccatggtaatgagtgagttctcgctctgtcagttcatgtgagaactggttgtttaaaagagcctggcatctctcttgctccctctctcaccatgtgacacactggctccccttcccttccgccatgactaaaagcttcccggcctcaccagatgctgaacagatgccgatgccatgcttgtacagcctgcaagaaccatcagccaaataagcctcctttccttataaattacccagcctcaggtattcctttatagcaatgcaaacagactaatacaagtacaagtctgtatagaagattaaatgaagtaatggatataaagtgtttaacacattgcaaggcatagtggcacacagaaagtgcccaaaaaaacaacagccattgcaattgttatcattacttaatttaagggtcagggataaaacccagttgctaaaatcctagttcagttgctctatttactaaaccaagagcgcaccagtaatagctcagaatttgctagtagaccttagccatctcacctacaaaaccattattgtctacccctctatgaccccggatcctggctctcatcactgagagaattgcagtagctgtggctccatcctggccttcctaaaatgaggccactcatgatctcaaacttagaaggaaagttgatccaatgaaagtgggaaaattggtagggccttagttctaagttataagaaaaattctcaatggaaggaagagctttaaattgtgatctctggtaaatgactaaactcctagggaaacctcaattacctcatctacaaaattcagggtctagtaacagcctttagcatcacattctgtaacagtgattctcttgggtcatataaaggactgagttatggagttacctaccctcttcgactcatcttttaatttgtcatagaaaaacaactgttgtacattgtgttaaaagttaaattctatggccagagtgtgatttggaaaagaaaactgaagtaagttggaagcagagtgaagaaaataactctgccattttcttccaactcaccctacagcatctctgttttccagcctcactgggttaagtcttcaaatgtagccctttgcttctaagacaatcccatgttacaaagcatcaataatcctcctctgaacattttcctcaaaagttctaactacaaagcagttagccctgatgttctgataaaagtctaattaatgtgatgaaaatggaagaacttcattttattctattcatgtgtcaattaaatatacatgagaggatccttgaggtgaatggatagatcagtccaaataaatgctttgtatatcgtaaagggttccacaaatgactagtaatacttattattatagatatggcacttaatattatcccaagcatatgtgaaggaaacacagaagtacagaatataatttcagtcttgagggaatttaaagagtggctggggaaatagggtttacttgttttttatgtaaagaccaattagtaccttcctctagcctcaaatgagcttagtctacaatcaacaaaatgtacaaaaataatatctacaaaactgaccacataatcctccaaggaagttacctcactacctttccatccccactccattagattccacatgattctataaggtggcgtgcacgtaatctttcacatttacataacacttttttaatttttaagttttttatttcaataggtttttggggaaccggtggtgtttggttacatggataagttctttagtggtgatttctgagattttgatgcacccatcgcccgagcagtgtacactgtgcccaatgtatagtcttttatccctcgccaacgctgaccctttcctccgagtcctcaaagtccactgtatcattcttaagcctttgcgtcctcatagcttagttcccacatatgagtgagaacatacgatgcttggttttccattcctgagttacttcacttagaataatagcctcccattccatccaggttgctgcacatgccattctttcattccttttcatggctgagtagtattccacagtgtgtgtgtataacattttatatatatatatatatatgacacatatatatttatgacattatatatatataactttatatatatgtgtatatatataactttatatatatatgtatatatataactttatatatatatatgtatatatatataactttatatatatatatgtatatatatatatatataactttatatatatatatgtatatatatatatataaacatcttctttatccactcattgattaatgggcatttgggctggttccttatttttgcaattgcaaattgtgctgctagaaacatgtgtgtacaagtatttttttcgtataatgacttttcttcctctgggtagataccaagaagcaggattgctggatcaaatggtagatctgtttttagttctttaaggaatctccacattgtttttcttagtggttacactagtttacattcccaccaacagtgtaaaagtgttccctttttactgcatccacaccaacattattgattttttttgaatatggcctttcttacaggactgaggtggtatcacattgtggttttgatttgcatttccctgatagtgatattgagcatttttccatatgtttgttcaccatctgtatatcttctttggagaattgtctattcatgtctatagcccactttttgatgggactttttttttcttgctgatttctttgagttctttgtagattctggatatgagccctttgttgactgtataaattgtgaaggttttctcccactctgtgagttgtctgttaactctgctgattatatctttagctatgcagaagtttttagtttaattaagtcccatccatttatgtttgtttttgttgcatttgcttttgggtccttggtcataaagtttttgcctaagccagtgtctagaagggtttttctaatgttatcttctagaatcttcatggcttcaggtcttaaatttaagtctttgatccatctggagttgatttttgtataaggtaagagatgaggatccactttcattcttttatatgtggcttgccaattatcccagcaccatttgttgaacagggtgttcttcccctactttatgtttttgtttgctttgtcaaagatcagttggctgtaagtattgggctttatttctgggttctgtattctgttccattggtctatgtgcctatttttatgccagtaccatgctgtttcagtgactatggccttatagtatagtttgaagtccagtaatgttatgcctccagatttgttctttttgcttagtcttactttgtctatgtgggctcttttttggttccatatgaattttagaattgttttttctagttctgtgaagaatgatggtggtattttgaagaaaattgcattgaatttgtagattgcttttgacagtactgtcattttcacaatatttattctacccatccatgagcatgtgatgtgtttccatttattcatgtcatctataatttctttgggcggtgttttgtagttttccttgtagaggtctttgacatccttggctaggtattcttaaggtttttattttattttattttattttacagctattgtgaaaggagttgagctcttgatttgattctcggcttggttgctgttggtgtatagcagagctactgatttgtgtatattaattttgtatcctaaaactttgctgaattcatttaccagttctgggagctttttggataagtctttagggttttctaggtatactatcatatcatgagccacagcaacagtttgacttcctctttaccaattcggatgtcctttatttcttccttttgtctgattgctttagctaggacttccagtactatgttgaagataggtggtgagaatgggcattcttgtcttgttccagttctcagagggaatgctttcaacttttccccattcagtattatgttggctaggggtttgttgtagatggcttctattaccttaaggtatgtcccttctatgttgattttgctgagggttttaatcctaatggatgctggattttctcaaatgctttttctgtgtctgctgagacgatgatgtgatttttgtttttaattctatttatatggtgtatcacatttattgacttacgtatgttaagccatccctgcgtccctggtatgaaacccacttgatcatggtggattatctttttgatatgccattggatttggttagctagtattttggtgaggattttagcatctatgttcataagggatgttactggtctgtagttttcttttttgttgtgtccttccctggttgaggtattaggatgatactggctttatagaattatttagggaggattccctctttctctgtcttttggaatagtgtgaataggatttgtttgaatttttctttgaatgtctgacagaaatcagctgtgaatctatcctgaactttttgtgttggcaattttttaactatcatttcaatctcactgtttgttactggtctgttcagagattctatatcttcctggtttaatctaggagggttgtatatttccaggaatttatcccctctaggttttctagtttatgtgcttaaaggtgttcacagtagccttgaataatctttcatatttctgtggtatcagttgtaatatctcctgttttatttctaattgagcttatttggatcttctctcttcttagttaatcttgctaatggtttatcaattttatttatcttttcaaagaaccagctttttgtttcatttatttttgtattacttttgtttcagtttcatttacttctgctctgatcttcattatttttttttctgccaggtttgggtttggattattcttgtttctccagttccatgagctatgacattagtttatctatttgtgccctctcagacttttatgtaggcatttaagtctatgaactttcctcttaacatcacttttgctgtatcccagaggttttgatagcttgtatcactattatggttcagttcaaagaattttttaatttccatcttgattttattgttgactcaatgatcattcaagagcaggttatttaatttccatgtatttgcatggttttgagggttccttttggagctgatttccaattttattccactgtggtctgagagagtacttgatataattttgattttcttaaatttactgagacttgttttgtggcctatcatatgctctatcttggagaatgttccatgtgctgataaatagaatgtatattcttcactttttgggtagaatgttctgtaaatatctgttaagttcatttgttttagggtatagtttaagtccattatttctttgttgactttctgtcttgatgaccagtctagcgctgtcagtggagtgttaaagttccccactattgtattgccatctctcattttttttggtctattagtaatgttttgtaaatttgggagctccagtgttagatgcatatatatttagaattgtggtattttcctgttgaatgttattttatcattatataatgtccctctttgtctttttaaactgctgttgctttaaagtttgttttgtctgatataagaattgctactcctgcttgcttttggtgcccatttgcatggaatatctttttccacccctttaccttaagtttatgtgagttcttatgtgttattaaataggtgactttcctgaagacagcagaaacttggctggtgaattcttacccattcttccattctgtacgttttaagtagagcattcaggtcatttacattcaatattagcattgagatataagatactattctattcattgtgctacttgttgcctaaataccttgtttttcttttcattgcattatttcatgtaggtcctttgagaattatgctttaaggaggttctattttggtgtgctttgataacttgcttcaagatttagagctccttttagtagttattgtagtgcttgctggtactggcaaattctgtcagcatttgtctcgaaaagactatcttttcttcatttacgaagcttagttttgctggatacaaaattcttgactgataatttttttgtttaaggaggctaaaatagaaccccaatcccttctagcttgtagggtttctgctgagaaatcagctgttaatctgataagttttcttttataggttacctgatacctttgcctcacagctcttaagattttttccttcatcttgactttagataatctgattactatgtgcctaggcaatgatctttctgtgatgaatttcccaggtgttctttgagctgcttgtatttggatgtctagatctctagcaaggccagggaaattttcttcgattagtccctcaaatatgttttccagacttttaaatttctcttcttccttgggaataccaattattcttaggttggggcatttagcatactcccaaacttcttggtggctttgttcattttttaaaatcctttttgtctttgatggattgagttaattctaaagccttgtcttctagctctgaggttcttttttctgcttgttcaattctattgctgagaatttccagtgcattttgcatttctctaagtgtatccttgatttccagaaattgtgattgttttttatttatactatctatttcactgaagaattttcctttcatattctgtatcatgtttttaatttaagttggacttcacctttctctggtgcctccttgattagcttaataatcaaccttctaaattatttttcctgcaattcagagatttcttcttggtttagatccattggtggtgaactggtatggtcttttgcaggagttaaagaatcttgttttgtcatattaccagaattggttttggggtttcttctcattttggtagacatgtcagagggaagatctgggattcaagggctgctattcagattcttttgtcccacagggtgctcccttgatgtggtttaatcccccttcccctaggaatggggcttcctgagtctcgcaacccagtggagctactgggctctgggctggtactggagagtgtctgcaaagaatcccataggatgtgacccatcttcaggtcttgcagccttgaataccagcacctgctccagtggagttagcaggggagtgaagtggactctgtgagggtctttggttgtgtttttgtttagtgtgctggttttgtgttcgttggcctccagccagcaggtggcactttcaagagcacatcagctgctgtcctacaggcaggatggaaacttgccctagggacacagtttttcagcatctcagagagcctgcagtggtgatcctgttccttcaaagggtctatggattcttctgactttcctggtatgttcctgtggcagttcttggagcagaagttcatgatgtgagtctccacaggctgctctgtttgtctgagtgagagctgcaagctagtcctgcctcctatccaccatcttaatccaagatgctacgtaacacttttgactgttcaaataattttcaaaaacatcccctcatctaaacctataataaattagacatgattagcttatttaattataccaatcaaatctcttccatctttatatctactcaatcttggtaactatatcctccttttattttgggattgcctatttgttatcagcactgaagtcagtggatctgcatgaatctggaaaattgcaacaccagcttgctgtggatttggataggaacatcaacatccagtggcaaaaatattgttatcccttgataggatcaatgacctattcagtcaaagagatggagtacctcacccgggccattgacagaactggaggagaaaaaaatactgtcattgttatttccctgggccagcatttcagaccctttcccattgatgtttttatccgaagggccctcaatgtccacaaagccattcagcatcttcttctgagaagcccagacactatggttatcatcaaaacagaaaacatcagggagatgtacaatgatgcagaaagatttagtgactttcatggttacattcaatatctcatcataaaggacattttccaggatctcagtgtgagtatcattgatgcctgggatataacaattgcatatggcacaaataatgtacacccacctcaacatgtagtcggaaatcagattaatatattattaaactatatttgttaaataacacaaaagtctgaaattcattcacttaagtaaaaaaatttattgactgtctactagcaggccagatgctgtgtttggctctgaattcccaactagcaagagcagagaatctacattatggctgatccataagccaccaattcagctaaatgagatgtttctaatctgggcttccacttaaaaataaaactaaaaatactcatgaaaagagcctacccttcttgatcagagccatacccctcttcaccaatgggaagtcaagacacctatgggtaaaagttctctctgatgcatgaaaactcagagtgataaagtaattttaaaataaaaatttggagaaagca

SEQ ID NO: 563 - DNA, 19968 bp, Homo sapiens
tgttatcatagtccataaaatcggtctttttagttgccacaattataagaagttgcatacaattacaagagtaaaacagaattataagacagcacgttaggtttaagatttatggccgggtgcggcggctcacgcactttgggagcccgaggcgggcggatcgcactttgagagaccaggagagcgggacccagtctctacaaaataaaaataaaaataaaatgtggggagagcgtgacgttttccaggtacagaggggaggtccaggcagaagcgcaggtagaaagtgtgaatatgctgagcgtattccgggagcagcaagttaagccggtgtgaccggagggaaatggaggcctggctgccggacggtgagggtgactgcgcgagcgtccgcccaagaagtctccctgccttcccgcctttcccctgtcttgggccccttcttgctttcctttcgcgctctgtgctgactccgcccctccggcggcgcccgtggccccgcccctgagggaaacagacaaggggcggggccggcgcggtcatctctctgcgccttcccgcagggcgccgagcacctggcgccgcctgcctgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgggggttgaaggcccagaagccggactctgtgacccgggtcggggggtgtactggaggggcggctacgtccaggctgggtgagaagagaggcagtggggcccaggaggctggaggaagccttagggttcagactggggtgcacgtagtcgagagctcagggtttgggcaaggggatacctgccggggttcagccttgagggtgggtttaccgggttcacgaatctctctctctccttacccccgcccgcccgcccgcctgcctgctcccggtgacttctgctggccgcaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacggtaggagcccgtctcctgagaccgcggtcactgcagactaatgggcctgaggtctgggctgctttcggtggagactgtgggacagggtaacggagagaagtgctttagggtttcacttttttggaagcttgttgaaaaagcagtcgtcgggctgggcgcggtggctcacgcctgtaatcccagcactttgggaggccgaggcgggcggatcacctgaggtcaggagttcaagaccagcctggccaacgttcaaccagatgtcaacatggtgaaaccccatctctactaaaaatacaaaaattagccgggcgtggtggcgcggcctgtagtcccagctactggggaggctgaggcacgagaatcgcttgaacctggtaggcggaggccgcagtgagctgaggttgcgccactgcactccagcctgggtgacagagtgggactctgtctcaaaaaaaaaaaaaaaaaaaaagcagtcgtggttttctctactctttcgcctgtactcacaagaaagtatatttcaaaaagactgtttaactttcacttttagttctggccacaatagtgctatgtgggtattaaaggcacttgcttagtgttgggtgaggtgtgtaataagtagaggaagagtccaaaagagggcaaaaagaataatcttgtagggattaaaagtcttgaggcttatgtattaaatcatatattagaatttgaagacaacttggcaactatcaagacaacttggcaactatctcattcaagtttttttttctttttatccctcctatgaggaaaccaagattcaaaaagatggtataactttcctgaggctgtcacagattaagtggcaaggttgggcctggtcacctggtccagtggactttctacggcatagggctaggagcacgcttaatgcaattgaagctgaatgtggctggcagcctgtacagctgaaatgagtagttcttgcagatttgtcaattcatttgagcaaaggatctagggctggttcaaactactaccatctttgtgcaagaggagtgttttttttcttttcttttcttttttcttttcttttcttttttttgagatggagtctcgctctgttgcccaggctggagtgcagtggcatgatcttggctcactgcaacctccgcctccctgggttcaagtgattctcgtgcctcagcctcccgagtagctgggatcacaggtgcgtgccaccatgcccagctaatttttgtatttttagtaaagatggggtttccccatgttggccaggctggtctccaactcctggcctcggcctcctaaagtgctgggattacaggcgtgagccaccacacctggccaagaggagcgtttacattatctcactcccatgctaattggaaatgagtgttttctctgattgccaatgttagatggtttggaaaagttagttttggagtcttcaaagagctatcagcttagattgcaaatgattgtcagcattttataatcttgtggtaatctagtattggagtgtgcttccttcccttgtattttgtttgtaattgcttcgcagtagtgtttcttctgagattagaagaaagtggccacattgccagggatctttcttgcactacattcttgagcattattggatgtatgttgtggcctggcctagttttttaccagatttcctttaagaagggatttatgcttgccgtattgtagggtcctgcctctctggtttcttttttgtttttgcattttccagttcagttaccataggtggctgtcactttgctagcatttcactgctggaatttactctgagatctagggttgggtcagcagggcttagtgacggtgtctttctgaggcagtttggatgggctttttctggtgtaccttttctcttaataactgccccctttctcctagtccttctctgatatactaaatgaagttctgggagaaactccaagttttccctactattatttgtgaagtgagagatcagaatttgagggagctcagttttagttttagttttgctatgtggttggtattgactccttggtattgggcactatatggtgaggtgaaggtttttgtttttttttaactctagcaggacagctgtcctccttcaggttccacacttgggcaagcatgttacattatctatcgtggtgtgcagcattcctgaagggccctggtatggaaggttcttggagcagagggctctcgtttagagatccctgggtagtttcttgagacttgttaccatgacctggctgtgaacgtgtgctatctgagcgtcactgggccttctcttccaatggaaagcaggtattcttgaattctgggtgtgagatctcttccccaccatattcctgtgtgtcactggctcccattcgtttcccccttcagtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccggtgagtaatgcggcttcttctcctgctttatccctcccctgcagcttttcagctggggtgtgttctggccttcgctgtctgtctctaaagaataaaccagttctatagcttctagcctaatctgggttgaagctgtacatttggtacctcgccttgcacatgctccttgctgcttctggactctcatggttgatctgttgtagcagctgaagcgctctgtttgcctaacctagtctgtctgtgcgggctgggcccaggaagctgccctgcttgccctcctgagggttagagacttaggattttctctgcttttagccctttaatgaggagcagtagtaagaggcaccccatggtgagcagaaagacaagctggatgggacctaatggtacccttcgggatggggcctgctttccagatgccacatggaagagaaccagagagtggctcggcggcgaaggtttccgtttgtccgggagaggagtgactccactggctccagctctgtctacttcacggcctcctcgggagccacgttcacagatgctgagagtgaaggggggtgagttgtctctcttggaggcagttatggctacagccaggttgtgttttgtaaaagtattatcaatggaaaattcaaaccaagctgctgcaaatgatttttggaacaggtaagagtataataaatacagaagagttgaaacaaaaaacccatccaatttatgtcattcagacaaatgtagatgttaatagcagttattgcttgcatctgttatcttagtttattacatagttatgatatattatttgggcatttttctgtgttatcacaaggacttgataagcattgtttgactttgttcctttccttgggtggctgagctggtatacggagatgtctaagcacgaagcatgctcctccctgggagtcaccctcttcccacaggggagccttgcctgtgatcctttgcatttttacaggtgggaggtggatgtcctgagttctcagtggcccaggagggctgacgataggcctttctgtgaggcggggcagctggcaggagtctggtggacagcctcctccaagtctggtcatgctaagggtgttttgagtttaaaccactagcaccactttgaaactctggtcccaaggatagagtgtgatgtcagtagcagcatctgacccatctgaccttatctgctgctagctccagttattcaggtagcctgtgtgaggcctagaggccgatttctccttgtccagcctttattcttcttaagggaaagactggtgtagagaacagccaagttttatgctggatcagaggaattagctataagcaggtacatggaaactagaagttaaaatcagtccaggtgtggtggtggctcatgggtaatcccagcactttgggaggccgagacaggaggattgcttgagttcaggagcttgagaccatcctggacaaggcagcaagaccacgtctctacataaaataactacctgggggaggccaaggtgggcggatcacctgagttcaggagtttgagaccagtctggccaacatgtcgaaaccctgtctctactaaaaatacaaaaattagccaggtgtggtggtgcatgcctgtaatcccagctaatcgggaggctgaggcaggagaattgctggaacccaggaggcagaggtttcagtgagccgagattgcgccactgcactccagcctgtgagacagagtgagactccatctcaaagaaaaaaaaaaaaaaaaaaaaaaacgagctgggcatggtggcatgggtcggtagtcccagctacttgggaggccgggagtttgaggatgcagtgagccataattgtgccactgcactccagcctgggtgacagagtgagaccctgcctcagaaaaataaaatacaatgtaaatactaggtgataggaatttttcagctccattataatcgtatgcacccactgatatgcgcagtccgtggttgactgaaatgtcattatcaccaacgctggatttgatgagtgctccggggtctccagaaacctgtggagtggtggtgaagagctctctgctcttccatgggggactgctgttgcctgggttgtcagatccctgttatctgcattctcaagggcaaacagaggtggcccttttctattcaatttacctaaatggctctgggccaagagatgcttccagaagttgtgttaaagagggggcaaaaatgaaattaatatttgatacatctgaattgaagagagagaccgaggaagtagttgatagtgggcactgagatgtaaagaacatctctgcaacccaaggaagcaggccacttgggtggggaattgatgtttgaactctgtaaggaggttgaacagaaggagaggtcacagctctgcccaaaatcaaagaaagcttgaggcccttcacaactgtttttgtttttgttttgttttgttttgagacagggtctcactctgttgcccaggctggagttccatggtgccatcacagcacagcagcctcaacctcttgggctcaagtggtgctcctgcctcagccttctgaatagctgggactacaggcatgtgccaccatgcccagccaattctatttattttttttgtacagatggggtctcactgtgttgcccagcctgttcttgaactcttggcctcaagcagttctcccacatcagcctccaagtgctgagattacaggtatgaaccaccgcacctggtcctctttgtgatgatttaaagaagttgtactaggccaggcgcggtggctcaggcctgtaatcccagcacgttgggaggccaaggcaggtagatcacctgagatcaggagttcaagaccagatggccaacatggtgaaacctcgtctctactaaaaatacaaaaattagccaggcatgttggcaggcaccggtaatcccagctacctaggaggcggaggcagaagaatcacttgaacccaggaggtggaggctgtagtgtgccaagatggcaccactgcactccagcctcggtgatagagcagtactctgtctcaaaaaaaaaaaaaattactgaggctggggtgtggaggctcatgcctataatcccagcactttgggaggctgaggtgggcagatcacttgaggtcaggagttcgagaccagcccggccaacatggtgaaaccctgtctctactaaaaatagaaaaattagctgggcgtggtggtgcatgcctgtaatcccagctattccggaggctgaggcaggagaatcacttgaacccagggggtggagtttgctgtgagccgagattgcaccactgcactccagcctgggtgacagagaaagactccatcccaaaaaaataaagaagtacaaacttctggggtcagtgggagccagagcagttaaccagggacacctgggggtccttcactgctaggggtgctcactgggactcccaaggccacaaggagcaggccagggctgccagacacctgtgatggggcaaggggaagagtggatttcttaattatagcgccttcaggctgtgtcccatgcccagtcccgtggcatgagagcaggtggtggtgcaacactgtgtggttgagccggctgttctctagggcagtggccgtggtgaatgattctttgtgccatggtcattgccatgtaggtcaaggggggagctctaggagtctacaaactctgaaatggctttgaacatgtgtgtcttggggcaaggagagctgctttgagggatgaagggctgagatttgatgggctgcttgatttcactgaaagctgtattccttccttcttccaaataacaactttgaggtctcaggagattgagggtggcagaggcagaatcactgtgcagctctgtgagcttgttccccgggcattgtaccaaacacagcttgagttccctctgtcagaacccaacttgccctaaaataccagctcctccagcaagccttcccaggcatctcagccaagagaaattgcctgcagcctcatcgtgaagactccttcttgggcatttatgacctcattaagttgggtcttatctcaaggtcagggtccatgtgcctggttatctttgaaggcctcatactcagtctctaacatggtttaggttaagagaaacttaattgccaggaggagagatgtgtgtaactgagtccttcattactgcttaagagtagagtggcagtctctgctcagagggagccttgggtctctggcccactgtgggaactcctgtcctccggagtgcacaggaccaaagggccttttcaaaggtccctgctcgtctctggcagatctcaaaagcctcagggtatgttaaaagggtcactcctctctggtagatttctccaaaggctggctgggttagtctgggaggtggaaagtgagagagaatggtgtaaatgtggtagcccttggcatgtgattaatctcttctgaggccccagaagctgcctcaggcagtagggtttcagattgttgagggttccttaaagtggggctgagatgcaattaaagtctactttctatgccagcttccctggagcctccctgcctcacagggctctaccatctttcactctgtttgtggcagcaaggctccctgacctctcttcttggctttgtgagctgggcctttaggatccagagggatggcagcatcgcagctcaggtcccaggggattctgtgctgatgcctgggctccagcagggctaggtccctccctgggagtgctggaggcagagagactcctctttggactcctgattggctgaggcagccctcaactcagcaagaaatagggtctccccctccttctagcaaagggagatgatgcaattccagcttcccgttccagataaaccatctacccattttgcatttgggcctggctgggcagaggagactctggtttgatttttctcaatctggcaggtgcagttgggagtttcattctctaggttgcctgtgggtggtctccctcatcagtacccaggttggttacgaaatctaatgacacttatccttgtccctttgatttctaaaggtgtttttttttttttctaataactaaaggggaaatctacttggataacctcttaaaaaacaaaggtgcagttaggaaaggttttaaataccttacaagttcttgtagtagatgtgtctggggcctcttttttagatgaggctgaagctcctctgtaaggatgcagtcagcacggactgggtaccaggtctggctgctcacttccagagccttcagagcctgccaccttgtggtttctggttttctgggcaggacagcacttctgccctgacattaggctgtcagttgttgactttatttgtaggtggtgtgtcatctctccttcagtcctgttttgctccagccacagggagcctattcttttttttttttttttttgagacggagtcttgctctgtcgcccagggtggagtgcagtggtgtgatctccgctcactgcaagctctgcctcccgggttcacgcccattcttctgcctcagcctcccgagtagctgggactacaggcacctgccaccatgcctggctaattttttgtattttttagtagagacagggtttcaccgtgttagccaggatggtcttgatctcctgacctcctgatccgcccgcctcggcctcccaaagtgctgggattacaggcgtgagccaccgcccccagccttgtgtttgcttctgacccccagaagtcctaccttttcccctgctcagtccttatctattttaggcatttagggaaaacaccctaatcagctgctggtggctgagatccaagagaaactcagcttcctctttagtgggtgcatcagggttggggctccttaggagccacctggcatatggcagccccccaaacaccttttcagggggtagtttgcattgtcttccccttcttgcttctggctgcaaagtggttcctatcacctctcctcacacccttaagttctcaaggttactatgggctactcctgttgcggtttaggtttggttgttgacttgggccagaggttgcgagtttgtggatgtgtgtgtggctgcccatggcctgaggctgcacccacccatgttggttgtggcaagtgtctctgactgataaggcaaaaacgagcagggacttctcacatttgccttaactgtcacagggcctcagctggttgtctgctctttccttcctggatcattttcccagcccttagttcccataggaaactttctctcaaataatgatttctgctgggcatggtggctcatgcctgtaatcccagcactttgggaggccgaggtgggcggatcacttgaggccaggggtttgagaccagtctgggcaacatggcaaaaccccgtctctactaaaaatacaaaaaaattaggtgggagaattgcttgaccccaggaggtggaggtttgagtgagccaagatcgaaccactgcactccagtctgggtgacagagcgggaccctgtctcaaaaaaaaaaaaaaaaaagaaaaaaagtctgcccttaagaggtatgaatgattgtgatttggtgctttggacaatgccatgtagagtgcttctttgggggtgagggatagacagaccctaggggctctgagctgaataatcctcttgttgtcccttacatttctctgccagttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtggtgaggctccagctgcctgtctccttctccttccctccctccctccatctctctgttcctgacccctggggaatgaaggcccgtgtggttactgcccctacaaggtgacatgggacgagaaatggtgagacagctggttttgcatctgtcccccaggtcacatatcctcttccaaggaggcccagcgtggatcctagggccagtgtactgcttgccccagagctgcctcccctcttgggagggggagtgtagttctctgctttctgtagagctactgcagaaagagctctacctctcacctctagggggaaatgtggaaagaactgtattttttttttctcctcatttcccttgaggcagagtccaagctgccagccccattacaagcgacaactgtgtaggtcactcaaccataattctcttgtcaggttcactgacagaatatatgcccacccaggtataaatgccccccccccagaagttagaagtttcccttttcctttcacactttcttcatgtgtcagcaaaagacctctcgtgccttatgacatcttggagttgacctttcctcccagcagttctaggaggtcagaatgccctcaccccgtaattgtgcaagctactggctagacagagaatgtgtcatacattaactgcacgtgggaagggatgactggggggaaggctgcgtgtaggagctggcctgatattgatgactgtaacatactagcttggaaattcaaacctagggtgtgggggaaggccaaggcccccattctccacagttgaggaaaaaggggcctcacccgtttctgtctggtctgcagtatggaagccggcaggactttctctggcgcctggcccgagcctacagtgacatgtgtgagctcactgaggaggtgagcgagaagaagtcatatgccctagatggtaagtgctgacagcttcctgtgggaaggtgactgactgattcaggggtggggctggcccatctgcctggggacccggggaaccaccaagatgctgtcagcagttgtggctcagttacccactagggacaaactctggctcccaaagacccttgctttctcctctggaagaagagagcagtctttgcttatctgtatatcatgctgattagtaacacacgtgcatgtgtttctaggagtagttgtatcctatcaatgttattcgtttttctcactctagccacagagggcaaaaccttttttcttaacctgaggttttttgctgctgcttagaaatctggtttcagttttctgagctggtggggcaggtgttctaagaatatagctagcttagaagactctggaatccacttggcaagtctgttggcaaaggctccaccctggaggatagggtgcatctgacctgtgccaggctcagggcttggccttatctgtcatgaggtcagagaatgcttggactttagagactgatgtgtcctgctgaactccacacactgagtcaggtaccatcaatgggtaatgggtttctaggtctgtggttcagttaatatctattttttttttttttttaaacagtctttctctgttgcccaggctggagttcagtggcctgatctcggctgactgcaacctccacctcctgggctcaagcaattctcctgcctcagcctccccagtagctgggattacaagcacatgccatcatacccgactaagtcttgtatttttagcagagatggggtttcgccatgttggctaggctggtcttgaactcctggcctcaactgattcacccacctaggcctcccaaagtgctgggataacaggcataaaccactgtgcctggccagttaactgtctaaaatggatttgtctacctttctattgtaagtacagccttacaaatattattgaatccttgataatgtatactcaaacagtacctcaaagttaacattctaaacatttgtagaattctgtcaatggagaaagaacagaccaattgagtaggatgtctctgtagaccctcagaaaaattcctggaagttttaacaaaagatgcttatttatgattactttttctctccaaaagtttgttttccctcctaaatttcagatgaggattctcagcttttgggctgatttttggactcttcatgtcaacaacctttcctttccctcttgatcattggtcatctcttattagtgctagtagccagcatgaaccccaaagacagaagtggaggcagtggttagcagggcagcacttggttggtctggcctcctgagcttagcacccatggacaaagctttacctgctggaggtcagatgactatggaatgtctttgaaggttctgctctgagatcacagcctttaagaattatccttactgggtataaagtttatttcattgtatctctaggagctggaccaccaggaggcagtcattctgtggggtctcaggcaatgtcttgtctacaacactgtctgtctagcttggcaggaactagttgtctcattctttgctattattttcctagtgagacagtactttgaagagggcagagagaaatccccaaagaggcagcgtccctcattggtggggccatgtggtccctctctttgggaagagaggtagagtctttcacagcatcagttgtcttaagaatgcatttgtggccaggtgtggtggctcatgcctataatcctagcactttgggaggccaaggcaggaggattgcttgagcccaggagttagagactagcctgggcaatatagtgagaccttgtctctacaaaaaaaaaaaaaaaaacttaaaaaattagccaggcatggtggtggaacatgccagcaggaggattgtttcagcccaggaggcagaggttgtagtgaactgagattgcaccactgcactccagcctgggcaacagagagagaccctgtctcaaataaaaaaaggaaaacatttcagattagccagtttaccacctcaatgcattacatttgttccattttctccatgttcccttccaaacttgttttcttcaaagaattcttggctgggcacggtggttcgcacctgtaatcacagcactttgggaggctgaggtgggcgcatcacctgaggtcaggagtttgagaccagcctggccaacaaggcaaaactgtctctactaaaaatacaaaaattagccaggtgtggtggcacacacctgtaatcccagctactcgggaggctgacgcaggagaatcacttgaacctggaggcggaggttgcggtgagcctagatcgtgctattgcactccagcctggacgacagagtgagactcttgtctcaaaaaaaaaaaaaaaaaaaaaaaaaatcctatgttgcagtgtcttctccagtgcataggcatgatggtccttatctggtggtccgtaagctccagcctcgatactcttaagtgacgcttgtcagaactttcatgtttatgggctttcatttctttgttagaacactaacctagaaaactcgggtaagactaagtgaacgtcatctctggtcagacctcagtccatgtggctcttgtgaaagagttttggcctagagctaattaatattgttggatcgtggatccttttgagaatttttttttttaaagagatggggtctgcctatgttgcccagattggtcttgaactcttggtcccaagctatcctctccttggcctctcaaagttctaggattacaggtgtgagccaatgtacccatcccctttagggaattttttcaaagctgtgatctctctccccacttacttaaattttatacaacttgagattcatggacactgcccctccagagtaaggtctgttggggacaatttctgattgtgttggatccgttgttgttgttttttttgaggtggagttcgtcgcccaggctggagtgcagtggtgcaatcttggctcgttgcaacttctgcctcccaggttcaagtgattctcctgcctcagcctcctggggagctgggactacaggatgtgccaacatgcctggctaattttatatttttagtagaggcagggtttcaccatgttgctcaggcttgtctcaaacacttggcctcaagtgatccacccacctcggccttccaaagtgctaggattacaggcataagccatcgtgcctggctggatccttttatattttaaatgctaaaatctgcttcaagcacatcaggtgggcattataaaaagaaggtaactggggtttctaatgacagatggggaagccaaggtgaagcagaagtcatccctgaagtcttcccttagaagccgtttgcagccttttctgagacagtcttgctctgtcacctagtctggagtgcagtggtgcaatctcggctcactgcaacctctgcctcctgggttcaagcgattctcctgcctcagccttttgagtagctgggactacaggcgcctgccaccacgcccagctaatttttgtatttttggtagagatggggtttcactgtgttggccaggctggtctccgactcctgacctcaggcgctctacccgcctcagcctcccaaagtgctgggattacacagcacagaggcgtgagccactgtgactggcttctttgcggcctttcattctgctcaagttcacaactatttccaaacaagtccaagctgggtagggattggtgagagctaaagcagtcattcttcccacaagccttcctatgaaagtgtgcataagagctatgtcaactctggatctaccttcgtcctacaggaaaagaagaagcagaggctgctctggagaagggggatgagagtgctgactgtcacctgtggtaataacaccctgcagtgttctgggaagagccagcaagggccaaagcagaggacagccctttcttttctctgcctgggccacagaggcattttccaaaggatccaggagagggagttctggcttgtatctccacatgcctcagtctacccctagccagagacaagggaagtttctggtaggggaggtggcttagggatgaggcaagcggggaatacaagctttttttctgatggggcttggagaaatgagtagctttgttaagagtcatcctagctacaaaactggagttcttggctctcaggaggctgggacaatctgcagctcccctatcctgcataagctcttctttcccctgcgtgtgatccctggctgctggtactttggcttctttgcttggttcatgtgaggaaaagtagatgtgagctcaccccccagaagtttagtggtcaatttattaggctgcaaaaacatcagccctttttgtggtctcatgtgaggcaaagttctgtcagcttacctgggccacggctaactcatatcctggggtctggttccagcacctgagttttagtgaaaatgttcctttcctttcccaccgccacccttgctttccatgtctccaccctcagactgtgagctaagtgagaggctgtgtttctccatctgttgctgaaacttttgtctctgcaagggttcttctcagaggccaggtaactgtttcttgggtgtcactgcttccctgggcttccaaggatgaacagctattcctgaggaacagctgtttggattaaacatggaaatgagcctctagaagtatctgataccccccggatacttagcatatacatgaaaaagcaacttgggctggttactcatcgaatgtcaactgtgctgctaggaacaatgctggggggatggggaagtaagactttgtttctgaagacagatgatgggaagctggctggctggttccctttgggaggggggatgtgggggagaaggcatatataggaggtctttcttcctctggttctgttggtttccaagtaacatcagaaattcctagaatatcccctcccaatgtgactatcctaagaaattgcttcccaagtcccagtgatacacctgtatgcttaaaggctaatgagacccacttttttgtctgcccagaagataagtagtatagtcaggtctcatacttttatgctgattgttttcatgcttttcaagtttttattaatgcctgtggctgtactccttatgagtgtaggagagatttactgtgtaagagagatttactgtggtgaacccagctttttttatacctagaatactttggagacttgtaagcctaccattatctactaaagaatactaattggggccagaggtccgtaaagaatggggattacgtacagatgaaaattaggtattttcagctctagttgagggtacagggataggggacaatgcaactaggctgtggttggggcatccattccttgcagtgatggtactcagcccttgtccctgagcttgctgcttcccccctaggtatgcggtgctttgtggtcagctggctgagcatgagagcatccagaggcgcatccagagtggctttagcttcaaggtgaggacaggcttttcctccttccttgtgctggcctatcccagattccccactcctttccagctccctgccaaaaacttttctacagcctcagtgacttgcctttcttctttttttttgagacagagtctcactctatcgcccaagctggagtgcagtggtgtgatcttggctcactgcaacctcctgggttcaagcgattctcctgcctcagcctcccaagtagctgggattacaggcatgtaccaccatgcccggctaatttttgtatctttagcacagatggggtttcaccatgttggccaggactggtttcgaactcctgacctcaggtgatccacctgcctcagcttcccaaagtgcagggattacaggcatgagccactgcatccggcccttgcctctcttttagcaactctggtgtctgatgttagtttatatttacattttccccttaggagcatgtggacaaagccattgctctccagccagaaaaccccatggctcactttcttcttggcaggtggtgctatcaggtaagctgcgtttcagtgcttgacataatggtcctaaatgccttctgacaccgatttccttgccaggaagaacaagatcctcagccttctctggctcaggtgccctttcttctgaatgctcgtattattggtggttcgacccagccccgtttgaccctattttcaatatatccccaaagatttaaagaaaaaaaaccttttaaaacctcttatacacaccttgatctttttgtggcaggtctctcacctgagctggctagaaaaaaaaactgctacagccttgcttgaaagccctctcagtgccactgtggaagatgccctccagagcttcctaaaggtatgagaggggcaggtggcaggcaaaaacaccagggtaaccttgttttttcctaaggacattattgagacccttaatgggaggggttttcctagtcgggggcaattttgtgtttgcctgttctatgggaaaaccagaatcacttgcacagcttatcaaaaatataggtttcttcagacccactgaatcagccacatggttggggactagaaatctagtttaataaacttcagcctgattagaatataggaacctcttactgaaatatctttgtcccttttcccaggctgaagaactacagccaggattttccaaagcaggaagggtatatatttccaaggtaaactcatttgtctacttcaacatagatctgggaactcctgaaagtacacagtatcaggtttcactgttgtctcttttcagtgctacagagaactagggaaaaactctgaagctagatggtggatgaagttggccctggagctgccagatgtcacgaaggaggtaaggctttttaatactgcctgttgggcagatcacctgaagtcgggagttcgagacagcctgaccaacatggagaaaccccatctctactaaaattacaaaattagttgggcctagtggcgcacgcctataattccagctactcgggaagctgaggctggagaatcgcttgaatccgggaggtggaggttgcagtgagctcagatcgtgccattgcactccagcctcggcaacaagagcaaaactccatctcaaaaaaaaaccaaacaaaactgcctgtcatcactgaatcatcatgtgacatttttagaaaataatctttcctagaggtcttatttccctagtaaaaaagagtctacctctaggggaagagacagatttaataggctccaggctatcctggggaagtaggaaaaagactgtagcagagctcaggaaggaagcaaagggcccctcttcttaggttccactggtttgggaaaatgctggtttaaattttgagccctagatttgttctttgtctccctaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgttatca

SEQ ID NO: 564 - DNA, 285360 bp, Homo sapiens
aagccgggccggtgacgccgggcctttacgtcgcgcctgtgagcggccgaggccgagcggcctcccctcgggctgcgagacgtaagcggcgacccctctcgggcctgggctcttccctcgcgcccggccgccgcgcccgacccagccgcggctggacctgcgcgcgagcgccgccgcgcgacgtctgtgtgcgtgcttgtgcgtgtttatttgcgcggggttcgaaaaacggggtttgggttgcatttcgctccccacagacccagagccgaatttctgaggtatccgggctctggtggactgaggggggcgacgcgccccgcgccgcagcatcctccgagagctcgtcttgccgccagcacctgcctccaaggacgccgcgcagctgccccgagcccgcgcgcccggggcccgcgactgcgtgggcggaagccgggagggtgtcagcacgcgtgggagcgctgggagcatgcgtatgcgggtgcatgtggtcggagggcgcgcgctcgagcgcggccgcggggtttcctggtggctgcgagcggtggggacggcagcgggcctggcgccgctgcccagaagggtgcggtcgccacgaatctgagaggcggctgggtgggggccggcaggtttccagtgcccgcagtgatccccatccgcaagaccccgaagccctttgaaatagacggtcaaagccgcgtggttgctctgcgactgcagcggcgagaccgaacgcccggcccccgttcctattagctcacagcagtcccggccccgcctacggaggattcgcagggcggccgctgggcgcgctttctcggctcggccacagcccgtttctgcaccaaacccgccagccgcggcccaccctgtgcttcacccatacccgcccctgcccagcatcgccaggcctcaaatgcagaatagtctctggcagagttcaaagagggaaagggaagtcctgggaagagtccagtgtggtagggattttacagtcttacttaaccccaagacgaagctatggggcgggtacatacacaccaccgtcccctttataatataaagaagggaaactgcagctaagagaggttaaaaaactcgtgtagggacgcccagctagtgagcgtggagaactgtgatgaatcatattttgttatgtttgcaaactaacacgttagctttcacggtttcatgaatgctgacagaacacaccagacttctgagtcagagataaaagactattacaacaaaagcaatagccagagtatcaccatttttgagttggctccctggaccccagttctcacaggaacgaagcacacgggcccagatgcatgcttacacacaagatgggttgcattacagaagaggaatgctgagcttggggaacccaccatgttatagtgagcagtaagcaagcctgctctttgttccatagggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacagtaagtggcagagccctgattggtgccaggcctatttaattatactctaatgtaaacaaagttttatatatatatatatatatatatatatatatatatatataaaattgttatgcccctttaatgaattaaatgtcttcacattgcatgcagggagaattctcatatggataaaattagcctttaaaatggaatatggttttaaattgtatttatttaaacaaatcttttttgaattctgaaatatgccaggcactggtggcatctcagggtctccactggtcttaggagttgctcacagccgaaatgggagaagagatgctctgtatgcctgtgggaaaaccatacagaggaattctgcctggggtattggagccaaatctcaaatgatgaggagtcattgacgtgattaagtgacagttgagatgcgtatataaaaattctggaaagggggaattgggaaagaaacaatgtgctaaggaaagatgtgtatgtgtttgattccacttaatgattcaaacgaataattttagatattttattccactagatgaagccaaaaaaattcctgtatcatggaaaatattagagatacagtgttagcagacagtgtgggaaagccaggctttccctgtgcagccttctgtgagctatcaaggttgtacttcttataccctgcaattagaagactggggccaggtgcagtgactcacgcctgtaattccagcacttctggaggctgaggcgggaggatcacttgaggccaggagcttgaggttacagtgagctatgatcgcgccactgcactccagcctgggcgacagaatgagaccccatctccaaaagaaaaaaaaaaaaaaaaagaagaaagtcacagccaaacaaggtcaggtgtgtggtggttctctgaacaattaactaagcagtttataggtagcaatgttagcatgtaagaaaaatgaaaagagtatttagttgccatctggggagaaagattcagtgggtgttgtcttccccttatctaatctggctgaattttctcaggctgtatctgtagtaaacagccattatacaacctgagctaagaattcccgcaagtgagaaagcaacctcttcctgccaacagagggagtcaaagcatgggttataaccactttcaattaggctgattgcagcacatctgcagtttgagttcgctggacagcaaagccctaaattaaatacggtttcatgttggtgttttatttttatttttattttgagacagagtctcactctatcacccaggctggagtgcaatggcatgatcttggctcactgcaacctccatttcccgagttgaagcaattctcctgcctcagcctcctaagtagctgggattacaggcacgtgccaccacacccggctaatttttgtatttttaatggagatggggtttcaccatgttgtccaggcaggtcttgaactcctgaccttgtgacctgcctgcttcggcctcccaaagtgaggcgtgagctaccgtgcctggccagcaggattatttttaagttactgtgtggttagtgatttcggccttcccagaagctctggaaatggactatacttctactgtatatatttgcactagctttgctttactccagaggtataaggttgctggagtaccagttttattcaattcaatgagtagggacaatacagttaggcctactgtgggaaccaagtgaaagtttaagacataattcctaccttcaaggacactccaaatttcctaggagaaatacgatttatgaatatgaagcaataagcaaatgaagcaaggtagcatgtgaaaaagtggcataatgtgactgggcattcctaccggtaaaaatttttcagtttggacccccaaggaaccaggatgctctattatactactaataaaacatacctaaaaaggaatttttaaagggtgagatttaaaaaacaaacaaacaaaaactgtggtagtagcagttaagagtacagcctgtggagtcaggaccctgtcattcaaatcttggttcagcctttatttgcaggacatgatccttaacttctctgcctgaaaaattataaaattgttatgagaattgcaagagttaatcctctcaaggacttgtctcagttctggcacatggtaagtgtgtaacaaatatttgctattatattagtaagtagctcttaataaagaaatcccacatcctgcagaaacaaaggacagtacagatacagcatcagctaaatttgttgcaaccggagggacattctgcagctccctaccccactcctactcagctgtacatttcatttctgttaccgaacagaacacttagcttctcagactgaagacatctaccttcagcttcaattcctcacagttcttagttcaagaaccttaggcacatttttattttcatttgtcccacccaccacatggtttcccaagacaagggtaccatccacccttaaggacttaagaagactcatttcttgctagaaaaatctactcacaacgttgaaatgaaggcctttttcatcctaaaatctactcacaacattgaaatgaagggctttttcatcctaaaatatctcagtgctgagtgtgattactgagccaggccaatagccaaaccacattaggtggccaggcaggaacaggggaaggaaaagaaaattttccaggatgaagaaaaacataacgtcaagacaaaaatgagggttggatgggtccttatggaagtacagtttggggtgatggaagatgtgtcaacagacgaggttgggaaggtaggatccaggccagatacggcaaaaggggtaggggcagacttgattcaagataaggaatgtggcaatgggaaagcatttggcatgagaaaagctgtgtttagagtgattactataggaggggatgtgcaggcagaatggagtgggtccagagggtcagggagactactgcatcctatttaatttgtctgatttcttcatcttttcagaaaaccgtctgagggtccagtagtgaccttggggcatacagagatgaaaaacacatgtgcttggcttacaagccttatagaaaggatgatagtccaggcgtggtaggtagctcatggctgtaatcctagcacttggggaggctgaggcgggtggattgcctgagctcaggaggtcgagaccagcctggccaacatggtgaaaccctgtctctactacaaatataaaaattacccaggtgtggtggcacatgcctgtaatcccagctactcgggaggctgagacaggaggactgcttgaacctgggaggcagaggttgcagtgagccaagatcacagtatttgcactccagcctgggcaacagaacgagactccatctctggggaaaaaaaaaaaaaaaggatgacaggtacacaaacagctgtgatgtaaaataaaaaggtctttaagtgaggtgcaggtgtggtgatacgggacttcagggaagagaaagattacattgtgagagggaattacacagggaggctgcatttgaaatgggctatctaacctaggactgacttgcgtacaaggaatgctgtggctagggcgcagggtagaaaccagactcaggagttatgaggaagaagataggacaaggctgggaaaataatggaggctgagcagttcagtgcacagtgtttaaaagggtgccaaaaacttgaccttggttgcagcaggtgctggtaaagaaggtcactggggttcagagtactggtgacaaagtcaggcatggttctgtgccatcagcctgttcagaagaggacaagaaacacagctaaggataaagggaacatgatctggtcccgaaaggggaaggcttgggaggctgattgaaagacttagactggtagagtggtattcagagaagaagtctagtcatgaaggaaaactgaggcagatgcaggtatatcgtgtctaaggcaggcagcaccaccaattccagatctcatggctggttgcctggctgaccaggcttccaagcctagtagggctcaggaaggatgtaggagtatcttgtaagtggcagttacctgtctctgctgttgagatggctaaacaaaggctgagccttacttgggtcttcaaggctggtcaggcttgtccctgcacaaacaaaagaccacattcattcatttaagcattgagactagccaggctctccacaagtctcttgggaccctttggtgaagaagacaaatgctgtccttgctgccatggaccttgcaatcttgagcaaagtcagacagcagagcatgaatgagtataggaaatgggcttgacttaagagatacagctgagaaagtcagtggggcaaagatccggaagcgcttcaaatgcaaggctaaggagcctggggttgagcagccccatgtcacctcctccgagaattttcccagacattcttctgcagcctagtctgctggtggtggggagggactcctggattcccaaggtactttcaaagctctataattttctgtgtggttttctatctcttctcccagacaataagcatcttgggggagtgggaggaaagtggggggagcacgtcttcttttcctttatctttgtaacctcagtccctagcattgtggctagctcacaacaagtagctttgaatattgattgaacaaatgaatgagtcctgtaggcaataaggaagctacttgactatgtgcctagcttatcttctgcattagaccagaagctcttgaaagctaaacatccgtgctttctaactgttttgtaattctccccaaggcttggcagaatatcatgtacacagtggacactccataaatgatgcctgaatgcgtttgtggaagtagaagtggatcttcagtgtcctaattcctgctttcagtgacccagtttgggggagtaggtcttaaatttcttcccctcagaatgacatctctgccttttaagttctcaacaaactagtaggatgacttcttctggtaagcatatttggaaggaaaggcattctgagccccactcgtgggcctcacaacaaataaccatctattaaagcttagtgaatcttaattgtttagcagttgaaaataataatgaagtaataacgcatcacaccaggcacttttctgggttcttcatgtatatcagacctcacttaatcttcataacaaccctctaaggtaggcaggatcattgccccattcccagatgggaaggcaaaccacagggaaagcagcaggattgaatccaggcacctgtccccaagttcacatataccctggactacagcagtttctcctagaaaagaaatcaggagagaatcagcaagcaactgggagcagacttgttagactagcggtcttcaaactctaccacgctctagaatcttgatgcccaggatgcaccctgaggccagttaaatcacaatttctggggatgggaccctggcatcagcattttttttaaactccctaggtgattctcatatgtagccaaatttgaaaataatgccctctgcccttcctgcaaaaatgctgaccatgaaccaggagtatcagcatgacctgggagcagattagaaatgcaggctctcggccccaccctaggcctgctgaatcaaatctgtattttactaagatcccctcagtgactcatttgcactaaagtttaaaatgcactggtttagggcttaggtattcaagctctcattattccacttgggcttctgttattagcatgaatttaaatccttaataagcaaatctcaaaactccatcaaaaagctcagaatcaatctgatatattggcccaaaaaaattacttcagaggaaactatgaccttttacttctcattttgtgagggaactgaggaagaaaagttatattgctaatggtgtctaacagaatgtagattcagtccaatctaaaagaggcagatgaataactcctggctgccttccttcttctgagtcagaaggatcaggcccacgacctcagttaggcaatgaccatacttgagtaccaagctgattgataaagaaaatcctccagccagaggtatctaagctttcacaacttctgctgtttccccatggtatgttcctgttatagacccatagatgagatcagcaatccttgtcccaattgagatcttgttgtttgtcattcagctttctgaatctaactagatacattgcccactttttagtttagtttagtttttttctttttattttcttttagactgagtttcactctttttgcccaggctggagtgcagtgccacaatctcggctcactgcaacctccacgattcaagcgattctcccacctcagcctcctgagcagctgggattacaggcacatgccaccacgcccagctaattttatatttttagtagagatggggtttcaccaggctggtctcaaactcctgagctcaggtgatccacctgcctcggcctcccaaagtgctgggattacaggcgtgagccaccacgcctggcactttttagtttttatttgccattgctttgtttatttataactaaataactgaaatttggaactagactcagaatgtgtcccagttcatctgaaggacatggaggtccactgggatgctccttatttcactatttcactattttttggtctttgcccactttttccttgaaatgatccattctgtgcattttattatatctcaagacatcaggtagatagtcacaaccagtagcaaatacaccggctgaaattgccctccttgcttggaatgtctgcccttgaatgcaaattatttacttctggatccctgacagtgtaattgtataataactgcgtttgtagaatggtaaggttagcatcccgtttttctcagatcttcagtagcagactataaatgactagaaaggggagggctacttagtatcaagtttttcaacactagtaatggagaggtgctatggtttgcatagagttagtttgtccccaccaaaatgcatgttgatatttgatccccagtgtggcagtgttggaggtcagacctagtggggggtatttgggtaatgagggtggatcctttatgaatggcttcgtgctactctcatagtagtacatgtgttctcactgttgctagactggattacttctcatggatatggattggtttccagggagtgggttgtaataaagacaggatgctcctcaggtttttctcccccttcacacatgtccacttcccttttgatctcctttgccatgttgtgatgcagcacaaaagcccttgcgggaagcagggccatgcccttgaacttctcagcctgcagaactgtgagctaagcaaacctcttttctttatgaattacccagtctccagtattcttttatagcaatacaaaacagactaaggccaggagcataaagagagaaagaaaggggccatcccttcccccatttctctggatgatcttacttgctggccaagcgtttgtcatttctaagcctgtggcgaacaataatgatacatggaaagaccctgtagatactgtcctaacaagagtccatgctagagccttgaacatgactcatgtgagtgttgaatggatcaattaattcttcaggtacatttatgactggggctgatactgagctcataggtactaacatgaagtaagggccagagcccattctcattgagcaggctacccaccactctgctgggctggtacccacactgtaccactcattacagatggcacctagaatgtgagaatgtggctccaagttgcaagccagaaaacaaagaaatgtttacaacccaacctgatatggcttacttacaggactggttaaagggagagaagtggagcctgattggctaggaatcttgaaggggtgggacccagcagtctcagagctgcaacaagatggatcctggagaaggaatgagaatttaaagtaattcgaactgagaatggattaatatggctctctagtaaatctggaggcaaaatttggaagcaacagagaagtaaaaaggaaggagagaccaggaacaggagctgagtgggtagaagctcattgaagttttggggaatgaagaaggaggaagaagaaagaaggtgcatcaattacattgaactaagtgagtgaaacacagaaaacacaaaacacagagcaactgaggcttaaatgaactggagctttattctatattgctagctgtattagtccattctcactttgctataaagacatacctcagacagggtaatttatttatttttttatttttattttttacttttttgagacagagtcttgctttgtcactcaggctggagtgcaatggcacagtctcagctcactgcaaccctgcctcccgggttcaagcgattctcctgccttagcctcccaagtatctgggattactgatgctgtcgtgtgcatccatgtgaagagaccaccaaacaggctttgtgtgagcaataaagctttttaatcacatgggtgcaggtgggctgagtctgaaaagagagtcagcgaagggagatggggtggggcagttttataggatttgggtgggtagtggaaaattacagtcaaagggggtttttctcttgcaggcaggggcgggggtcacaagatgctcagtaggggagcttctgagccaggagaaggaatttcacaaggttaatcgctcagttaaggtggggcaggaacaaatcacaatggtggaatgtcatcagataaggcaggaaccggccattttcacttcttttgtgattcttcagttacttcaggccatctggatgtatacatgcaggcttgggctcaggcctgacattcctgtcttcttatgttaataagaaaaataaaatgaaatagtggtaaagtgttggggcggtgaaaattttggggggtggtatggagagataatgggtgatgtttctcagggctgcttcaagcgggattaggggtggtgtgggaacttagagtgggagagattaagctgaaggaagattttgtggtaaggttgttagaaggagcatttgtcgtatagaatgattggtgatggcctggatgtggttttgtatgaactgaaaaattaaatggaagacacgaggtccaaataagagaaggataaaaacaggtattaaaggactaagaattgggaggacccaggacatctaatgtgagagtgcccaagggggttcagcataattacttgtttggttggcaagtttttaggctctatccaagttttggggatgcagttcaagttgggctgatgtctgaaatgagactggggcctaataaaagggagtgtccgtacaggagcttaaatgggctgtaccctgtagcatctcgaggacaggctctaattctgagaagggcaagaggtaagagtactgtccagtcctttttaagttggaggctgagcttggtgaggtgtgtctttaaaagaccattagtccattttacctttcctgaagattgaggatggtaaggggtatgaaggttctgctgaataccaagagcctgagaaactgggtgatttgactaataaaggccggtccgttaccggactgtatagaggtgggaaggtgaaactgaggaattatgtctgacagaagggaagaaatgaccgcggtggccttctcagaccctgtgggaaaggcctttacccatccagtgaaagtgtctacccagaccaagaggtattttagtttcctgactcagggcatgtgaataaagtcaatttgccagtcctgggcaggggcaaatccctgagcttgatgtgtagggaagggagggggtctgaacaatccctgaggagtagtaaaatagcagatggaacactgagaagtgatttccttgaggatagatttccacgatggaaaggaaatgagaggttctaagagtcaggctagcggcttgtaacctacatggaagaggttatgaaatgacgacagaatagaatgggcctgtgaggctggaagaagatattttccttggtccaagaaccatttgccttgtgtgggaggagattgataggtggaagtttcagtgggagagtaggtgggagtgaccgaagaggaggaggaggaaaactggccgtgagggacagaagttggaacgctaagctgcttctttagataccttatcagcataagcgttgccctgagcgatgggatctgatgccttttgatggcccttgcagtgaatgactccagcttcctttggaagtaaagcagccttgagaagagtttttattaaagaggcattaatgatggaggacccttgagtagtgaggaaacctctttcagcccatataacagcatagtggtgtaggacatggaaggcacatttagaatcagtataaatgttgatgtgtagtccctttgcaagcatgagggcccaagttaaggcaatgaattcagcttactgagaggtagtggagggggcagagcagtagcctcgatagatgtggaagatactataacatagcctgcctttgctggtgaatggcaattaggcctggtggaaccgccatcgataaaccaagtgtaatcagggtgaggaacaggaaagaaggaaatatggggaaatggagtgaatgtcaggtggatcagagagatagtcatggaggtcaggtgtggtatcaggaataatgtggaaggccagattgaagtccaggccaggaacaatggtaattgtgggagactcaacaaagagtgagtttagccgaaggagccagagggcagaaagtatgtgcatcagatgtgaggaagaaaatagattttggaagttatgagaactgtagagagtgagttgagcatagtttgtgattttgagggcttctaaaagtattaaagcagcggcagctgccacacacagacatgagggctaggctgaaagagtaaggtcacgttgtttggacagaaaggctacagagcgcagtcctggctcttgggtaagaattctaaccacacggccctgcacttcagctgtgtgtaatgaaaaaggttgggatgagttagggagagctagtatgggagcagcttttagggctgtttttaaggaatggaaagaggagtggggaaaggatttaggatctatggggtcagctaggtttatctagaatagaataatgggtagtggagggaggtattgagggataggagagtatatgggtttggcaccatagggtggataggcaagacaatttggttgataaagcgcagatcctgaactaacctgtaagacttgtctggtttttggacaggtaaaatgagggaattgtaaggagagtttacaggctttaaaaggccatgctgtaacaggcaagtgataacaggctttaatccttttaaagcgtgctgtgggatgggatattggcattgagcagggtaagggtgatgttgcaggaagtcagggaacccaaacggagggactggctgaagccacggcagaacataaattgtgaagatttcatggacatttgttagttccccaaattaatagctttataatttcttacgcctgtctttactgcaatctctgaatgtaaattttgaagatttcatggacatttatcacttccccaatcaatagtcttataatgtcctatgcctgtctttcttttaatctcttaatcctgtcatcttcataagctgaggatatatgtcacctcaggaccctgtgatgattgtgttatctgcacaaattgtttgtaaagcatgtgtgtttgaacaatatgaaatctaggcaccttgaaaagaacaggataacagcaattttcaggaaacaagggagataaccatgaagtctgactgcctgtggggccaggcagaacagagtcatatttctcttcttgcaaaagtgaataggagaaatatcactgaattctttttctcagcaaggaacagccctgggaaaagaatgcattcccaggggaggcttctaaaatgaccgctctgggagtgtctgtcttatgcagttgtagataagggatgaaatacaccctggtctcctgcagcgctcccaggcttgctaggattaggaaattccagcctggagaattctagtcagactggtcctctgctcttgaaccctgtttcctgttaagatgtttatcaatgacaatgcatgcacagcgggacatggaacttcattagtgattctaattttgccctggccttgtgatcttgctctactcccatttgccttgtgatattttattgccttggaagcatgtgatctctgtgacccacactattcctacactccttcccctttgaaaatcgctaataaaaacttgctggttttgcagctcaggtgggcatcacggaacctgccgacatgtgatgtcacccccagagtcccagctgtaaaatttctttcttttgtactctttctctttatttctcagaccggccgacacttggggaaaatagaaaagaacctacattgaaatattgggggctagttcccccagtagggtgattaggttttaatgggatggtaaggggggcatcatccatcaccaaggagggagtagaggtgtcctgtacttgtggattaaggtggggagatacaaggagaggacatgaaggaggctttgaactgggggaaaaggtggcagtgaggtgtggctgtagcccaggaatagtcaggaaagcagataatttagttaaaatgtctctacctaataagcgagctgggcaggtggggataactaaaaaggagtgcataaaagaatgttttccgagttggcaccagagttggggagttttaagaggtttagaagcctggccatcaatacccacaacagttatggaggcaagggaaacacgcccttgaaaagaaggtaatgtggagtaggtagcctccgtattgattaagaaggggatggacttaccttccactgtaagagttacccaaagcatctgtgatggtcctgtaggcttccgaggtgattgggcagtgtcagtcttcagctgctaagccgagaagatctggaaaggagtcagtcagagagccttgggccagagttccaggagctctaggagtggctgccaggttggacagtctgatttgcagtggggtcccgcacagatggaacatggcttaggaggaatcgcaggctgcaggcattccttggcccagtggccagatttccggcacttgaagcaagatcctggggtaggcagtcctggaggaatgcctgactgctgtggttcaggcgtttggaagttcttgtgtgctggagatgtggctggggtttgtctcacagtgtaggcaaggaattgcaactcagaaatacgttgctacttggctacctctactctattattgtacaccttgaaggcgaagttaatcaagtcctgttatggggtttgagggccggaatctaatttacggagctttttctaatgtcaggagtggattgggtaataaaacacatatcgagaataagatggccttctggcccttctgggtctagggcggtaaagcatctaagggttgttgccagatgggccgtgaactgggttgagtgtttatatttgatgaaaaagagcctcaatgctaacttatttgggagaggtcagataaagtaaaaggagcattaaccttggctatgccttcagctccagccacctctttaagaggaaattgttgggcaggtcggggagggctagttgcggaaagaaacagtaagccggacaggatgtgaggaggggatgataaaaggattatagggtggggaagtggaggctgaggaagaattgggacctggctcagcctgccaaggagcagcctggggaggaggggagaggtcagatgagtccatagaaaaggaggattcaaaggagtcagagcttggggtggagactgaaggaacagacaggagagaaagaagaaagatttgggacgagtcgcttcaggaacagagattagggagggaccaatgtgtaaaagaatgcctggacatcaggcacctcagaccatttgcccatttttcgacaaaaattatctagatcttgtaggatagacaaatcgaaagtgccattctctggccacttggaactactgtcaagtttgtactggggtcaagtggtattgcagaagaatataaggcgtttaagttttaggtcaggtgtgagttgaagaggttttaagttcttgagaacacaggctaagggagaagaagggggaatggagggcggaaagttgcccatagtgaaggaggtaagtttaaagagaaaggtagagacacggagaagcaggtgggtgagcagccaaagcaggtgtccctgcagttgacttgtcaccaagagaatgtgggtgaatgaccaaggtaggcatccccatggtgatcagacaccaatggagtatgggcgaataatcaggcaggcgtccccacagtgattaaacaccaagggaagactgtcttcctgagtctgtgaccgccaccagagttttgggtccacggataaaatgtgtctcctttgtctctactagagaggaaaatgaactggaattggaaggacagggagattgaagggtagcgagaaagggagattgaagggtagcaagagaggctggagaagagagtgaaaagaccacttacccaatttgaaattcatgagatgtttcttgggctggttggtctgaagacctgaggtggtaggtggatctcctcacagagtgagggcaaagacaggagaccagtctcctgaaggagtcctcctgtcccaggttttggcaccaaatgtgacgcacgtccgtgtgaagagaccaccaaacaggctttgtgtgagcaataaagctttttagtcacatgggtgcaggtgggctgagtccgaaaagagagtcagcgaagggagataggggtggggccattttataggatttgggtgggtagtggaaaattgtagtcaaagggggtttttctcttggaggcaggggcggggatcagaagatgctcagtgggggagcttctgagccaggagcaggaatttcacaaggttaatcgctcagttaaggtggggcgggaacaaatcacaatggtggaatgtcatcagttaaggcaggaaccggccattttcacttcttttgtgattcttcagttacttcaggccatctggatgtatacatgcaggcttgggctcagagtcctgacagacgtgtgccaccacgcccagctaatttttgtatttttagtagagacagggtttcaccatgttggccaggttggtctcgaactcctgaccttgtgatccacccacctcggcctctccaaattctgggtttacaggcatgagccaccacacccggccaaactgggtaatttataaaaaaaagaggtttaattggctcatgattccacaggctgtgcaagaagcatgatgctagcatctgcttggcttctggggaggcctcaggaaacttacaaatatggtggaaggcaaagagggagcaagcacttcacatggccagagtaggaggaagagagagtgagtggggaggagctatacatttttaaacaaccagatcttgtgagaactctatcattatacagtaccaaggagggatggtgataaaccattcatgagaattccacccccatgatccagtcacatcccaccaggccccacttccaatgctggggattacagttgaacatgagatttgggtggggacacagatcaaaaccatttcagtaacaaagtctggaagtaagccattgtaggggtagaaatgtgtggtaccttttctcaaccatcataaggctcacagccaacacttttataacaaaagacaaattaacaagggaaaagcatggcaaatttatttaatcaaagttttaggccaggcgtggtggctcgtgcctgtaatcccagcactttgggaggccaaggtaatacaggagttattaagaaataatttttaggcagctagaaagggtgggagttctcggtggaattttcctttaataaaaagcagccccaaaaccatttcttctctaacagaaagcagactgagaaggcatagataaggaaactaggagtttttatatgtaaatgcagacagctggaagccaggtacattcagtatggcatctcccaccctcttttccttgtcaccaggtctctcaccctcttttccttgtcaccaggtttatgggtgtcacagcagcctccaggtaaaatcacgtgtacaagtatagccaccaccaggtggaggccatatttgcataataaaagactagggtaggagagccagtcttttcctgggctatgtgaatggcacacctggtcaacccaatcccctgagccctaagtaaatcagtcaccgcctcctcaagcctgtacaaaaccaattgcgttccactgcagaccggagaccctcttttgggtgacctgctttctcagcatgaggaagctttttctctctcttttcttctattaaactttccactcctgaacccactcctcgtgtgtgtccatgtcctgagttctttctcaagtgagaccaaaagccagggtatataccccagacaacagagctgtttcacaggtggatggatcacttgagcccaggagttcaagaccagcctggcaacatggtgaaaccccatctctactaaaaatacaaaaattagccgggtgtggtagcatgcgcctgtagtcctagctacttgggaggctgagacacggattgcttgaacccaggaggcagtggttgcagtgagctgagatcgtgccactgcactccggcctgggtgacagagcaagatcctgtctcaaaaaaaaaagttttacatgatgcaggagacttcaaaaatgaatacacaaagacccagggaaaactgtccacttttatgcatagatttgatgaagatgaacagctgtgtagaaatgtgattgcacaaaaaggaggggcaggaacccagcaaggcctgtctgttcagattcttcttggtcttactgtgtagcattccttcctcccaggcagaggggagaacccctctggagcaaggataacctgcagtcagacaaggtaggtcagggaatttatttatggctagcttctgcacagaaaggcaggggaaggtcagagtaatatttctaggttttatagcttaatttggaagagagggattctagtttctatgacttgccttggggaagaggaattatgatattttctaaagagacaaggtcttgctctgtcgcccaggctggagggcagtggttgcaatcacagcccactgcaaccttgaactcctgggctcaagtgagtgatcctcctgcctcagcctcgcaagtcattggtactacaggcacatgctgtcatgcccagctaatttttttttattgtttgtagagacagggtcttgctctgtagcccaggctggtatgcagtggtgcaatcatagctcactgcagccttgatctcctgagctcaaacaatcctcctgctctctgcctcccaaagcactgggattacaggcatgagtcactatcccctgcaggaattgtgatttctatgactgggaagaatgaggggcaagagacatgagggtgggagaaggtcagagagaacttgctactggggctgcttctgaggccttccaatctcttttagtttgaggtactcagcatgccaatgtcttattttggggtattgttttctgagccccaacactgtccatcacttctctctctctcccctacatactttctccttccctcccttctcctttctctcctcctttccctcctcccttctcttcctctctctttccctccctccctctttccttttagatgcgtttacaagaaggctggatatagaatcaggagacctagaaacctggcctggtcttatccttaacttagggtaagtaactcagcctctctggactcagtgtcctcacttgtaaaattaggggctgaataagagaggatgcctagggtcctgcccagctccaaaatgctttggtcctccaagatccataagactgcaggaagtagctgagacagccctctcggagggagctgggtcacagtctgctagactcccctgctatgtaaagtcccattctggcagatgtcacttagatttcccccactggctccagataggcctgctttggataaatgacactcctgttttgctaaatctgaccaactcaaatcatgccatatgtgcctcattacaaacttgtccctgtgccagccagatggatgcagtactttttggtctcccagctaaaggttgaaatggccttcatgatggcacagctggcctgtagaggtgcttttgtttcacttgttagacaccatgttctgtttcaattctgtttctctagttaaagtgttttcatttctttatttgttcaataaacacctctcaagtacctgtatggccctggcactctgaggggctccataataccaaaacaaataggtcacagtcccttcctttctggagctggcactgcccatggccttcctggtattccacaatctcttcctacttaactctccagctttatttccctccactgatgactcctccctgtcatattgtccctttccctggggaggttttgcacatgcacatgcttagcctgaacaggaacccctgccctcccaggtacacataggcatttatacacacacacgtgcatgcacacatgcacgcacacacacacacacccctacctctctccccagccatgggattctccattcttcaagtttcgacttcagtgtactttccttaggagatctcccctgactgttctgcccccaattcctgttatatattcctttagcaccctgactttccttctcaaaacattctccatctggtaactgctttttaagtcttctccctcactggaatgtaaactacctggcagcatgaggatcacttcctgcacacggtaggccctcagtaaatgaagtatgaatgaatacgtggatgaatgaagctgtgaaagggagagacaaatagacagagatggatatatcccatcaagatcacagaaggaatgggagcgaagactggtagacagacccatagaaagggaccccagctgctgtgatggggaagggatgggtggcaaggtctcagaagaaatttgtacctgatcctgaagaaggaatgagtaaagtgaagaggagaggaaagtgcagctcaggcagaagagacagcatgaataaagacaggaggtggtgggcctggtgttttcagggtctggagagttgttcatgaggcaggtgtggaacatcagaggctggcaggagaagctgtgagctcccagacagtgccctcctccttgaataagaacttgcagaatccccgactctggagtccttaccatggcagggcactctaaagaacagaattcttccttccctctcccctctttcccttgcttcctgtcttcccttctctcattcttcatcaaattcaactcacatttactgaactccttctgtgcatcaagagttagagaattttcttctcactctctgctttgaaagatgaatctagctccaaaccagaaatggttccactaggctggaactgtggtcagggaagcagatgagagctggcatgtgggcaaattagggcagaaacagactcttggtggattccaaagtaggcacagatttagagggaccaggttagtgaagttacccagaacagagatgggtcaaagacagaggagagaaagcctctttgctgctgcgggccctttaaatgataccctctcctctgctcgcatggcctgggggctggtcggcaagtgccccaccagtgggtgctgactccagaggtttggccctggggaaggagggtggaaggccgagctcaaagtagagaaaaggggcatctggaatctccatggcaaggggcaggcagagagtgcagaaaggcagggagcatgacctgtttcctttccacaaaagaaatggtactatctcctgctggggtgacctctgctttcctctctgaagagaccttaacttttaactgttcaggttgcttttcttgatcagggaggagctcaagcctgcaaaacctccctgtaggtaagagggagaatatgccaagggaggctgctgctatacagctcctaaaaggaaagtagggtgggtaggatgggatctcaaggccaggctgcccatggtgagtgcacttcaggtggatagctgtgctgggggaagctgccggccaagtggacactcagagctggcagccctggaaatgagattggagccctgaggctgagtgggggacataggcgttagcactccagtattgtatcatgtattactgtcaggttttgtgcgtactgcctcctgaacttgaccttggatgtggaggtaatgttatacgtcacccagagaaaccattctagagctgactaaacccactgagggggtctctgtacgcactcgtgagttttgataggttaccagagagccacagatgggtatggcttggaacaaaacccaggcaggtggctcacagccaagcccaacaaagctgcctctttcacagactctttcttgggatggcttggatattccgtggagagggatggtccccccagaccacctgggcacacagaacaaagtgcccagagggaaacttggttaaatccaaattaagtgcattttttgatgagacagaagaaatgaagaaaggccctgtgggcagctttgggcttgcagagcgcatgaaaaatatgtcatctgaggaatggggagaggagacaaagaggttagtgtgacaggaagcctgggaggaataaagccagagtaggaggaagagagggccactaagaaaggaggagggtctttgccaagaggaggcatgagaacaaagggagagaggtggtgggggtaaggtcggggatgcaaggagagctgccggaccctggtcagtgttttccccagcactgagagttgtcaccggaggcctgtagtctgtgtgttggaggagcccagcctagccctctcggacggagaagaaagaatgggcccttttagctgaaggagttagcctccacctacccaccagccatggatggatgagcacctgctcctggcccctgacctgtgtgttcagtgccaacagtgctttagagagggtaacagcactaagggttctgagggaaaatgtggacagaagctgtttatgtccatactgttttgttctttaggagtcttaaacagtgcttgcaggaacagtttacaatggtagtgaaggaggcactttaggcaagatgtagagaggacgtggtaaagttggccaggccacgttggccagacctggggtagtggctgagggttcttgttcattcaacaaacattagttgaatgtctactaggaataccgaaaacaagacagactccctgatcttctggattctagtttatattctaggttaccttctagtgaggggtgacagacaagtaaacaatgagatacttttcggccaggcgcggtggctcatgcctgtaatcctagcactttgggaggccgaggagggtggatcacgaggtcaggagattgagaccatcctggccaacatggtgaaaccccatctctactaaaaatgtaaaaattagctgggcgtggtggcacgtgcctgtaatcccagctacttgggaggctgaggcagaagaatggcttgaaccaggaagtcagaggttgcagtgagccgagatcttgccactgcacccagcctggccacagagcgagactccgtctcaaaaaataataacaacaacaacaaaaaacaatgagatacttttctatgtaggttaaaaaagctctttgtttgtcttcacttcccaaccaggttgaggctgccagggctgtcttctctgacagcaacagtagagcagaagtacagtcagtattttgcctgtcaatgtcatcttgacttacacaatatttttatgcatttttcctctcctcatttccaaaatagtcaataatcccttcaggagtggaagggaaaaggaagattgcagagggcagatagctccagaagaagagaccactgcctcctaactgtattccttccaccagcttctcctcattcaccttcctacactcctggaggaattttataacatgctaatgtcaccatgggacttcctgctttaatggtttagattgagaattggttgggatgcttttgactcctaagaagtagaaagccctgactcagctggcacagtcataaagacacttagcacctcacccagcaagaaacctggggaaggtgcctcctggtaggttaattgagtgattgactcccaggagcccaagtccttcccctctttcagctctgtcatttccacgctgtacgccttcagagtggcatgatggctactgcatccagataccacagcactcagcaggaggagagacactcctccctgtgcatctacagcagggaggggacccttcccagggccccagaagattgccttcatgactcatgggctggacttgagtgatgcctcttcctaactcactggcaagggaactggatttccatggttgcctctgagaagcacagggccatgggtggagcaaatttcctgatctacaaagggagctctattagtcagtgagtcaagagtgagtggtgatgagttgatgggtaggtaagcataggtgtctgttacagataactttgtctcactttcaggaaaaaaaaaaatcaaactctgtagcaagacatcaaatgcccttcatgttcaggtccctgcctgctcctccagcctcatcttttcagcaatactcaagtgcctttctccagccatatccaaagtattgctggctgggcatggtggctcacgcctgtaatcccagcactttaggaggccgaggcgggcagattactttgagctcagaatttgagaccaggctgggcaacatggcaaaaccccatctctactaaaatataaaaattagccaggcatggtggcagacccctgtaatcccagctgctttggaggctgaggcaagagaatcgcatgaacctgggagacagaggttgcagtgagccaagaccacgccattgcactccagcctggacaacaagagcaaaactccgtctcaaaaaaaaaaaaattagccatgcgagatggtgagctgagtaatctcagctacttgggaggctgaggcaggagaatcgcttgaacctgggaggtggaggttgcagtgagccgagatcacaccactgcactccatcctgggtgatagagagactgtctcaaaaaaaaaaaaagaaaaaaaaaacatcacaaagatggattgcaatgtccatctgaaccttctctgttctttaatgcctcaatgcctttgcccacactgtttctggcccttgctgccttgttctttgagacagcccttgctatactaacactctcttcaagcatatcccagcttccctaaccttgcttggctcctgcctccaggtggaattagaaggtgctcctttgcaagtgactcagttattgcagactggtacagtggttaaatacaaggtgcagaaagcacacacccaagctctcatgcttacaggctgggtgacctcaggcaagatatttaactctctgagcaatctaattgattcttcttctgtgaaatgggcataataatggtaaaaatgggtctaataatagtacctacttcattaaatttttgtgatgattataaggtatgctaagtgcttagcacaacacagggagtactgtgctaagtatatgtgtagtgctcagtaaatgctaattctttttatttggtggtggttattattagcatcctcatggagggacaactgtagacacaaatacaaatagagtgacctcatgccaaaatgtgattccaagacgtttgctcacttttcaaatggctctaacatttcaccacccagtaactgcatgttgaaaggcccctgtagtctttggggctacggtatttagtgtgggcaaacagcgtgatgtgtaccgtggacatttttgaaggtttctttaccaccacctctgaactccatctgcatccaagggctatctctaaagagaaatcgaagacatccacccacagtttcacagagctctctacaggcctttcccttattggtcatctccttggtgaggtcagaggaggctttgctcctggcctctgcaggagattcctgtcctctaatctctgaacttcaatggaatctgggttagaaggatccctgagggagtctcaagggaggacagccgatttaccctccccagacccctcagtgttgaagaacgaccttcaagaggcaaatgatgatttgaaggtcgagtaaggctcttatgtacttgtgacaaaataagaaaaatacatttggtctctgccccagttcctagcacagagctcctaaaactcttgtaatttccggagtgataggggtgacaggagttttttttgttttgtttttttataatgtaactagggtcttggtccctagttcctgctataagagcttctaacacccttggaatttctggagagataagatgtaatttgtaatgctaatgaggtaactctaggttgggtgggggtgggggagctagacagcttcaggatgaggtcggcttaccagaggaatcaagcttacgattagagggttggaactttcagccccatcgtctgacctctgggaagaggggagttggagactgagtccaatcaccaatgccccctgatttaatcaatcatgcctatgtaacggaacctccacaaaaaccctaaacaacgttattcagagagcttccaggttggtgaacacatccacatgtcaggaaggcaaatgcccagagagtgtggaagcatctcacctcctcccacataccttgccctatgcatctctttcattggctgctcctagagttttattctccataataaactaatcagagtaagcaaagtgtttcactgagttatgagaagcattatagcaaatttttgaacctgaggagggaatttggggaacccccaatttatagctggtcagtcaggaatacaggagacctgagacttgtgattggcatctgaagtgggggtcagttttatggggctgatcccttaacctgtagggtttgtgctaattccaggtagttagtatcagaattgagttaaatggtaagatcctaattggtgtctgcagagaactaaagaagtacaagtacttagtttggaaaacctacacattttggtgtcagaagtattaagagcatcgaaaactagtttttcttttggtattcttaccaatttccacagaaattgaggtcctgatggactctggatacttgagtagcatctttaactgtgtttgtgtgagtgagttctgagtttagagtttactgttaaataaatctggctcctaagcaaattaatgcaggaacagaaaaccaaataccacatgttctcatttataaatggagctaaacattgagtacacatggacacaaaggagggaacaacagaccctgggacctacttgagggtggaggataggaggagggtgagaatcagaaaactgtctatcaggtatgatgcccattacctgggtgatgaaataatctgtacaccaaacccccatgacacacaatttacccatgtaacaaacctgcatttgtacccctgaacctaaaataaaagttggaaagaaaaataaataaataaataactggaaatatataaataaatctggcaaagttatagtgtttgtggtaggtgaaaagatactcgcacccagcagcgtctgcctgaattttctctgtaagttgcaaaggtccaatatttaatacaggtcacattttaggattagaattttaatccactttcaagtagtaagtttgttcctcaaaaaataaaaaataaaaataaaagatccagaagagagctaagagtaggaagcaacctacctttgtatcttttgctaaagcgcatgtattttggtagttaaaagcaaaagcaagtgggcttggtaaccagtgggaggagtggccagggaaggtgctcccgaagtatcaattggttagcaaagtcagtttaaaatgggcgacccggctgggcgtgggggttcacacctgtaatcccagcacttcgggaggccgaggtgggtggatcacgaggtcaggagattgagaccatcctggccaacgtggtgaaaccccgtctctactaaaaatacaaaaataactgggtgtggcagcacacgcctgtaatcccagctacttgggagcctgaggcgggagaatggcttgaaccggggaggcggagattgcagtgagccgagattacaccactgcactctagcccggcaacagagtgagactccatctcagaaaaaaaaaaaaaggacaacccacagagtatacaattataacaacatgtggatcattgcttctatctcaacattattataacaaacatttgatacttttctatttacaaaaatatcatatatacattgctgatacctaatatctaacaattcttcagcacttaactatgtaccaagcagtgttttaggtgcttacactcatttgctcatttaatcattactgacccatggggctgtattccagtgcctccttagcctgctctttaaaaccattcatcacccacccacttactctcctacacagcacttaccactctctgacacactatgtttacttcattacctgtctgtgtctctccactagaatgtgagctccctgttggtgagaatttgctttatacccagcacctagaataatgcctgacatataatgaaacaaatgcctggtcctcagtaaatacttgattaatgatggaaagtactgttacctcccattttacaggtgaggaaacaggctctgagtggttaagtagcttgctcagatcacagctaggaagtggcagaactgggatacaaacccagacacttccgctctggagacacccacaaccacgacagtaggcagcccaggtacacagcactgagtcagaccagtcctgaggtggggacttgcgtggtaggcatagaccaaggtatttagcctgcaggcagaagaggaaggccctgagaaggaggcggtagacattgaagattaacgtcagctgtgtggcacttgtgctttagtgtgatcctggctaacagtgctgatatcagtctctcatgagtgtaatcacacagaaaccaacagatatttctgaactccttgtgtgtgtaaagcactgatgtacgtgttaagaaaactgtcacaaagtacaaaaggagacacttggcactcaaagagcttataatctaattgtgggaagcactagcacatgaaaaataacatagcaaagtcagcagtattaagagtaccataaagtggcacgtggttaacactcaaaccaggggccctgggaaccagtgcgtcaccggtaaggagggagcagtcactaaagtctcagtaggctgggaagcttcgtgtggtgtggggcggcggggagcaaagcttccttgggactggcagagccaagagggctgaggaggtctaggggaaggtgaactgggagggtgggaaagcagggaggaggagagccccttggcaaaaagtgctgtggggcaaaatactgcaaagatgctgggcagggatgtgggggggtaaacagggctagtcagctgtagcccatcaaagccaggatggagaatgtcatatgtagtttgtgcatggatgtcaccttgagctgggaagcaactcagagacttacagggaaggagaatagaaaaggagtaagattgggaatgctgccagagatgacatggagaagcacagggaaggccagagaaccaaatggctaagggcacaggctttagagccagcctaacttccacctctacctctgccacttctgaactgtatgaaaggtcacgacactcaactttcagagactcatttcctcatctgtaaatgagagaaaaagaaaaaagttgtctcatggaatgtctgtgaggttaatacagtgagataatataacatgtaaaatacttagcacagtgctcaataaatggtagctttcaaaaaccatggaagtgacccactgggaatgctgggctctcagccccaaaaaccagagagcaatgccagaccatggtgcctgctgccccccgcactgggggtgacccccttcagcccctgctttgatgcccagtggcccatttcttccctcatacttaaaagtgcctgctcacatataaggctaaatcaaactcctgcagaaacatgacaggaagctgaaaagataacataaagcagaagcagggattcctgttaccagaacagtgttggttgaacaggatgtggggggatcagggaaacagatggctgagaagcagatattgcggaaccatccaggaagttattgccctcccaagctcaggacagaggctagttctattattatgacttttttttttgagggggtggtggtttaatgtactgattgcttgcctgcccctgaaggcagttttaggacttcagcaaaatacaagttagcacctgtttttgtaagtatagctaagatagttttagtttggggggttttgttttgttctatcttcattttttgttgcattcctgaatatcttgttcctagctatggtggttgttttgacattgtcaatcaagaattcagtgggcaatagcttaaatgccttcagtattaccatctattgcttgtttaaacagagttttaatttctttttttttttttttttttttttttgagatggagtctagctctgtcgccgaggctagaatgcagtggtgcaaccttggctcactgcaacctccgcctcctgggttcaagcgattctcctgcctcagcctcttgagtaactgggattacaggcgcccaccaccacacacagctaatttttgtatttttagtagagatggggtttcactgtgttggccaggctagtctcgaactcctgacctcgtgatctgcctgcctcaacctcccaaagtgctgggattcaagcgtgagccactgcgcccagcccagagttttaatttctaaaggattttgtgaattattcaccaatgaaagcaaagctataaattgcagcataatttcaaaatattgcttgggggatatgatcatgagaaaacataaaactctattctcctgtcaattcctgagcaaaaattatcctacagtgatagaataaactagtcacagtgggctttctgtgcagctaatttattttatgtgcctactgtgtgccaggtatagcactagattctgggtatacagtggtgattaagacagcatagtcctcactctcttggaattttctagtatagttttccaactagcagctggccttttgcatatctggatagcctgaatacgtacctcttgttctttcagtagtaataatatgtttgtgaatgttccattcacattcttccccagcatcctttgtatgtagagtgtactatacacatggctgagggatcagggaaggtgtgaatcagatcctgtaaacctagcacaggccctgaccacggcagcattcttctaacctcctaatcagtgagataagtgtggttgctacctaataaaccactgtaaaattacattagaactcctcatttatattttttggctcaaacatgttctccgtgtgtctgttggtgtatagcgcatctctatacaaatgtacatggccctttcccatgttttatttcattttcccttcagaagaagcctgtgcagcagaatgaatcaggcaatggtatctcacacatggatgaaaagtgacttccctccccattcttctggggagggctgcttccccgctttgcgaagccccacctcttacaacctaatctgcagcgccagctttaccaagtgaggttcactttatattcagcatttactgagtcatcaatccccaggaatctcaagataccaaaaatatggagaccccacagagaaagctcaagttcactactgcaaatgcctctgttctgaagagtaaattcgagtaagaaaagaaacaactaatcatgtttatgctgagaaatgtttctcttctttctctccttcttgatctgcttatttctcatagttccccgtctctgagcttctccctggggcctacaaaatgcatctcgctggcatcctaggagagcactgaataaatataaagtgataatgaggaggcggcagctctgggccacctgggaggtgataagtgcagccaagaggcccggtgggacctgaatgcctgctcagacagcccagggatctcaggtgtgatataattgttgctcagcttgtttcctttacccaataaactgtagctctgtgggggcaagttgtatattgtgctctccatatagccctaacgcagtgcctggtgctccataaatagttattaaaagtaggaaagaaggcaggcaggcaaggaggaaggaatgtgtgggggtgcacctaagcttctgaggttgtacagaaaatgtggacagaaacctaaagtctaggtaggagcggagtttgcactccgtcttttaagacagaatccctgggttagttcaggtgaaagccccgtggattaaacctgtttgatgcctggtttgtgggagtcaagggatgtatgcgcctcctctcctggctgccacacaggagctgtgttcagtctcacaggggcatcatcagcctgggagcagctgtgtggctgtaacaccagtggatgccggtgtaacagctggtacacacaccagtggtgacccccagatgggcccacagggcagaaacactaaaggccaggcctccttctccatgagggctgcccagagttccttcacaacagcgacaaaggcagagcccaagcccattggaggttttgcaggtagtggacgtgagtcctgaagagcagctttaccactccagggaccaccaggccctgcccgcctagaagtcatagcagccagtgtagactttagcttaggaatacactgcatgaccatctctgtgggaccccttcgccctcaaccatcctgtgagatgtggaaattgaggttcaataaggctgaataacttgcctaaggtcacacaaccagtgaagtgtcagagttcgtactcagggcatctggtcctttgtcaatcacatcagcagaggcatagcagctgcaatgttgagaatacacttgatcttagccaaaaggccaagaagtgatgcaatgttgagaataaccagcagaggacagcctccaccaagaggccatttactgcctttgcagagatcaaagctaacataccagtattggggcatatgtcaccatgtgctccctgctccctgacaagatacactgaaaaggatccaacatcaattctgtgattttcctgtcataaaaaatttacctaaacctaatcctgaaataccagataaactcaaaatcaggggcagtctgctaagcaactggctagtacccttcaaaattgctaaggtccaaaaagtcaaagaaaggcagaactgttccaggttaaaggagggccatacagctaaatgcaattaaatgcaataaatgattgatctttcattggatcctgggctgagaaaaaagcaatacaaaatgtaaaggacattattgggacaattgacgtaatctgaatttgaactgtggtttagatagtagtattgtatcaatgttaagtttcctaaagttgcaatcataatatgtttacataacagaatgtctttgatcccgaaatattaaggggtaaaggggtacaatgtttccaactagctttaaaatagtcaaggaagaacacagagatagtaataaggccacaaaagaaatggagcacaatgaaagcaataggtgaatctgggcaaagggcacatggaagtcccttatactgtacttacaatttttctgtaacttttaaattatatccatattaaaagtgaatgagagagagagagaaactgtcctagtttttcagagctttggacttgtggtagccacacccgatttgagtcagtgaaagctttctcattgagggggtgggggcagtgaggtgaggcctctttttagtaaagtgtggcttcagcccactgtggagccctgacctttgccctggactgaccagagtgactgcacacaaagcttacctgataatagatttacctgacctatgagacggcctttgcttaaacattttgagggagtgaatataattcacacctataggtggaggaagaacagtggaccaagctgaaggcagaatggagctctgggggctggggacacagggagcattccagggcctgtgaaatacagagaaggagaaaggagggtcatctgggggagggatgcagggtggaaccaccacctacagctttgctggggcaatccttccaaaaggtaagactgctggaatctgaatgagcaggggaaatgttaacagtaaaaagactgctatgaggggtagccatgaaaaaggacatagagtagaaaaagccgatggagatgatatagacaatgatgtgtgttagaaccacttggaggactattggaattctgattcttttaggcctgggataggggggtagagaatttacatttctaacaaactacctggtgctgctggtctggaccacactgtgagttgcagtggtgttgcagatgattgtgtccagcccaccctggaggggtaatgcctgtgaggaacatgtgagagtcacaatcaaagaggtccagggttgaccctgtggtgcctctagctgggcagtagggattagggacagacagcctcatggatgaaatgccacttaaactgggtttcagaggagctggggtagaggagggccttctaaggaagcaaagacctagaaaacagtccagtccagttcatcatttgggtttcccagggaaatggtgggcagaaaggcagttgaagggcctgagtgccaggtcaggagtttggaccatatttggcaggtggtgcagagcctatggtggagacatgacagagagagggctttcaaaagattgacctgatagaggtatgaagaggtatgaagggcagataggagagggggagacttgaggtaggaaaactagacaggaggtcccagcggtgggcttcctgggacggaagggcctggggaaaggggatggtaagggtgcgtggaaaataagggagtttaagcattctagctaagtgggaagtagaattacacaaagaatccatttgttctattagacttttggccttgagttaccaccaaaattgatatgaagcattcaagtcttcaaagatgttttttaaaaaaatcaatccattaaatgtatttacaggacatttattactaaaaattaagcacgagctttcatatgaacatcttcaaaagtctcctaagcagcaagtgggcagatggagacaatgatgtgctgggaaacgtttaccaacaggctgggagtcaggagagccctgatttgtagcgaatgtcagtttccgagctataaaattctctcataatggccgatttcaagctaacaacatgatgtcaactagcttgtaaaattccaaaaatatgtcagttggctcttgggagccagtacaagctgtttctagcacactccagaatgtagaacaaatgacaggaaatggttggagccactgcataagtagtgagtaagtttcttttcagcattggtttctgaacccagaaagccaggattacctgtggaagaagctcacaggccaggtgactttgggccccaagcattggagcatcagttaacaacagttctttccaaagaatggaaaatggcggataggttggatttgttccaaagccccaaagccaggaggattattttacataatagagaagcataaaggaaagggaagagtcttaaaactaagaggaaagagacccggtgtttgcacttatctctgtctctgatacttagcagctgtgtgcttaactgctttgagcctcaccctctgtctttgaaagcaaggacaatactaatagtatacacagctccatgcaaagcctagaaggcattccatatcagtcagacttcacaaccctccctttcttccctgctacagcattcacccctctccacttaggtttatgctgccccagaccctgtatctgtcccatagaaactatcctctcacgtctgagggatgtcccacaccttcagggtagatctggaagccgcactggccagtctgctgcagagaagaaggcaaagggagagaagctgattgtgtccccatcagctttcacggctgtgctttggtccctcacgagctgtacttcctgcccttggattctagtctttctttttttctgataattttttcttttggcttaaaattgggattctgttacctgtaacccaaagagcctgagacaccctaattatcttccttcaaaaattctggtagagacaaaagacactggcctgggaatcagatttgagttttgaccttggacaaatgacttcacctctctgggtcttggtttctcatctgtaagatgaaccaatgaaccaaatgaatgtaaatgaattttagcactagtgtactgctctgttctacatatctttagcctaatgggagtatattagagttaaatgcccactcaattccactagtcagaaatgagttgatttgaatgaccagagagctttggacagtatttgcacagtactgattaactccctagccagtactatctgggcacgggtgacaccttagttcgcctggtgtctgtagagggtcctggaacttgtgtaggattgtgaaaggctgctgacagtgggccttggcatgcatggagaaggatgatgctgcagggacatgtggttttcatgaacatttttgaagccatgaaagtgtcctagggttcctgacctggcatcagagtgtgctgatgtgggccagtttcctgtctgagactttgagagatggatgggaagaggtgaatatttcatcagtcataaccacgtttagtattcaccctgggagatgctttccctgtgctaagggaaaacttaagggctagttgtcaaaaaagtctttttgtgtgtgtgtggtaacaataaaatagtaattgctatggaagatgcgtatatttataaactataaagaagaaagtgaaataatctgttaaccaaagacctggagataacttctaacagcaatttcttttttttttttttttgagatggagtcttgctctgtcacccaggctggagtaaagtggcatgatctcggctcactgcaacctccgcctcacgggttcaagcaattctcctgcctcagcctcccgagtagctgggattacaggcacatgccaccatgcctgctaatttttgtatttttttttagtagagctatcttggccaggctggtctcgaactcctgacctcaggtgatccacctgccttgacctcccaaagttctgggattacaggcgtgagccaccgcatcgggccagcagttccatttatatccttctaactgcatgccaccaggttttacaccgtcttataaactgcttatcttaaaaatgtttgggagaattcctcgttaaagacctttattgggtcttcaatgatttttttttttttttttttttatctttttgagacgaagtcttgctctgtcgcccaggctggagtgcaaaggcgctatctaggcttgctgcaacctctgcctcccaggttcaagcaattctcctgcctcagcctcccgagtggttgggattacaggcacccacagccacgcccagctaatttttgtatttttagtagagatagggttttgccatgttggtcagagtggtctcaaactcctaaccccaggtgatccgcccacctcggcctcccaaagtgctgggattacaggcatgagctaccgtgcccagcaggtctttaatgatttaagatcaaatagtaccaaagactttatcgtgagaaatagaagttacctgccccacgactccccccaccaccacccctcagccttgatcccccaaagaaaattttaagcatttttgttttgttttgagtttttttggtggttacctccaacagaagatgttgtttattaatttagcatctttattcttttctattgactttctacagtgatagaggagtcagctacttctatcccactcctgcctcctccccatccttctaaatatagtgaaatcattattctcagatctttctccatctcctcctcaacttcaaagaacataattaaagccccatttcctgttccatcaaatatagataatatctctttactcttcactttgtcaaaggagcacttggcaccctacccttccctcccgcttctctctctcttctacttcccaacctctgtcagcctgttacatacttttacgctttgttttgaaatcattgttgagttggttatgtttgtctgatgttgactctacaagttgaagaccagaaaataatatttatcttattttggctatagaaatatagttcacagcagataaagtagtgaactaggattacatttctttatggaaccaatgtccctacccaatagagaatatttctggaacaaattatcttattttcttttgtttttaatcccaccaattttctttatcttatcctcatatcatgttttccatgcttttaatcaagctattttttttaactgattctacttctgtttgttccagctgccctccaaaaacaaaacaaaactagaaaactgtgtagttctctatcttccttctcttgtttcctctgggtctgtaacgtggttgccatattgcaatttctcttcattgttctcaatgttcagaattcacatttttcaagtcctcaacagcttcctctttcttaatttatacatcgattttgctggagtgtattctcaggtaactttctagaaaatgctatacaggaggtacaattctgctttcatatctgaaaatgcctttattcaacttttcacttaactaataaattggctgggtataaaattctaggtcaaatactatattactcaaaatagaatctgtggtttttttctggaatctgttagcatctactttttattcttggtgctctgaaagttttcaatggtgtgctatgtgtgggtctttttgattcatttgttctgggcattcatttgccctgttggggctctgaaaacaatagccaaaaatatggtgctttaacgtgttaaactaatgaagcagacttaaggtctctctctgatcttctccacctccctttctctctgattctctttctgaatgtacagagagggactctctgcaattttttcttttcatttttcttctttttttttttttttaaaaaaaaaaagagttttgctttatcacccaggatggagtgcagtggtgtgatctcagctcactgcaacctctgcctccctgaacctcccacctcagacacccaatttcactgtcaagtagctgggactacaggtctgtaccaccacacctggctaatttttgttattttttgtagagacagggttttgctatgttgccaaggctgacctggaactcctgggctcaagcattcctcctgcctctggcatcaaaagtgttgagattacagccatgaaccactggaattttcttatctgacccaggaaacttctttccaaaagaagtgcagttgtcttaagactccttccctaggaatctcaccaactaaccaggaaagattaaccactggagagaagaaacagggagtcatcaccacacccacacagactattaatctattcttccgagagtagcatggagagattagctgggggacttaatctgcataataagacaacttttgttcacagtgaagttccacccctagccttcccaccaccttccgcagagctcaaaggaactttttcccaggccattgttctttgtgctcattcatttcccctgaaaatcatttactcccacacccatcattctccatctccccttcctctatgataaagaatatataactctcattgggttattgggtaatcattctcatgggatttccctgtgctttggcatgttaaataattttttccccctcagtgatccttgttctgatgttaaataaattttgtatgtctttttctcctattcatctgtctttttttcagtttattttcagtgaaccttcagtggatggagaggaggctttcctccacccctacaggccatatcaatcaaagacatatgctcttctaaattttagaaaattctactattttttttttcttttgagatagggtctcactttgtcatccaggctggagtgcagtggcatgatctcctctcactgcagccttgatatcctgggctcaagcaatcttcccacctaggcccctcaagtagctgggacgacaggtgtgcaccagcatgccagctaatttttgtagagacaggggtttgccatgttgccaaggctagtcttgaactcctgagctcagatctgcccacctttgcttcccaaagtgctggaattacaggtatgagccgccatgcccagccttctactattcttttataacttctattgaggttcagaaaacgataacccaaaatatgatgctttgacattatgagtgctttgagttaaagaaaattgaaagacctaagaaattagccacagaatcaaggtctctttctgacctttccccagcctcatctttctgattctttttctggaagcactgagaagggctttctctagaagtttctttatcatactgaaaaaaacttctgaaggaaacacaattgtcttaaaaccccctcctaggaatttcatcaaataaccaggaaagattaaccactaagagttgtcaccacacctgaacagagttttcatctgtgcttctgaggacagttccaagagattacctaagaaactttatctacataataagacaacctttgttcttgcatagtttcacccctcactttccatgttagtcctatccagctttcaaagataatcatttataaaatagtgtctgcctcccaggttcatatatcactctcctatgaagagaatatttaagcctcaaccatctggcctctctttgagtctcatactttgtgtatggctcctgtgtttatgcatatcaaatgcctttttctcatattaatctgtccatggttagatcattccagcaaaatttcagagtcggtagaaggcaaagttttcctcttcaacactatgcttccttccttttgttttaacatttttctctttttgaaattcctgtcatttagatctcaaatctttatatcacccctttagaacttttatctttttttaaatcatattttacatttcttttcaaatctatacttgggagatttcttcaatttcattatttaaccttattattgttattttggaaaccatatttttaatttcaaaaagctctttcttgttctctgattgtttctttttcataacatcctcttcttgttttgccactgtgacatatttttcttagttttctctaaggtttttagaagtttttgttcatttgtttaatccttttcttccccatgaattatctctatttcctctaaaattatgtttgtctgttggtttatttttcctttttcctattgcagactttcctctcatgtttgtttactcttggcttttcatttctgtttaagactgaggcaataaggaggctgatagaaaatcttaagaacatagggagaacttgtccactgtcagggaatgttgacaataagtcattctttttgttgagggtcctaaaggcaggaatgcagagggcttcactctggacttccaaatcccatgttggctgccctagttctccacaggcagtctatacagtgtcttcagagacacactgtccagtgttttactgaaagaaggtgattgacacctgtctaatctatacaagcgagggtgtcaactgctgcacatatagaactttaatggctttcagccccattttccattactgctatctaggatccttttcatttccagactgaagcacctctcatcttctgtggagagaatcttgatcccttagctgcagctcactccaccctgctgtattagtcagtattcatacatctatttctgtttccaagaaatctgttgaaatctctataaagcagattcctatgttcttctttattgtaggcttatgacattttaattcctgagctagaagattcctgaacttaaattgctgtatggtactctataacatggttgtatgtttaattgtagcaaatgtataaacaatgttatgatgaagatcctggtagctaaatcattacacacatccatgattttttatttagaataaattgtgagaaaaattgctgcattaaaatggaagcagttgtgttttaaaataaattaaacatgcatttaccttagggtccagaaattccactcataagtatttacccaaaagacgtgaaacataattccacacaaagacttgtacacaagtgttcataacaagtttattctatccatgatggctaaagactggaaacaactcaaatattcatcaactgatgaatggataaacaaattgttacacagtggttcctccttatccactgtttcactttctgcagtttcagttacttgcagtcaacttcggtccaaaaatattaagtggaaaattccagaaataaacaatttccaagttttaaattgcatcctgttctgagtagtacgataaaatctcatgctggccaactctgtcctgcccaggatgtgaatcatttctttgtccagcgctgcacactatatacactgcctgtctgttagtcacttaatagccatcttggttatcagattggccctcatggtatcacagtacttgtgttcaaggaatccctgttttacttaatactgcccccaaagtgcaagagtagtgatactagcatattattataattgttctattttactgttagttattgttgttaatctcttactgtgcctagtttgtaaattaaactttatcataggtatgcataatacctatctcagaagaagaaaaatttgaacaaaaatttcatttttacaagaggtccaaaatggctgtaggttaggcatatgggtaatagaagctaggcctacgaattaaagctgaattctcacctgtgaggctggagtttgccaaaattaaaaacaaattattttttaatgtatttgaaatagagatggggtctcactgtgttgtataggctggtcccaaactcctggctgtaagccatcctcccacctcagcctcccaaagtactgggattacaggcataagctgctatgtccagccttcagatatttcactgacatgtacttatggccactttgcctatcagatgaagcacagaggcaggataggatcaatcatccctctccagaacctaagatgcctacatatgcattaaacttttaccctatatacatcaatagcatattttaagaatgtcacctttgcttcactgctccctgttttcattttctgtgttgcaaaacatataaatactgtgcctcctgtacccatctggggacgccttctcagtgttccctgagtttgtttccaagctatagttcttaaacttgggtcagaataaaattaactttgatttctttaagtctatagtgccagttattttaaccttttgggaccacagatggcatagttggcaggattctagcagaattcatggacacccaggactcattctctgggactcagtacttagtaccagaatgaacctattgtgtttgaactgactctggaggagccactgggtatacagggtgagtggcatggaatctggacctctctctttttctggtagaggtctatttcacttttttctgagatatttccagaatcagtaaaaggagtagtaaatcctgggtttgctaaattcttcctatgcttgttattattattctaaattgctaggaaggaagaaaggaaacaggtcaactaagcattgctgcaggttagagtggcggtttctttgatcagccgagtgttttcaaagctcttttgtctggtccaaccctttacattctatatgtgaaccactgagacagaatggctctgaaggtatgggacacttgcttcctacagcctgaatcttgggtattcttaggtgacaaaatcttgtggaggtattgcaggagatccctcatggcatgtaatttggtctcaaagggcttcaccgtcaacagaagaacacttcaattgcaatagatcctgcaggggatgctcataaaggttggtcaccccacatttgaagcacctcactgcttcaacaggtgagcatctcctgagacggagaagattaactctggggtaagagcctgagaagtgaagttcataagcagcacacttttgaccctgaacacgattagttggttgcagacaaaggagaaggagggagtctctttatgtgcacaattggaaggagccggctcaaaaacaaaaagagtggaatagttttttccaggggtatttagaagcttctaaaagagggaatgataaaattgcttccattcagaaggtgggccacaagattttggaaactgtttctctactgcaaaaattgtctgaagtttccactgtctctcactcctcctctgaccattccttcttctgatcctccagaacccttttattctttgctttcaaaactgctggcctagatattcctttactcccacttccataacccacagaagttttgacagcatgcattagagaaaagcctgacccaaggggaaaaccttcagtggcccatactccctggaccaaggcagaacttagagctcttactaaggaatttccagatcctacccaggatcctactggttttacttaggagtttagtctagctgtaagaaattatgaatcttggccatttagctctgtgtcagttggttcacatgttagtatctgaaagaaaagcaagggaatgggtgtcaaaggctgactggaaagatccactaaacaattttcttttttttttttcttttaaagttgagatctgactcagctgcccaggctggagtgcagtggtgtgattatggctcattgcagcctttaactcctgggttcaaatgatcttcccacctcagcctcttgagtacctgggactacaggcacacatcaccacacctggctaattttttttaattttaaactttttttttttttttgagatggagtcttgctctgtcgtcaggctgcagtgcagtggcacaatcccagctcactgcaacctccacctcccaggttcaagccaggttcaggtgattctcctgcctcagcctcctgaggagctgggattacaggcacgtgctgccacacccagctaatttttgtatttttagtagagacggggtttcaccatattggccaggctggtctcaatctcctgacctcatgatctacccatcttggcctcccaaagtgctgggattacagacatgagccactgcgcctggccaattttaaacattttttgtggagataaggtcttactatgttgccttactatatatgccttactatgttactactggtctctaactcttggcctcaaatgattctcctgcattggcctcccaagtcgctgggattataggcgtgagccaccacacccagcctgagaaactgtcttcataaacaaacagctgcagaccaagcaaaagcttgagaactgacaaaccatttagcctaaacaattcgcctgatatttcctaagacctctgactggtctaaagtccagcaatgtaaacaaaaaccaaacaagatcgtgctggattactttgaaagatttgaaaagggttttagacaatatttggaaatgaatgaagaaagtctaaggaatcatcagaatgattctattttaattttaaccttcttttagagattggatgagcaattggccaaggtggtcaaaatgcaccaaataaattgggattctgtgcacactttggaactagtgaaacttgcgataaattggccagttatacagaataagaaagacaacgaagccgctaaaatcatgaatttacagattcaacaacttactgctcagtttacctgatctaaacagaggccttgctttcaaaagaagcctcagaaacatctaaagatgtttgttgttattgcaagaaaacaagacatctaaagaaaaattgcagaatactgaaatgggcatagaaacaaaaggaagaaaaggaaaagaggaatacgggctccgagggaatcaagagggctttcccttttcttttgcaatactctgcgggaagtggaactatgtataaatagagaataaacgaaagcattagttgacatgggagctaccctttctgttctcaaccctacctttttaaagagtgttcttcctcagcgtaatcaaacagttcaaatgatagggatatatactcaaccagtgactacatacaaatcagaatctctgcctttccaatagggaaatttagatgaacatccttcttttctttggagccttctacaccgatacatcttatgggaggagattttctagaactttatagtgctcatacttctttttcagaaagaagaaaaatattttaaaaaaataactgaaagaggattgattcaaaattataaatcagaaaattcagagcagataatcatccaaattcagtcatcaaatattaagacaaataaagaacttgatgcttgctttccttcttatttatttatttatttatttatttagagacagagtctcactctgtcacccaggctggagtgcagtggcacaatctcagctcactgcaacctctgcctcccgggtttaaccaattctcctccctcagcctccaaactagctgggattacaggtgcacaccaccacgcccagctaatttttttgtatttttaatagagacagggtttcaccatgttggccaggcttgtttcgaactcctgacctcaagggatctgcccaccttggcctcccaaggtgctaggattacagatgtgagccaccatgcccagccatcttgatgctttattaagccaaatccctaattatttatggtctgaatcatccaccaatgtcataaaaatcttaacagctaccccaatatggatatgaatggatccaaataaaccacttccatgtccaaatattaaacaataacaggaagcgataatagaaataaaatcaataatcaaatattttattgataaaggatggattatctcttccaccagtccttgtaatactcccatcctcccagcatgaaaatctaataggaaggaatggaggtttatacaagattagagaaccattaacaagattgtgattccccatcattcagtagtcccaaatccctacacactcctttatttaacataccagtaggcagtgaatttcactaactgatttatgcagtgctttttgtttattagcataccagtaggtcctgacagtcaatatttgtttgcctttacctggaacagctgtcaatatacctggactgttatgcctcaaggttatactggaagcccaactatttttcaaaatattaagggctgagatggctgagctaaattttgaggaaattccactctagttcagtatgtggatgatctcttgttatgcttttccattcttcatgattgtaaaaaacacaccctgtaattgctggaacaattagctgaaacaagacataagttatctaaagaaaaattccaatattgcttaacagaaataaaacatttgggaaatttaatttctaaggaggaaatacatataaattcagataaagtaactggaatttttgcatacccaactccaaagactgaaagacagcttaggagtgttttaggcttagctggctactgacacagttagttacccaatttttctttcatggaacagtctttacatgcattgttgaaagatcaacctgaccccatacattggatatcctaagaacaaataactattcagtaaataaaggaaaatcttacaagggcgcctgctttgagccatccaaattatcagctaccatttttgttctttgtttatggaagccatggcatcatcctgggtgttccagccccaaaacacgggggaaaatatagacctgttggctctgatagtcagcaatagactctatagctcacgggctgcccccttgttggagggccatttcaggcattatcatatttctcaaggctactcaggaaactaatggaggctcccttgactatatatgtacttcattctgcagaagcttttttgaattcacatcatacacaatatttttctgtcaactgattggctttattacaatgtacttttactctctgctccacacattaccctctcttgctgtaatactcttaatctcacaagttacttcttgaagcaactgaggagattacctcatgactgtatggaacagcatacagtctgtatgctgtatagttctattactaatagaacagcttttgatgcccagtcagaatttgcaggagataccactacaaaatgctgatgttacctggttcacagatggatcatatctaaaggataagtttgaaaaataccaaacaagctatgtcgttgtgtctcatgtagacatcatagagagcaatttcttgcctaaagtaaagtcagcacagttggctggattaatagtactcaccagaggttgtctaactggccaaaaatcaaataactaatatttatactgacagccattacacttttggtgcagctcatgtctttggaatgttatggaaacagcgaggttatttaacctcctctggacatcctattaaacatggctctcaagtttctgatcttctggaagccatccagttaccaaaaaaaattggctattgttaagagtcttggacattccaaacatgactccctggagtgaaggagataattttgctgatgctgagcaaaaaaaataaaaataaaaattagcttaatgctaatatcaaatgaaactgtagagatggccatgtttaaagtgaaggggctcaagaaaaggctccaaagcggaaaaagcaaatatgactaagggagaatgcttttcccccaacttgcaaaatataatatagacccagtgacaggaaagcacatccctattttgcctttgggatatcaatttcctatattacagcatgtccatgaactcattcactggggacttgagaaaatatttgcctggggaaaacactattactggaaaccctcacccacagtagttcataaggtttgtgctaaatgtccaatttgtcctatatataatccaggaaagcctcttctagatctcaagggcatttacctttgcccaccggccctttcaatatttgacaaatggattttatccacttacctccagctcagggttataaatatgtattggttatgatttatatgttctctcattgggttgaagaatttccttgagacagtaggaaaatgtttgttggaatggataatttccttttgaggaattctttccaaattacatagaaatagggaactcatttcactgaacagataattcacttaatttgtataatctggcctattttccaatatttttattgtacataccatgcccagtcttctgattggtagaatgaatatatcaaaaataaaacccagctagaaaattatcgaaagcttttcctattacttggccccaggctcttccactggttttgcttaacctaagagcagctccttctggaataatatgtcaattatcccatgagataattacaggttgacctatgaaagtaaatggcagtttatatgaaccaactttactgaaaggagatatactccattattaacaaagcttaactaaacttcttttccaaacaaactaaattgtaaaaagagccttaaatgcaatagaggcaggacttgggacattaagacaagttgagaatgtatttaatgaagaaagacatttacaagaaaagttgatacttaccaacctaagtagaataaaaagcatactctttcagaaggaaagtgagggttgagaagctgcatggaaagataatgatgctattgctaaatgggtgaatcaaactgcctggctaacgagggactatgccaaagcccaacaatcagaaaaagcatgggttcaaattcaacaaggttattgaccatgctaatccaaatggaagcagaagtggcctctaaaacgtggccagtcgttttggatgcagaagcacaaggtatacatttatggaaaacatatgggccctcttcttcctggaaaattgctaccagggtacacagcctgtactcttagggcttcagcaacccacatatacagtaaccagaaatataatgcagtatagctagtggaaattgggatcatttttaataatacccgtgttctcccaacaggcagttgatggaaccatactaaataataatatttggaatccaatttcagttttagattgcaaacaaattcaggaagaattgttctgtccccagaacatctggaatcctgaaatcatggaaacatggttcctaatttttacccctattcaaaataatatataggaaatggatatttttgtttggaagcgaagacaaataagactataagtgttggggaggagccaagatggccgaataggaacagctccagtctacagctcccagcgtgagcgacgcagaagacaggtgatttctgcatttccatctgaggtaccgggttcatctcactagggagtgccagacagtgggcgcaggccagtgtgtgcgcgcaccgtgcgcgagccgaagcagggggaggcattgcctcacctgggaagcgcaaggggtcagggagttccctttccgagtcaaagaaaggggtgacggacgcacctggaaaatcaggtcactcccacccgaatattgcgcttttcagaccggcttaaaaaacggcgcaccacgagactatatcccacacctggctcagagggtcctacacccacggaatctcgctgattgctagcacagcagtctgagatcaaactgcaaggcggcaacgaggctgggggaggggcgcccgccattgcccaggcttgcttaggtaaacaaagcagccaggaagctcgaactgggtggagcccaccatagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaaagcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagcaatggaagatgaaatgaatcaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaaggtactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaaggaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatttaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttaaactcccacacattaataatgggagactttaacaccccactgtcaacattagacagatcaacgagacagaaagtcaacaaggatacccaggaaatgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactgaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataaccggctctgaaattgtggcaataatcaatagtttaccaaccaaaaagagtccaggaccagatggattcacagccgaattctaccagaggtgcaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcaccccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatcccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacacttggtgggactgtaaactagttcaaccattgtggaagtcagtgtggcgattcctcagggatctagaactagaaataccatttgacccagccatcccaatactgggtatatacccaaatgactataaatcatgctgctataaagacacatgcacacgtatgtttattgcggcattattcacaataacaaagacttggaacaaacccaaatgtccaacaatgatagactggattaagaaaatgtggcacatgtacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcacaccagcatggcacatgtatacatatgtaactaacctgcacaatgtgcacatgtaccctaaaacttaaagtataattaaaaaaaaaaaaattaagaaaaaaaaaaaatgaatacaaaaaaaaaaaaagactataagtgttttagatcttacatgaaagcagacagtatttgatttaaattatactgccatttagtgcactactggattcataggaaagctacctttaggacagaataacccatataataatgaggacactgataatcaaatatttttgggaattggaactcaaccctcttcaagttgtactcccagcagaaaatgaatggtaagttaagcaattagatattataaatcatcagttaattacagttctggataaatcaactcacatatataaaaaagtacatatataagcaaagggagagggatgattattctattaagcacaaactatcaaaatgtatgttcagggtttttttctataatatgttatttcttttcttcattgtctttagccaaatgaacctctcggttgttcactgtattgtttattatttttctaatatttctgttacaaatgttataaatgctgcagaaattgcaaatttcatagaaagaacagaattccagctaaaattatgttagttcatcaatttgaactaatagccatagaatgtaagtaaaggcagtcttctatggcccattttgtcccacacactccctcctctacttctgaccaaatggggaagggcttcccattaacttttgtttagccctaaagtcccaaggcttacaaaaggacatcaagctggatattcttccacctgactcctcaaggtccctcaccagtatgactgactgtgcaatggatcattgcctctaaagaatctctcctaaggaaataatcctaattgcaatcctgatcttgtttctccctatgctaatgaggatacattagcataaaacaaggggctttggcattccagaaggaaaaataggagcctctgcatcttcactggaaaaccagatgatggcacttcatgtaggggtgaacaatagcgtaaggacatttcagaattctgatttgatcctgtatgccctatcattctaaacaaatgagacctgttctcttcaaatttcttattatttggtcttcccaccccaccccaagttacagccacagtgattagtttggtgtttgttcttccagattatctaataaatatactaatacgtatctgtgcatacaatttttgtggatgtggaatgttactacatacatattcttgcaacttgactataacatttttaaggtttttagctcctacaaagggccattgctttcccccatagggagggcttagcaaagaaccctacatataataggtctttacatgttagattcagtgtctttctttgctggtgagcatttcctctcacaccaaaagacagtattttaataggttgggtgtagtggcttgtgcctgtaatcccaacactttgggaggctgaggagggaggattgcttgaagccacacgttagagaccagcctggccaacaattttacatatttttttaattagctgggtgctaaattttagtagttccagctacttgggaggctgagacaggagaattgcttgagcccaggagtaagaggttatagtgagctaggatcgcaccactccactctagcctgagtgacagatcatttctcaaaaaagagagaaagatagaggaagaaaaaataaaggaagggagggaggaagggagggaatattttaacatttgctggtattatttttactaaaatcacacattctctaacttttagcctaagttcttgtagcctaaattccttctactactgaaaggaaagcaggactcagtgggactctgggtggtagttgggactgagcagtgacttggcatggattaaggatgcccaaacagtgcccaaaaaatgaagttataggaatatttgagcagggagtggcaatggtctatctctgccagccagaagaggctccagcccccacagtcatctcagattaacagcagatttctcagcagaaaccttacaagccaatgggatcggggtccaatctttagcctccttaaacaaaataattgtcagccaagaattttagatccagcaaaactaagcttcatacctgaaggaaagataaagtcttttttcagacaaacaaatgctgaaagaatttgccactaccaaaccactgctataagaaatgctaaaaggagttctaagtcttggaacaaaacctcacaatacaccaaaatagaatctccttaaagcataaatctcacagggcctataaaacaataacacaatgaaaaataacagggtatttaggcactaaataacataatgaatagaacagtacctcacttctcaatactaatgttgaatggagaagttctaaaagctccacttaaaagatacagaatggcagaatggataaaacttcatcaaccaaggatctactgacttcaagagactcacctaatacataaggactcacataaagaggtggaaaaagacattccacagaaatagaaaccaagagcaagcaagcaggagtagctattcttatatcagacaaaacagactttaaagcaacaaaagtaaaaaaagacaaagaaggacattatataatgataaaaggattagtccaacaggaagacattacattcctaaatatacatgcacctaacactggagctcccaaatttataaaacaattactactagacctaagaaatgagatagatggcaacacaataatagtgagggacttcaatactccactgacagcactagacaggtcattaagacagagcgtcaacaaaggaacaatggatttaaactacaccctagaacaaatggacttaacagatatttacagaacattctacccaacaactgaagaatatatattcttctcatcagcacgtggaacattctccaagatagaccatatgataggccacaaaacaattctcaataaatttaagaaaattgaaatcatatcaagtatcttctcagaccacagtggaataaaactggaaataaactccaaaaggaactctcaaaacaatgcagatacatgaaaattaaataatctgcgcttgaatgatctttgagttaacaatgaaatcaagacggaaattaaaaaattttttgagctgaatgatgttagtgacacaacttatcaaaacctttgggaaacagcaaaagtggtgctaagaggaaagttcgtagcattaaatccctacatcaaaaagtttgaaagggcacaaatagacaatctaatgtcacaccttaaggaactagagaaacaagaacaaaccaaacccaaacccagcagaataaaagaaattaacaaagatcagagcagaactaaatgattattcctcttaagttttcacccaccatctgtctcagatgccccttttcctccattccttcaagcttaatgccaagcccactatatccagtcattggggacacagggcctctgtcagctgagaattgaaaccctgctccctcccctgacaagacacggactgcttaaatgttaaactatgagcatttctttaagaaataaactgcaggagaaatgtcttaaaggattacatggaagatgtgtgaagtatagatctctaaacttagaaacaatcagtgattcttaggtgcaaaagaatcatctggaaagtgactgaaaaatgcagcttcccaggccccattctaaggcagttagctgcaggggacagtgtgaaaaatcacagttggaggaacattggcccagatgatccactaaaatgcttagtcttcacacttaaaaagagtttggagcaatgctacactcagctatggaagggttaccactccttcctcagcctgatgtcaggttcaaattaagcttcagattgtccatttcccctgctatttgtctcagtgagttctctctcagccttggaaacctggaaggaaaacaccttttccttttaacttaaaaattttggtatctgtgcttttggaggttctgaattgatcttgggcctttctttggccttccaggagtgtctctggctacaaattcaacatttgatcctgttccccttatctatttctgtgtaaaaagtcactcctaagcttagtgacttaaagcaatgacattcatttattttgattatgaatctgtaatttaggcaagactgagcaggaatggctttgtctctgctctccatggtctcagctggggctacttaaatgggagctggaggacccactttcgagatagtttactcacatagctagccagttagagctagcttttggctaagagcccagctaagtgtgtgagctgggtgctttggttcctgtcaacatggtcctctgcactccacaggggccttgggctccctcatagtattgaggctgggttacaggtatgagcattcccagggagcaaggcagaaatgcatggcactttttttttttttttttttttttttttgagacggagtctcgctctgacgcccaggcgggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtcttgatctcctgacctcatgatccgcccgcctcggcctcccaaagtgctgggattacaggcgtgagccaccgcgcccggccggcacttttatgacttactagctttggaagtcacatcgtataatttccactatactattgtttcaggaattcataaagtcccactcagattcaggggaggaaaagtaacctccaccatttgatagaaaaagtgtcatggttaccttataaaaatagcatgtggatgggaaatgttattgcagccatctttggaaagtacaacctgtcaccagaccctgacctattttgtattatatctgtgggtttttcttaaaagcattaatgatgcatattcactagttaattattgttggttctattccatctcattttatccttctcacaatcctgtgatatagctagatctttttgtatacatccaaatatggttcacagacatgtttggtatagctagcacattattttaaaaattgtgaattcttacgtatttgaatttctggcttctcttcacaatcataagattggataaacctaggccaagctttcctcctatcagcagtgagctggagctgagtagtggtggttcccttagtaaaaccctgtcttctgtttgctgcagtccccaccactccctgttaccacttaactcattacattttatgtctgacaagcatttgactttgaggttttccaccttagaaaaaataggcccagattctactatggaaaattgtaatagcctacccttcatttggtgtttccaaagtacttgctatagaaagctacattttggggtttcttttttaatcctctctctcatttggggagaccatcaggttgctgtttcttgtttgaaggacaccttcagctgtccactgactgaaatgaatgatatgccccaactcccagaatggcccagctgcccagttctagcccttcccttccaggctggcccttttggggatccccaaggtggagcagaactctccttaatcccttaaatttgctcttttcactgcctgaccaacattggatccttataacttggaattctcaacaggagtaagggaagctcatacagggagcaccaacgtcaaagtttcctaacaccacaatcttgcctagagctaagtctgcacacaaagacctcctctctggaagataagtgcccagtgttcatccactgttcagaaccaattctcaatattcctaatgtcacaatgctcgctttgtcctttcaaaggctcttgattttgtttccaaaatgtcaacagataactctaagtgttgattaaacaagcaagagcattgcctagggagagcatttggctgcgcagtcttcatcaagcccactagagaagctccagcctgcacagaaaggacagtctgggcctgactaggcaactctatcagataatcaggacactttcttcccctttggctcttgggtttttctttagctctttcatgctgggggaactgctcaccctcagcactgctggcacttaggagtaggaaaggtctgtggttttactcctcttaaccttctgagtagtctctgccaccaaattaggacattctggggcaggcagttcccccacttgatcctgctccatcacattccctgtcctcacctcatcaataaccataatcctaaattttaggtttattcccttactgttcattagagattttactatctattctggatatctgttgcttaacaaaatgccccaaaatttagtggtgtcaatctttttttttttttttttctttacagatccattatttgggcaggattctgtagggaaaactcatcaccacttcatatagcatcagccatgcggctcaactgagggctgttggatccacttctaagatgactcactgctggctggctgttaatgctgggttgaggccctggggccttggtttgtctccacattggcctctccattaggcctggacttcctcacaaaatggtggatgagttctaagggtaaacatcgcaagagagaaaaccagacaagagagcaaaacttgccttttgtgacctagcctcagaaatcacatagtgtctattaattgaagcagtcccaaagtcccacctgggttcaaggggaggagatactgactacactgtccttgatgggagggtggtaagattctggaagagagatgggaccagaaatgttgttgcagccattttggggaagtgcaatctaccacaacgcatatgtatgtactcctaggcaatatgctatttaattttgcatgttttacgctttatagaaacatccatactgaatatgtttttctacaactttgttccctcaacatttatgagtcgcttatatttttggagttcatttatttttagaattgtataatatttcattgcaattatttgctacaatttagttctctgttattttggtgaatgtttgtgctctttctatatgtttccaaccctttttttctatatatttatgctttttgctattttgtacagctgctctgaacattctcatagaactttgcacatgagcctagggcaagaattatcaaccagtgtgatttttagcaatgtcagaggcatttagcaaatgtcctacacattttttatttttatgactggagtaggaagcgttggtactgacatctggcaggtagaggctatggatgttgctaaatatcctacaggaaagccccctataacgattagctggtccaacatgtcaatagtgctgagattgaaaaatcctagcttagggtatatatggaggagtagaattctcactcaatgataggatattcacagtttcaactttattatataatactaaattgtttacccaagtggttgagcaagtctatactcctaccaaagggaggctccacatcctctgatattgtcaatcttcttagattttgccagttcatgtttttttccttctgaaatgcacatttgtgtgctttgtccatttttatagagtaaatgtttataggattgatttgtaggcattatttatatattctggatactaattctttgttggttgtatgtgttgaaaatatctcctcccagtctgtggcttatcctctcacttcttcctggttcttttgatgaacagatgttcttaagcttcatgtagttaaatccatcaatcgtatactatccatcaggcttgtgatttagggtcattatttaagaaagaatgtcctgccctgaggttatcattgcttcccaagcctggcagcattttggggttttatcttttccagctggcaagacctggagttcctcttgctgaccccagaggtgcctggccttccttatcctccactgtttgctcagtccttatgaacactcagattgtatttcctaatgtactccattttctctgttgggctctttctacaacctctgtagccctctctacccaggactggactctactgtctcgggactggcctcaaaatgaactgacttctctggaaccacagtgccccacttagtatcagcactgctgaagatgtcccttagagattagccatggcaggattgagccccagttttctaaagtacttggatggtttcatttgcactcatgtggggtattctcctctagggctaaaatcaaaaatggggcaaagctgaagatgccaagtggtccccaggaacattactgctcacaggagggacaccccaagatgagcatatctgctctgaccacataccttctagccaggcctatctacccagggcccctcagaaccgaccatgattaaaggacagccttggtgtgatctgctccatccagggaaatcattcagagttaattttgcttccttttccctccattccggttctgtccacatcctgacttctgatatgtcctcccttctggatccttctcccatcctttagacttcacattgatctgggtttccctggctttgacactcagtaagggctttgggcaaaacccaccttttggttccagcagctcctgtttgccccaagaaaggcaccttatcctagctcaagtcatgatgacccaaacccaaggacctagataaagttgaagagatatgattccaggtgcctaatctgaacagttgtcgagcttgggagaagataaatcttaaagtggggaacagggagaaggtaaaagtaagaatctaaaaacccaaacagcaggaagagataggaaagtagacaggcataggaggatttgagaacccaaaatgtatgcctatgatgcagagccagcatgggaggcattataatggctgagaacttgggctttgtagataggcaaggatctcctcaccttactagttgtgcgacctcaggcaggttatcctcccagagccctgttttcatcatctgtaaagtagggctggtgtaataacttgctcaattgtatgaagattaaatgataagtatgtaaagcatttgcatagtattttacactatgttcaaaatgatgggcattatcaatattaattgatgttaatattaatattcatggactaatgaacagaggacccgctgcccggttcctttatggctgttctggcacacactgagggtcagcaaattacggcctgtgtatcaaatccaggttgttggccatgtggcccatgagctaaaagtggtttttacatttgtaaatggttgaaaaaaatcaaaagaagagtattatttcatgtgtgaaaataacatgaaattcaaatttcagtgtccatagagttttactggaacatagccatggttgtttcttttgtattgtcttattttctgcctctccaagaaagcttgctgactcctggcataggccaagtggactaggggcaggtgctttagtcagctggaccttggagaactgggcaatctcctccactccacagctctatacatggtggctgcccttcttttcctactggccctcccctggggttccagagtaccttttgttcaagccagccccacttgacccagggcactgggatctagatttctgaacaatgagccaaatcattgcagaatcatagggggaatcaggacaaggctgttttgagattaaaatgaaataaaatatgtgaaagtactttgtaaatgcaaaggatgttattatttagcaagtaatggttaaggggtatcagtgaggttttttactcttcttagtaaatttagtaatgtatgttatgttcacttttaacaaaatgtattattaaccagaataccctaatttctgtccagatcaaaaaagattttaaaccaaatgaaaccatccacaatgcatgtcaaacgcacccccaaaatggagttttgagcttctagccctttctgcaaagaaaatcctggctcctccatcttgttttttttttttttcctctcctcttcacttcctgtttaccatctccattttcttttccagtctctgtgcctgtgctttgggccacttgattgctttgggtggccagagtagagagcagatgaatgtcattgtgtttgaagaagccaaggaaatgtgacagaagagttttaagagaatcatcagcccagtgtagacatttcaagtgatgttaagagttggagtggaagaaacattatgagtcaattcctcagtcactattatgggataaccaggatttggtaggaaaagcagaaggaagaggtagatggcataagaatcaaagatcatttgtacaaaggagagttgagcaaagtatcaggggagctaggacaatgctgatcgcttctgagtccccacaggatgtgggaaaatgagcagccttccatgaaaaaggtggcaaaggaaggccacagaggagtcctgtaagggaacagaaaagaaaaggctgaggtttgggtgttgtctaccttaagcaggccctgagggtgggagggaattccaggagcagtgggggatgaggtcagtgggaaggaggttggaaacaatgtgggtttgaggatgagaagacatgtcctgaggggtttaccttttgggtggaggccaagggcaacaggaaccggagtcacctaggattagctggtcccaaattgtaaatgaagcactggggtcatgttgttcacatcctgggattgggggaggagggaagaggtgggcatgagaggccctgctgggctggaggtgggtattgcagctgccacataccattcccttgctgcaaaatcctttagcagaatgtctgctatccaggagtacgtgcattgttaagtttgttctcatttcctgaacaacttacgcactaagcaattacttaaagcgctgaaggaagaggctcaggtttctaatgacattctgtcaacatgactaatgctaccctggaacacccttcccctaggtatctgcatggctcactttctttttcaaccaagtttccctcaaagaggggtcttctctgatcccaatacccaaatagccctactcatcactcactatcctcttgccatgctttatttttcttcattttacttatgtccaccgactcatccttatttgtttattagttggtacctgtcattctcactagaatgtaagccacatgaggttaggagtttccttttgttctctaccctattctccactgctgaaaatagtgcctggcatacaacacagctcaataaacagctgtgggcaaatgaatgaatgaatgacttggccctggccaagtcattggacctcaggaatggcatctttcaattagaagttgttgctactctaacgattttgttaatcattaggtggcctatcttcaccatgcttcctatacaaaagtgaattgcctaaaactcagcatcggcgcttctccctcaaagttttagacaataaactctgactgtttgaaactcagctgtttgccttcaccactcctcctcccatcttgcctcctcccatcctcctcaactgctttttctgatgttggccaagatatcagaacctgagattagtatcagaaaattgagctcctaccatgaccccacaccaaagcttgaggctttcaataacaaagacagacaccctcctttctccaagagcctatatattgtgagggaattgataattaaatatgtgattgtataatggtttaatgagaaccacaacaggggaggtgctaccttcagaaaggcttccctcgagaaatgatacctgagtattaaactgcaggatgagtaggattcagctgagcaaagaagggttggagaaaagtagacagcagggaaaatccctgatcctagagaagtgggtcttgttggaggagccagaactggcaggtggctgggaacccagtaggaggtgtgagtagtgggtaaaaccagggctgcaacaagcgttagaaacagattatcctaaggcaaaaataactccctttcactgctgctgctggtttggttggcaaaaggaaaaaaaaaaggactccatgattttagtaatcagattgctggtaataatattggtattattattctgatactattcactatatatataataggatagagcaaataagtaattaggctaatgttgatagaaaccaagattcttcaccataagagatgcaaatataaaatttttaaaattgtaaaaattctgtaattttaaatttgaataaaatatattagtgtaaactaatgatacattttcttatcttaaatctgtttcctatctctgaccactattaaggcctagaaacaatgaccagtcaaatgcagtccatgcccctagtaccggtttgtagtctctaaattatgcttcccaccaaatggaaccagggtttatttcagaaatggatggtccagaggaggaattgcatatgatgaagcttaaacaccatgatataccagatagtgagggaagtgtcagagatccctggggtcatgtcaacaggactcagaagtcaacttgtcaaggctctcactggccacaaatgggacaatgttaatatgaataagaataactaaaaaggactgaaatccacatgaattctgttggaaattcacaagtttataatgatgttcaaaaaagaaaaataaagaccattgttcacctttggataatactggggaaccaactcattattctgaaaacaggaaagcaaagcaaaggaatctacatttgccatataaattgaacctcagggtaaccaaatagtggagaagggaatgtttctttctataggagtattccagccaataatttagaagaaatattgggccaggtgtggtggctcatgcctgtaatcccagcactctgagaggccaaggcaggaggattgtttgagcccaggagtttgccaccagcctgggcaacctagcgagacccccatctctacaaaaaaaaattttaaattagccaggcacagtggtgcatgcccgtggaggaggaggaggaggaagaggagaaggaaagaagaagaggaagaggtggaggaggaggaggtggaggaagaggaaggaggaggaggaagaagaggaggaggaagaggaggaggaggaagaggaggaggaggaagaggaggaggaagaggaggaggaagaggaagaagaggaagaagaagaggaggaagaagaagaagaggaggaagaagaaagcagaagaaatattatttgcaagctcttaaataaataataattctgggtatcaataattgtattagtttcctatggctgccataacaatgtaccacaaaccaggtggcttaaaacaacagaaatttattgtctcgcagctctggaggctgaaatcagaaatcaaaatactgacagggctgtgttcctctgaagcctctagaaaagaattcttccttttgtttgccagcaagcaatcctcagcattcctctgcttgtagaaccatcactcccttctctgcctccatggtcacatggctgtcttctccctgtgtctatctgtgttcaaattgtcctcttataaggactgaatcaaggcccaccctaatccagtatgacctcattttaacctgattccatctgtaagaaccctgtttccaaatgaggtcacgatcacaggcacagcgttggtgggtaaatgttcaacatatccttttggggaacatagttcaacccgtaataatcatcaagggcagcctagatcacaaataggaagacataagactttattttctggcagagcataccacctattggcaaagaattagacataaatcagagtaagtctagatctacctaccaatttacaggaagtagagagtacaaaaaggcatgttaaaaaataccacaggcagtagaatcagcaagatccagaatgtgggaaactctacaggactaataacttggtttcttcaacaaataaattgcaaggaaattccaggagagagctctgtaaattataataaaatggacataatagacgtaacaaccaaatacaatatatagattttgtttgaaaatttgaatacttactagatatttaataaaataatggcttatcgacagtttaaaaaacttaattatattgtggtaatgtttacaaaggggagagtctttaacttacagtagtacatttccgcagataaaatggcatgtttgggggtgggaagacagtagggcgtgggttggctatgaaacaaagttagccaagttaattaatgaaacttggtggtggggacatgggggttcattatattattatctctgcttcatatgcggacattttctatcctataaaattagaaagaattaacatgcagtatgtttagttaatgcttctcagcttgggaagtatcagaacctaccagatactgctgaggatacctccctccctcagcctcattgagatcttctattctagatactttcctaggaaattgagtttctcttttcaaacttattcactgcagcttgattgctgatggaaaccttttgtttgctggaagctactggctagctgacgagaatacttttcattaggcaagaaaggaatttttcaaaaccccttttattataaaagtcctaggtacatacagagtcaaaaagaaaattcaaaaagtgcagaaaaattaagatcactcctccccagttctacttcctggagtcttcactgcttcaagtttcttgtgaattgctccagacatttttctaagcatatacaaaaataagcatgatttggacctttctgtaagcctaagtatgtttgcaacttcgctttttttccacccagcaatatatcttagagacattttcatagcagcaaatacacatcctcctcttttttattccattatgtggaaaatcgtatttatttcaaattggtccctgaatggcaggcactttttttccagtgatttcctcttagagataatgctgccatgcaccttcttgaacacatatagaaaatgaattttttaaaaaatatgcatctcttaaaaaagcccttcctttcagctcaggacaggaagtgccctatgatatgaagcaagcacacaacaaacctcctggacctgtccgcatcacactgtgactcaccagccgcgcgcgtgctgggcaggtagaggctggagcggtcaggagcatgcctggctcctggtgcctctctatggagagcacctctgtgcctctctgagagcactcacagccaaaagtacacagctgcccccaggctgagagtgcttgatacacccttgaatcccctcttatatgatgccccagcccaggagagataaaagcatcagcaccatgagattcacctgcctctggtcgttaggtaagttcacaggcactagcgttgaaagattctaggactgagggatgttaaactcaattaaatttacctggacgcagcaattgcttagctggtggtgtgtccaagttaagaaactaaaatgctaatgtgtagcaccagtgcctctgatggcttagtggcttctctgaaagtgggtaaccagagtaagattttattttagcttactttttagcttactctattttgtttaaaaatgtggtttgtgtttaatcctctggaagtcctctgtgtcagcatggcttttctttcctgctgtgtgggactttatacaagacatctcttgccagattttggaattccctggcaaggaagagaggcaatttgagtaacctggccacagacaaatacatttcacttcagcaaagcttttcagatgtcattgaagatgtgtgagaaaccagatagaaagctatagaaaatgctctttgaaaaagtattccctcattgactgcttagtgaagctcttgccatacgatctcctgaatgggatagataacttcaggtcgttgctttgccaaggagaggtttgttagaccatagggacagggcttgggtgatggtcaactgtctcagtacaggctatgtggggcctcctttacagcttcaacaataagtatcaaggctagggtcaaaatgtacatagtttggtttgcttgtcttttttttttttttttgaaacagaatctcgctctgttgatcaggctggagtgcagtggtccgatctcggctcactgcaacctctgcctcctgggttcaagcgattctcctgcctcagactcctgagtggctgggactacaggtgcacgccaccacgcccggctaatttttgtatttttagcagaggcaaggtttcaccatgttgaccaggatggtctcgatctcctgacctcatcatccacccacctcggcctcccaaaagtgctgggattacaggcatgagccactgtgccctgctgcttgtcctttttaaaataatgctcatgtgcctgtttgaaaagtcaatgctggcttacgtagtttctccctgaagagtatattttggagttactcctgattgctcttaacttcctttgtgaaatgtggccaattgatagttattcgaagacaagcatatgcttactttaaagggaccaacaaagttcttgatcatctgacaactttgttgtttcaataacagcatttggcttacaaataaggctactcagaaatcaccattttagtgggacttgaggaggggattcaagtagggaatagagaaggagttgagtaaaagtcctgaggccaacacaagagatgcaggatgagctggctagaaggagaaggctgttctgttttttatttttaaaaaaaggagcattaatataaagaaaacataagaaaaaaagagctaatggaggtgtggtggctggggtgggggaatggactaacctaagaggtcctggtcaggctgggacagagctttggacacagttcactgctgattcccagcaccatgtggaaatccagtcctatactttataggcactgggcactagctgattgtgcaactggaacctggtctaagactttcatgagcagggtccaatcaccaggtttcatggggctatggaaataaatcctgaccagagatcaagtggattaggacccaggagacaggcactgattcttaggaaatcatccagggaagctttctgtctgcccccctccccttcccacctgcacaggggtgtcccatttcctgtccagtctccctaaacagcatttatgttctgaactagttcagctccatagagaagcttttgttaagcattcattagcttgtaagatttttttttcacctatgaaattctctcaagtcttttgacattgtcaagtgccacaatgattggtttgaacaactgtgactttcagctgcctgaagacttgtaatgccatccctgtggattgtagattcaaacgcaggcatcttttagtcaacaggaggaaacatgagaaagggacgtagggtcctctctccctgcctttggggtctgcaagctaaaacctgtttttccaactaacctatcaatcttctagtcaatcttgattctagttcctgtaaacagatcaatttcctagagagacagaataccagggtgcctggtttaggagtcagaaaatctgggttcagtattgtccctaccaccaatgactatccatggcccttcagcaaatctttcagtacttccccttaagtaaaaaagaagaggttgatggccgggtgtggtggctcacacctgtagtcccagcactttgggaggctgaggtgggcggatcaagaggtcaagagatagagaccatccttgtcaacatggtgaaaccccatctctgttaaaaatacaaaaattagctgggcgtggtggcgcattcctgtagttccagctactcaggaggctgaggacaggagaattgcttaaacccggcaggtgcaggttgcaatgagccaagatcacgccactgcactccagccttggggacagagtgagattccatctcaaaaaaacaataaataaagaaaacagaaagaaaaaaagaaaaagttggatcaagatgcacaaagatttcaataccccaaaaggaagagctgaaactaacaagattagatttaaaacagttagttgcagagatagatgctgggaaagagctaaccctgctattcctatagaaaaggctctgttgcccagagctgaatgtgaaacaagagtgagctatggctgctggtatagctcaccatcactggcagcattgatagaagctaggaggttagaggcctgctttactgtgccctggtctggccatggcatatcctgcccccagtctcacatttgcctccaatcctctctccaacttgtagtcagagtgatttttcttaaaatccaaatttgattgtgtcactctcctgcttaaaagccttcagtggctttccattgccctcagcatagaatctcatacaatgtcccttgtgatttggcccctgctgacgtctccagactatctcttgtactccactgatccatgaccctcacctctgatgaggctagaacaaatcatatttcacttgttccctttgaaatgcctagccttccgttgacattatgagaggtgtaataactcaccttcttgccaagggctgccaggaggaagtgggatatgatttgctctggccacagcagagggcacaaatagtatctctggtgggagggagatggacatggtgcaatcttagaagcagctttggaaaatgctatgatgtgctatatttgggtacatttggtagaggaagggtgtattgtggagaagggatagcttcctggtgacccaaggagcaatctggccctaaaaggcctcagcaccttctcaggaatgtggttggaaggattcttgtgttgcgtgaggtgttcatatagataaaatattaaagatcctgcagagtatggattctaagatctgcaggtccctgacagctctaaaacatcacacaatttagaaaactaaacagacattctaacttatgacttattttccttagcagcttctaggtatttacctattccaaatctgcccttgatgcctggttcacttcattgttccactgggaaaggaaaaagagacatagagacgttatataacttgttgtagtttttgcaggtaataataagaggcagagtcttaataggaaacagaactctcagttcctaggcactaaagcagatgcttttccaggtccttgatgacttcatgtgccaagttgccctatgtcgtgtctcttaccatttacaattcatgcctgaattccatgtataaaattcaagaacacaactctgacagggtggctgtgggtatgggctctggaattagattgcctgtgtaacctcagaaaaagtcacttaattttgctgtttctcctatttcagcatctctcagtttcctcatctttccatttctccatcaataaaatggatataataatggaattaaccttgtagggttgttataaggataaaatgagaacacagtacatgggtatagtaaatgcttaataaacattagctagtattattagtactggataaggactggattggaaataaagataattgatttatcattcccttgtgaaaggtatagtacagtggtcttcagactattttctgtgtaacctcagaagttcctcagagcttccactgagagccgggactgggtttaatgggtgagagatgacaccacttgcatagatgaaataaatggggtgggagtgtgcaccaaaatggtgctcctgtgctgctgtctgtggtcctgaaatacaatttgttagtaggacctagctaattctctagaaaactggtgggtactctattgccccatgtctttcctccctccctagtaactccttgcctatgactagttctcccaccaacgactatttggataaattgttgataacctattgaagcattagtttccttatattttaatataggtattttctacccaccccctctgtatgttcatggggatgctcccaggttatgtgccatcctatatatataaactcctccctcaatgcctgcctgagggacatagtcagaaagggacaacatagtggcaacaaaaaaatgtttgcctctgagctccctcctagtagagtcactggaaccccaagcccactgaaggcatagcccagtttctacttgcagagtcccagggggcccacatagatttttagcaatcattcaagtttttctgaggccaggatcagagcagaggcactctcttcactgtctcctggtggcctacgtgagctgtcattgcctctgccattactgatgctgtacctcctttctggtagtccttatggtggggacagggcagggcactcccccagcagctcttccgttagatgcctcgaagtattctcttgctgtttcaacttaaaatcttctcgaccaaggacttgggattgatctccagtggagcctgggccaagtgacagttgagccaccttctgtcccccactatcttgctgaaaagcctttcccctttctgtctcataagcccagacagtgcaatccatcactgtcccaggataaagtccagcctccactgggccctccccagggaagacagaggggatgcgctgcttttgtcctctttcttggtgtcagggttttatctgacatcctgcagctcagctacattcccaacaccctcatcaagtaactctcctggtggcccacaagtgggtctcctaagggcatcctgtcagctgagctccctctgggattcccaatccaggatatgaaagttctgcaccagaggagttctccacattgatggagtattattatgaggaaagagttggaaaaaattttccttttcatagattcacaaagcagaaaagcatgcttggtgttgatttggcccatctttctggctccaagtggggttaaactcgaacagtaattcttcaaacttagagagaaagagaggaaaacacctcccagagattgaaatgcaaaaacactcccttctaagttggagggttttttttttctcctagtggccacacaaattctctggtggtgcaatttgagtcctttgcctattgttctgtcctcaaggggaatcagagagaagatcatagcctctttaactatttccatcacattgcatttctctctggctgagttcttctccaccccgctccttgacacacacacacacacacacacacacacacacacacacacacacacacacacattcctacccacatatttagtcctaaactgtaatcacctgtgtccaacttggctcttggaagtgaagagggagctctgtgtttgcaataccacgagcgtattttccccaagagctgcttatgcagcaatccagaaattcccattgctctgccttttaattagttcagggagttgcagcctaacggtgtgggtgtgcttgccagctgtgcttttcgggaagttatatcgtctgctgctccttctgtctcctcccccagggttgggaaattatagaccctgctctctttaccctgtaaaaccccagacgctccaggaccttttccagccagcgctcaaaggcccttggggacaaagggcgacactcagatctcaggtcttgaagcctgctgtccttgagcagggtggcagagatgacctttgaactaaagggattattttcatctgtgactgttcagtcccctcgggtgacctaccacagaatcagtgcttgctggggaccagaagagggattttatggcttgaggggtacctgcatctctcccaggcagcgccctgtttgttttacaggctgccagataccttatctccacgaaatgagaggcctccagcatcccctccagccccacttcctgcgatatctctacttccccacaggggccctgggctggctgcatggctgaaattaaatctctcatcgctgctgtctttttaattaaacttttttccccttcatattttgtttgtgcattctccctctgggtgatcacattgcactcccagctccggttttaagttctcctagttaccaagattcagcacatccccctccttcaaagggtgggtgatggtgtttttcctggcatcctcccacagacacttttccagctcagctgagcggctagtgcctgtctgatttgcccaaatgggtggtgcaggtttctaccacacactttgaactcaaacccatcagggcacaattttctttcttcacttatctcaaccttgggcatggattctactgttgattgcttcgtatttatatacctgctttttgttgggctgttgtacacacacacacacacacacaaacacacacacattcactcagtcttttgagcagagcttctgccagccttcctccttggcacttggcttctccagcacaacgtctctctgcaaatggggtcattcgttgctgctctggccattgactctaatccgacagccctgcacatagccacttgcttgccatgtagtcccagcacgtcacattgattttcaccaagtgtacctcggcaaagcctgaagacaggcaccagccttgctatgttcctgtctttttcaaggcctagactaaggcagagcacaaacctcagaactctttgatagatgatgttttccactactagaaatatgtgcttttgtaacccctatctagtttcagaagatctgcctaattgaaatgttgtcttggatgttatatttatttttcaaaatagcaaagtaaattaaactgttattttcacttaacccattttctgtttgccccgagaatactcttgcttctaatcctaatggaacatcatatatatttctgttacattaggattagagacaagttctgcttagaaataactccaaaaatagtttatatattttattttcataccgaaaatcagatttccttcagcctcaaagagcatatttatgtaaaattgctggcagtgagctgcacttttattttctaaacaggaaatgggttaattttcaaaaggtgtaatacatttatgtggtttgaaacacaaaaagtataaactttttttttttttttttgagacagagtctcactctgttacacaggctggagtgcagtggtgtgatcacggctcactgcagcctcaacttcccaggctcaagtgatcctcccacctcagtctcccaagtaactgagactacaggcacatgacaccatacctggctaatttttgtatttttttgtagagatggaatttcaacatgttgcccagactggtctggaactcctgtgctcaagtgattcgcctgcctcggcctccgaaagtgctgggattataggcatgagccaccctacccagccaaaaagtataaatactcttagacagcaaaaatgctttctcccagtcttgttcccttgttctcagttcccaccctgcctggataactactgttcttggtttcttgtgttaaagatggatcttgatagtctcgtaccagattcaaaaatcagtcaactacttcaaaaacaatgacatgctggctacttaaatagaaaaggaggctttttttttactctgtcacacatttgctgcctaggattgaattacctgccctgctccccaccctcagagctatataaattctgtcctaaactttttctgtttctgacagtctctacaacatagcctttgttgtactatgaatttttatctcagccatctttgtctaagtttctttgtttcgatgtcttgaagcttaaagcagattctattacttggaagcttagtgaattggccccagttaatcagataagcactaaataaattccctggaaacctccaacagatagactttaaaagatccagcacaatcggtttatcctgacaagattacagctgatacggtgaagatggaggagactctggttttctgaataacttgaagcggactctaagaaagaggaaggcatcaggaatgtggacgggcagccgtgctcaggctcaggctggatgtgtgctgtggccagcagcggctctggacggcagtcagcaaaccaggcaacaagaacccagcattcctgcagtcagaaagaaaattcatctgggaagagggacctttagagagctctggctgcccacttcctgggcactcttgcttctcagtctggaggaaggaccctggtagctcagtcatggtcagcaccatctccaagactgcccagcacagtcctccaacactttaccccaaacacatgcacacttagtgttacctaatgcatttgtcccaagtcatcacttctctacaaagagcttttaattcactggctcaggtggctctggatgagttaggaggggtcaccaatgtggtttcctctgaggaaactctctccacagggttgttctgtaaactgactatcccacacatctctgtgacctggtactgcatttaaagatgttggtcaaactcatggaagcagagtagcatggtggttgccagcgattggcagaaggggaaaggggagatgatggtcaaagggtacaaagtttccgttacacaagacaaataagttctggagatctactatacaccatagtgcctgtagctttgaatgctatattatatacttaaaatttgcaggccaggagcggtggcttatgcctgtaatctcagcacttagggaggccgaggtgggtggatcacaaggtcaggagtttgagaccagcccagtcaatatggtgaaaccccatctctactaaaaatacaaaaattagccgggcatggtggtgggcgcctatagtcccagctactcaggaggctgaggcaggagaatcgcttgaacctgggaggcggaggttgcagtgagccaagattgtgccactgcactccagcctgtgtgacagcaagactctctctaaaaaaaaaaaaaaattgctaagaaggtagaccttatgttaagtgttcttaccacacacacaaaaataatgataataataataaagggagtgggaggaaactttgagaggtgatggatggccttggtgaatggtgtcgatggtttcacaggtggtatctacagagtcatcaggttgtatacattaactatgtccagttttctacctgtcaatcatatctcagtagagtagtttaaagaaaagagatgctgactggtgatcctagagatggccccaggtcccacaagattcagaataaccaagaccagggaaatgtgctgtagtctcagtaggtagtattaatattaacatttgattgtgaggctgtgaaaactgaccattcttatatggtgagtgtggtttctatggtaacaccacattaaatatttattaagaaaatgttattctcaagccacacctagtaggagtggttattgtacacagcactggagacacacaaagggaaagcaagtactttttttgggtaaaccacttggtccttaattaggagttgggaggaaaatacagggtcctagctatgagctatgcccacctttagccacctcccctaggagtagcccccgggatgtccactgaagctcatcctgaccttggggatatcctctgacctctgagcaggggagctcaatccttagggctgcctggcgtaagagcgaggtcccacttgaacaggagatgcaaacatgtgtgctacagtggggcggacaccttcccctaggactgtggatgtggcctggggtagaccgggcaagaggaaacctctggacccagactcccacttaggaggcagaagtgctcaatcaggggcatatacagagcccaaaggagagctagataccaaaattgaagagaggaagcattctgaccaggtcccccacactgaagaacccaggtaggtgtggaagcccgggtgagaggcaaggactctgggcaccctaggcactgaggagagaggcaggaggggcaggcttggtgtcatggggagccaggtctcctggtagcgatgtggggatgggcctgagcagaggcacataggtggaagactgtggcagcaattcaggaagagagtggtgatagccgcagcagagatgtgactgtgagaggcaggagatggaggccacagatatcacaagggtagactctgtagggcttggtgcctgggctggggtgggagaggggagggaggtctcagatcatgcccatgttcctagcttggctgatgcgatgaatggcggtgtcagagactgggacatggaggaagggttgggtctatggagaaagaggatgaaggaggcctaagaatggctgaatgggaggggcctatgggacatccatattccagaaacatcatcacaggaaggaatgagaagagatgggccccctggaagtgtgggaggattgagaagcgcagacacacagacccaggcagcagcgtggggtgttctggtggaggagggcaggggctgtgatgagtcaaatctgctgtggcaagcaggagacaggggcctgtctggaaatgacagcagccttcagttctgccttaagatttccagtggtggacaagaaataaatgtgggctttcaacagcactttccggatctatgtgtgatcaggtggaggggtgtgtgaggtccaaggtagtccatccttgacaagtggagtcatggagggtgacagagctggatcccatcagtggtgtgctggagccagctcctgccagctcagctcacagactgattgtgcgcatctcttcccaactctgcattcagtgacatcatattcatagcttgaaatcggccatagtggtagcatttacaccatggaggttggcaaatgctgcaagtcaggcctttatgttccagaaagccaatgttaaatatttactggcacaccagtggggtggaagagggagcaaagctgcatgtgggcaagtgaaaatggatgagtctggagagagaggtgggcaggagccagaaaaatgagctaagaagactggagaacaactgagaagcagtataattactgtgcattgctcgagagtgaggaatttaaagcctggaggcttgagttcaaattctggctctgtcactagttgtatgaccttagccaggttacttaacctttcttggcctcagtgttctcctttatgaaatgggagaaataatgcctacttcatgaggttattgtgagatttcaacacattttgcatgtaagcacttagaacagagcctagcatgcagtaggcattcaacagtaagtgttagcaggctggctgcaatgctcatgtctataatcccagcactttgggaggccgaggcaggaggatcacgtgaggcaagcagttcaagaccagcctgggcaacatggtgagaccccaactctaaaaaacatttaaaaattagccatgtgtggtgacgtgcacctgtaatcctagctactctggaggctgaggtgggaggattgcctgagcctgggagtttgaggttacagtgagctgtgttcatgctaccacacttgtaacaagcaagaccctgtctcaaaaaacaaaacaaaatagaaaaacagtgttggctattgtagaagagtttatgtagatcatgacatgattgtatttgtcttttggaatgaaccccacagtgtagagaatagattgaaaggggcaagagagaaagcaggaagaacaggcaaggagtggtcatttgacaagagatgggggagcctaagctaaggtggagagaagagaggagatttgaaggagcttgaggtggaatggaggggactgggagattaattgactatgattcaggagggagagagagagagtgggtgaggcaacttagaagaggctttgggaaagaggttgggatcaggctggggtttgaagggccatctttgcagagaagagggaggaggaagcaatatgggaggagaacaagggtttttcagagagtattggggttggggatggaatatgtggtaggacgtgacaatgattgggttcggggtgaagggtgtcatttcagcagagaagcatgagtccgtagcacgtcaggtccctctgtggcctggcctgcctttgcctggctctgggtcttagccaggtgtggccatcagcacatgtcctcctgctgcccttgctaacttgtctgcatccactgctactgccactgggtgtacacgagctctcagcagaatggttctgagttctgacccaattctatggtcaccatgatggggagccttgcttgacagttttgtctttctgtatgtggatggtgcacagagcagagctggggacagtgacccttcaggggtctgttagcatgagttgatgtgcatggaggctttcatttcttagcaaaggaggtggaaagatctcttgcttgttaactgtgcatcatgaaagtgagagaaggacaatggaggagtgagatgtgtctgtcttcagcctggtccctggtgctgctgtcttcagcccctatggagagagagcttgaaggaaaaagtttaaagagctattttcatgaggtactttgtgatacttagagcacatattctgcttctgtgggaccctggtgacaaggtgtggcacagagtcagggagaaaaccatgatcccaactcttgcaggaagtcagcactgtgggcctgcatgctggtgctcttatcataaaccctgagagcccagacagcagtatggtaccctcaagtggcttcttgggtgaggatatcaatgagagaaaaccggaaggggacaggaatagcagggaggatgctattgatgtaatcaatggactggctcatgggcatgtaggcaagtggggtaagaacacgatctttgtgttattgaatttctttggaattaaacaggatccacaggaaggtggcctggggatgttcagattacccatgaaagtgaaacattagaagaccacattcatgctggcttggctggcttgagctcgggggtttgccgtggctgccccagctgggatggctgagggcacacagtaactgcagggctaggtgctctcaaggtaattcatctgtctccaagcctttctgggtcaccacttacgcctgctctcatggtgaaaacaaagaaaagacttcaaccaaagaccagcctgtggtttcagcaggtccagggtggtccttgcctgagctggagtgtcctttggtgataggatggcacctactaaggtgttaggtattaatctcagtggggaaggggtgggtgaatttcagaagcagggttggagcttcagcctcaggaggccagacctcctctctgagcagttctacactggttgtgttcactggttccaactttttaaagacaaaactggctcaggacgttggggtcagcagaaataggtggaaactgctttggagatttagtgttctagggagtggaggttccacacccccgtcatctcagccttgtgtctctacagggggcagactcctgccaccagctctgtcccagcaggattctactccacatgcctaaaatcatctccttgaccctaagttcctgctttccatatttgtgttaatggccccagcataaaaccacagtagttatcatttctgagtgtcctacatgctgtcccatctcacttcttccaacaggagtggcttatatttccttttagttcccactgtctaccatggtccatgtggaccatcagtcacatgccttgctcctctctggcctcaaaggtgccatgaaatggaaatctggccaatcagagacctctattccttgggccacagtgataggtccagggatgaactcctgaccaaggcctggccaatcagagtctctcctgggacctttctaccagaggtcatgggaaagctcacctatgtttgctgggagatgagtctggggctgcctagaacacttgcctgcccacagaaggagcctggccatgagtggagctgtgcctgcagcaagaagtttccttacacttcctagtgacatggctaatacattccttcttctttttttttttaagctaatttatataggtttttaccatttgcaactaaatctaatgcaaccacaacagcatccaaatttgatttctcaaatttatctttattttattagtctccataatgtctctcatatctgtcccttcctttccatcctaactggagtgagtaaagcacctgctaccatgcttcatcatgctttatacctggaagacaccctcctgctccccacttctcattgagtctcacccgaagtcagacctttatcgccttataagctggattattgctgagtccccactgaaaatcatgaaagatcaaagtcaaataccttaattcctagtgcaagacttcctttgattctaatctttcttttcaaccctcccttcccctatttgtctcttagatgacctctctgaatggttagcccgaaaactccagaaatgccttttttttttcctgtgggccacatttattcattcattcaccatggccttttgtatgccaggcacttgctgggtctctgcctggaacacctgcttttttatctgaatcctgttcctgctttcacacctagtttacgtaagttacccttcctccagcaagctttccctgacctactgacccactcactggataggtccagtttatccctggacctttcactgtggcccaaggaatggagatctctgattgaccatatttccatttcatgccacctttgagaccagcgaggggcaaggcatgtggctgatggtccacgtggaccatggtagacagtgggacctaaaaggaaaaatgagccactggtctgttccagccctggacctcagcagcacctcctgtgtggctttctggtgtgctcatggcagctcatcaggctatcattttctctttcttatgtgtattatcttcttccaaataacgcaagggcaggtgtgttccttctctcccctgaatcatttagtgtggtgcttgacaggtacctagtgggctttccagcaacatttgtcatttggttatttaaatgtttgattgatgcagttggcatgaaaatgaagaaaaaacaggaaacttaaaaagcaaaaattgcttgtgaggccccaatggtactctctgctccacacactccttcccctagcacccatagaggccgcttggtaacacagccaggtgccacctctggtgctgtctggcagacagccttccagccaagaactactcctgcccctcctgaatgcccagctcagtgtggtgctgcagttacccttggccagtgttacttaggaaattagccggacactggagggttaaaaacctctctcttttttgtgaagggtagagaaagagagatctttcctgtctatactatgcttagctttcggcgccttcctgttatcataatggttttttgttggtggcaaaagccttttcagaccagtgaggcaatatttcacccttggccacactttaaacattgttgtcaggggccggctaactgtgccgcaggatgtgggttgcatcagcctgtgatgtatgcttgtgaggttagtttggggataatgactggctggggttatacctaattttgcacaatagtgttgggagagggataacagggtgctaagagttatacactgaatgctcttggctaggaaatgcaggcccagaaccttccaccattccctggcatctggccaaccagccccctgatggcctgagaaaggttcacagtgcagacagctggacttttctcctattcggttctctaacagcctctcctcagttgccacccactgtccctcctcccaaatgcaatagaaaaataaagataggtggcagtgatacccagggggtgaacacagagcagagaaccacactggacctgataaagtgacttggtgaacgctgataggcagacatcactcctagctttggtcagtatttctcagttcccaagaacatttctcagctattctcctcacccagtgcctatgagtctgctatgctttaaaaatgacatacactaggaagtgcaaagcagagtaaggttgtaatcacctttgagaatctagtgaaagtgtcatagatttagaccatcatagaactggctcccgattaggggtgttttccagaccaactctttgtctgcactggaactctcctgttaggcttaagctggtcgtctgggctccatctacaagatggcagccagttcttcttcacactgggtctgccctgcagcttccagctgacacttgttcttttccagccactggcagggctccctggaaactcttctttgtcctcccctggccctgtatcctgatggatcaggccaaggcgttgacctagagcagtgcagaccagaggccgcagctttatactcctctttctctggtctctgacaggtacaaatgctaggcaggctgccctcatctcccttatgaaccaagacactagtcctcctgacttcgggagtgctgcctgctgatgggtcggtccttccctgggagttgccttcagccagtgggagctgcctcccaaaagttacatgccccaggcacaagtggacgatgcagcagtaccaagggctcctcctttccctccattcaagatatctctgaagggccaacttggcttcagagctccccgtgagatcagttgaggcctctagtacgattttgcactactcaaccttgtgtccgagcctcctttctctccctcatgggtattgttcccaagagcacatttgcatgtaaatttccttctcaaagtctgtttcccagacaacctgacccatggcacttagaaataatgggcaagaggctgccagcacagaggccagcatgtgcattctgcaggctactctcacaccagcaaggaagctgtgtggtgggagaagcaatgcctggagactgtacacccaagagattgggagggtgatgaatgaatgacccagaggaggaagagttgactctggaggatgcctgcctagccctctgcaacccatgcaggattgccttttcccaattgaaggaagaggagaaaaaatgaagtgcagaggagtcgtgatgctcgctgaagggtcaactatttatacaacagttaacccaacacatattgcaaaatgatcttactccttgttgcctaggcaaacttccctcccagtcattgcttctctcccttgaaagttggcctcggaattggtgcagcgagacttcccagcagctgtctcagtggagtgagatgtgaacgcaaagtggacatcagagaaaagagaaaatggggggagctgctgtctgctccactcctctgtgggagaagagtggtgtggaggagagaggtcatcaggtaggcctggcccaacttctttggccgggcttcagcccccaggccccatgattgtgtgccccttttggaagaccactcctcactataacagaagacaggagtaaaggtcttcctctttgcacctcaacatggattccagaggctaaaacacactaacctgcccatcagacccagaacagaccccaaccggcagagactttcctactgtgggagctgaactggaactgcagctagtcaggggacatgcctgcaggtcctccccacccctccctaactccaaagaggccagtccagctcagcatctctgccttttccattccaggcaactctagaagcctagagtgtaaattttgtaaggccaggcacccccacatttggggataaccattacatagcacttggcacagcagccataggaatgccagggactagtcatcaaagccatgagactctctgagtgctgttgatgccaaaaatcactctaacccttcccagaggctgcacctgggcattccctggagtgttccttatggagcatggacagtgggcacagacacacttctttccaaatggaatattgcctcttaggaactaaccaaggccctttcagtttctgttaaggtttttgttcaaaagtaatttttaaaaatgttttataaccattttaattggaattggaaaattagcacatatactgacttgctttatcagcttttcccccaccttttaagagatcccagagaataggagaaatgaaatgcaaaatttacaagaacttgtataacataaagtggtgctgggctcttcggttagtcaccagggtggttcctggcatgaagcaccagccattcgtgtcccatgcaaaggagggttctggacgacttcagggtggtggggtgttgattattagaccagggagtggtattacagagatagaatggcttgggaaggggttaagagtgaacactccaataacagcctttgggtgaccctgggccaaccattgttttctaagagaaggggaacccaagccaccaagggcactaacacacaagggggaaagaaaacaattctagaccactgcatgcaattaaagagcagcttaatttggttcttttaggttatagatcactctcaaatcctgcttatcagttctgtgcattttgtctgtgctattggcagttctccacaattcactgaaattgtcagaggctctagacaggagagccacaaagcccatgaaactggggacgtattctccccactcttacttgtcaagagcaggtgaacttcagtagcaagctggctcctgctgtgggaatttccactctgtttggcttgagccctggagtcagtgtgactccagataacctcgagatgggacacaacaaaaaatttaaatgatacaaaagtccctgtcattagatattatcttagataattttaagtgattaaatgtttcctcccttttgcatgcacgcacacacatgcacacgcacacgtacaacacacacatacctcttcactctatatctttttatatatagtcgtgtgtagcttaatgatggggatacatttggaaaaatgcattattaggtgattttatcattgtgcaaacatcataaagtgcacttacacaaacctagatggtataacctgctgcatacctctgctatagactatagcctattgttcctaggctacaaacctttacagcatgttactgtactgaatactgtaggcaactgcatcagaatgctaagtatttgtgtatctaaacatgtctgaacatagaaaagatacagtagagctacaatataaagatttaaaatggtacacctgtatagggcacttaccatgaatggagcttgcaggactggaagttgttctgggtgagtcagtgagtgagtggtgagtgaatgtgaaggcctaggacattactgtgcactactgaggactttataaacactgtacactcaggctacactaaatttattttaaaactttatttttctttcttcaataatacattaactttttaactttataaatgttttatttttttaacttttttgattctttcataacacaacacacaaacatgttatacagctatgcaaaaatattttctttatattcatatttgttaagcttttttctatttttaaaattttttacttaatatttttagtttttaagttttttgttttgttaaaaactaagacacaagcacacacgattagcctcagcctaggcagggtcaggatgatcagcatcactgtgtttcacctccacatcttgtcccactggaaggtcttcaggggcaacatacatggagctgtcctctcctaggataacagtaccttcttctggaatacctcctgaagcaactgcctgaggctgttttacagttaacttttttttagtaggggtacactctaaaataacataaaattatagtataataaacacataaacaagtatcatagtcatttattatcatcaattatggagtactctacataattgtatgtgctaggcttctctatgactggcagtgcaatatgtttgtttacaccagcatcaccacaaacatgtgaggaatgcactgcactgcgatgttaccacagctatgacatcactagacaacaggaatttttcagctccattataatcttatgggaccactgtcatatatgtgagtcatcattgactgtatatatttctgattcttcatctgcacaatggagataaaaaagtaagtctggctcaatttcacctctgagatatgttttgtgggtcaaaccatattatgcaagctctccaaaaagatgaagtgctgtagaaatggaaggtatttccactaaaaaccataatttcatcatttgttatctgattactctctctcttgccctttgtgttcagggaacaatggaggcctgcgatttggagttaaactctcagtgatctctgtgttgacaacaccaaagctagaggaatccagtaggatgtgggcatggttttcccggaaggctgactgagcagttctgcaaatgtttgcaagtacagggcagaatttcatccagcctcagaaccttgagccaagactcagcatcagcaaagccaaaagtttcatttcttcgactgtgggagtgctagtcccaacctttagatggccattcagttttaagttcaataagcattttgattgagaaatactttgctgaggagtgaaaagtccttggctttgaaagacgaatgatgagcagttcagtggcccatgtcacagtccaggcacctgccaaaggtgactccctgggaggagcatcttagtcacagagccagtgcctgctgtaggtgtgcagaagggtgcatgtgtgtgtgtgtgtgtgtgtgtgtatgtgtacgtgtacatgtgtgttgggggaagggagcaaggttgtgggagcatttcttatctgctcttctctgcaagatttcctgtgatttaagtcacattaaagtacccataagcccgtaatgcaaaagaaccccaaaaccagcccagcagccaaccatggcagcaagtagatgctctggtctttagatagtcagaaatgacacttctgggctctcaggcagtcagtgggttgagctccccattaaagtccccctgccaagtctggaatagtcctagtcccgtgtgtgtgtgtgtgtgtgtgtgtgtgtgtgtgtgtgtgtgtgtgtgtacccgcgtgcatatgcgcgcatgcagtgcagggtctgcatacctaaagcagatgaaattctgcagaatggctgcctcactagacaaagtcaagaagacagaccgaggagagagaggttgatgtgtctccactaccaagagataggcttctctaagccagcgagacatcccatccaacaatatgaaactggccacatttccttgagatgtcaacgttgaaagtgtagctgcatctttattcttcactgttatgaagttgggtgcaacacagcttgagtggaatacaaaaacaccgcttggaaacacatgatctggatttgaatcgcagctgtatcattcacctgctatagactttgagcaagacctctctgaggttatttcttcacagtaggtagagacaagacttacttcaaaggttcttaaagttgaacctgagtcaatgaatgcaaaagtgttcacatttaaactgtaattttaaagcacaatacaagtaaatagcattaatatcattagagagattaacttagcactgtgcgtcacatgattcatcacgggccatctgtgagatatcaaatagagaggtgaagcctgcagtaataaaaaatactgccatagctataaccagtgtactcttctcttcctaaacaaacaacaaacaaatcttgccagagtcaaaaggcaacagtttcgactgctttttctgttttcttgaaagacagaagtcaagcttagtcccttctctatgagaaatggtgaaggaggcactctctttgttagagctatggagtgtggccatgtgtggatcaagccaacgtcctgccttcactgggctcacagacaacactcacaaatgtcacagagctcagatcacccctctccaacactttttccttcatcaaagaaagtgcgtccaaatgcaaatgagagcaatgataccgtatgcatacccatgaatccactctttgctcattcttattttgaatgcactcctatttcaaacctttggtacttcctattattgataacaaattacttcacaaccgattgacatgtgatggcacaactgaaagtcaagattgaggacaaatgtctgcagccgtgggtgggggcaggaatttgttttatgcatcttagtatttccaatgcccaggtagatgctcattgctgacttgaattggccctagcctgggaaggagaaacctcacagctccctacccatgagctctggggccattcctaatgcagaggggctagttgggtagtcatagcccttttaggagcatcacagtcatgacaagagaccagaaatggcctctacaggagatttcaatgtaggacaaaccagctcccttcacactctgtggtagtgacagttttaagtggaggagtaagtgcccagcttctttcatgcctgcctttgaagagggtggcctcttgccagcaagaagtgtctgaggtttgggtgggtgagagctggatgaaatgagtgtgtaggtggtactgcccagggaataaatgtgaaaagccaaagcaaaccttcaagtgcacagcaaagagatgcattctcagctgtgttcctaaagacattcaaaatcacatgcgtctatctgggtcatgtgggcggatctgtaacccagggcatccacagataccagagccaaagctggcatggctgttccccgccaggctggggaggccttgccagggcagcagccccagccacacgcccttgtgttggagcagtctggaggctgccagcctgtggggctggctgagagcaccagcatgtggggaatcttctagataatttgtcacaagtgtgctaatggctctgggggccaagaggaaaggggtgatacagcatgtttggagactggaatgtgtaaatgagttgctctgtgaattatttgatattttctccctgcagtttagaagaaaactaggtccgatgggcttggccaaggtttatgaggcaaagcagggcttctgaggtgaagttacatggctgtttgagcccgaggcatggcaggattgctgccatagtctggaaacctctctggtgataccaggccagcttggtaccaggtataaagttacccaggtcagaaaatgcagaggcttcattcctttcttgaaaaaagggtattgtaggtagcaagtgggaaaagagaggaaccaggggaaccaaatagatgagggcataagggaaaggccgtcagagtggaagtccagaggtttatgttgacagtcttcctgtcacccactgcatgggaggagtcagctgcagcttaggggtgggctttgcagttaagccaagccgaggtatcagccccagctctgccacttcctccccatggaactgaagttgttagccccttggtcttcagtttcctcactgtgtgaagggaaaatgatgacttcctccctgagttctggtcaggatgaagggaggtgagtgtgcagggcttgccggtgtgccgggcgtttggtggtgtttcttggttaccatggtcattgttacccagtgtgactgttctgattacgatggctgcatcacacacagcacaaatttagtggcagaaaaaccccaactattttttatcaagcttatggattctgcgggtcagaaattcagaaatggcacagcaaagaggactcatcactgctccacgatatctggggcatcatctgggaagggtaaagatccagggtatcttgactgttggaacctggaatcacctcaaagctcattcactcacatgtcttgagcctgacctgggagggccttgttggttaggactgctagccagagggcctacacgtggcctccctgtgtggcttccccacagcgtggtggtctcagggtagttagacttctaacacagtgcctggtttctcccagagcaagtgtcccaagagaaccaggcaggcagaagcagaatcaccttttctgacctagcctcagaaagttgtggcattctgttggttgtaagtgagtctctaaggtcagctgtctgtattcaaagagaaggcagctctggatgggaagactgttaaagaattttaaaaccgtcatagtgactatagaaaataataatgccttatgctcacagaatgtttacagtttcaaaagcacattcacttgatcctcacagtgcctttgagtggtgagcaggacaggtagcaaaatcccattttgcagatgtggaaacagcctcggaaaggctgccacttcattcccctgagctacaagatgaagagtttatacaagatgccctcgctggtgcctgaaatgcagtggttttccgttccttgctgaaggaggcagtcctgagcagttggctttagtgaaggaagcagtctgatcagaactctgtttgctctttgaacaacttctgtgatttcctgggccaaactgaattgcttccacttagctcacacctggattcttgaaggcagctaattttagattctttggtctggtgccaaatatcaaaggagttgaaagaataatctttgctcaattgtagtacaaattccttcaactgagaccaattctggtgcctcatattaagataaggaaacccccatttatcatatatctttaagctgaaacatttcaaccaaagcaggagaagcaaaaaaaaaaaaaaaataagtcaagatcatctttaagcaaattactcactgagcaaatatcaagaacgaagatttttaagagtataaaattactaaatttgtgcaggtgcaatttgctttacgtaatacttgtgttcctgatttggtgagtggaaattaaacatttatactttaagtctattttaaattgacttgaaagtaatgtgagaatggggaatttcctagtaaaggcgcctgtgcaaatttacttcctagtttcagttttgttaatttgggtttctagagattggattttcttttcttttttttttttttttttgacggagtctcgctctgtcacccaggctggtgtgcagtggtgcgatctcagctcactgcaagccccacctcctgggttcatgccattctcctgcctcagcctcccgagtagctgggactacaggctcctgtcaccatgcctggctaatttttttgtacttttagtagagacggggtttcaccatgttagccaggatggtctcgatctcgtgacctcatgatccgcccacctcggcctcccaaagtgctgggattacaggcgtgatccacctcggccagcccatgatttatatttttaaaaatactgtgaggaaagggtaataagagggaaaaccatgaagaaacattaaccaaaacttaaacccaagtatgttcttcattagtggctctggaagccatagtgagagattaatatgcaattaccacacacacacacacaccattatttgtttgtgtgtgtgggggcccacacacataccattatttgttttgttgaaggatatagtaacattgctttgagacctatataatgccctgtagttaatgcagatcatcttgtaattctaaacttaatgataatttagtttttaaaactaaactggcacattatggtggtgaggctacttgaggacccagtcaaatgttgattcagcaccttcgttgtcttcagcattgtgttgggcattctgggagctaaaagaagcataggacacagttcctattcccatgtaccccaatctagctggagggctgagacatacacacagtccacaatgaacaagccaggtttgtatacaacattatgtcaagcaagaatagagttccaggccatgcgacactatggaaaaatatgtaggtcagtatttgaagtgctattaattgtgcagacaataagaatatataggtcagtatttgaggtgcttttaattgtgcagacagtaaggacaaaagaagattggtgcagtgagaaataatattgagagggatggtgaccaaaggggctacttccctttaatgaagagccagaaattaaaaatcacaagatcattgaatatggccgatcgaagtccagtctggaatggcattaataatcaaagtatctgatccaagggatggagtcaggtgcagtgctaagggcttctaggtggaaacagttcttggggatgggtaaatgacagacttggagatcaagttaggtgaaggaaaggatatcgcaattaggatgcaacccttcgtgaatggagagtaaaaagggagatgggtgctggtcagtggggtatgggggagctggccactgaaatggaattcagaagacagtgcaaaagcccaggcaagcaagctagccccaaacagtggacattcagctgactctgccctccaagatgggcaatggctatctctctatgctcaatcccagcacctagctcagtacctaatattgagtgggcattcactaaagaagtgttgaataaataaatgaatgaattaggaaatgaggaagaaaggaggcacctaggactctgtttactctagggacattagatccagggctcagggaagcagacatttctactcactaaaggtgagggccttccaatgaaccaccagggttggttctcagttgggaccagaggcacttgatgggtcattactgctggcaggtaatgttggagcaggcaggactctccaggatcatagtaaacaaaagcctagaggttttcatcagtgtggcatgtacaggaaacacaagcagttgggtatggctggagcatagcacactgggggaagtggcaggagatggaacctgagtgtcatgctaaagggtttagattttatcctcaaagcaatagagaggtgctgaaagattctaaagagcaaagtaacaaggtccaatttacattcaggaaagacagttctggtagcagctcaaattatatggaatgggagagacgagaggcagggaaactcactaggaggctgttttgatagggcaggtgagcactaatgagaccctaaactaacatagtggtggtgggacacaggggaggagacaaaatcaagagatatgttcaaggttcgtttaatctcattgggtgaagacagacaccagcaactgcaaataggatgatgtgatgctgttactcaagattggaagtataagagaaggatccctgtggaaagtagagggtagcccctatactgtctgcaacaatgctgggcacagacactacagcttgtgctattggacactggacactacttctagaacctggacatagcagcatcagtcctcacctgaacagagcctaccagtgcatgccttttgagcctggtttcccattcaaaggtggctttcaggtgcatctggttgccagagccaaggttgcatgtgtgcaccctagctgcaagggaagcaggaaccagtatccagactacctctccttcccacctaaactcttaaggtggagacttcaaagaagaaacctgtttagaggggctgctcagccataaagagtgataaatgtccattaaaaatatgaagaatgaagaaaacaaagaagaccaagaccacagccctgaggaaagccaatatttaagggacagaggagaaagagttggtgaaggaaacggagaaggaagaaacaagataaaaagagattgagaagagtaggagtgttgcagaagccttgggaagagagggctttgagcaggactgagcagccattggatttgacagttaggaggtagccagtcacctgtgggagagcattttcaggggcaagtgggggtaaaagccagactccaggggtctcaggagtgtgggagttgtgttagtgaagacagagtgtggatcacctttaaagacaatttgactgcaaagggaaaaacaaagagaaagtcgaaactaaggagtggctcagaatggtagggtgtggagttgggtttttgagcctggggcgccttgactacatttacaggtgtacgtgctgggcaaaccttgtgttcaccgaggatgcccgcaggctgtggggagaacaaatttaataatggcctctccctttctgctgctctgagaaagttgctctgttctacaaaagatattagtgttctttttaagactctaaactacccatgaagctctgtttctttaaggattaagaacatagaaggtctcaactttacatctagtgtttgcaagtgtttacttcaagaggcatcctgaaaggctggagggaggtgtgagggttggggtgggaggcttgaattgagcacagccttgtagcatcttagcccagtgcatctctttccatctcctagacaggactggcacccagccatattcctttggacctgggctggtggctgctgctgccactcccttctgtgcctgtcccagaagacttggcaagttagatgctcttgacatcttcttacccacatgcttgcaaatccctgagctgatccacagccagctgccttttacccagtagagcacaaggaaagcattaggcttctgttgaatttttcgtgcaagttgcagccttctatcatcccaagacctctgtctcacctttagtttcacacaaatactatgtttaagtgaataaaagcttctatcttctgaagagttctaagcactttcacttatcacactcccccagaaacatgcccagagtaaaatatttttggttttgtttttaattttttaaaatagagatggggtcttactatgttgaccaggctggtgttgaactcctggtctcaagtgatcctcccaccttggcctctcaaagtgctgggattacaggtgtgagcaatcacgcccagctataaaatttcttaaaagccttacttttcagatggggaactaatgaacaagtagatagggttgcctgcctgctacccctgcctccccaccccacacctggttatgaacacctggaagagacaagatgagaatccaggacactttcttctgcacatcaagtagcaagagacaagaggctatggaatgtttatttgattgtgctggtgatagaggggattcattgaggagaagaaaaatggtggggggtaggagaaagataaaagcatcttgatctcccacctttaatttgcataaaacatttcagctcaagaagctaacatttggtaatttctgaataatcacaagggcctgtgacaaagcaattctggaaacaactgagccatgggcccctctgctcttctcacaaacgctgttgttcatttgctgaagggtgaactcatcggtcttcaaagcacctaactccttggaggtgggcagaggctgaatccaactgccaactcccatctgcacagccaagctggcagcatcacttctttccctccactcccagtcacatggccaaaccagcaggttcttggagcatctgcttctgccccacatggtgggctccacctgggagactttccatcactgactctttgaaagagtctgtttgtctgtgggaaagagagttgctgtcacccataaaacttctgaccccagccatccaacaagagtgtacctgctgggtagggtagacatgtgcttgcctgatttctagctatggttccctggaggtaattaagtaaaaaagaaatgcctttgggttttggcccagctcaaagtaaaattagagaaggcctggaaggggaaagagaaactgcagtttgggcaaatctctttcatttgtagtttctttcttctctcagacaccatggcagctttcttcctaaggggatttcctcgtggggaagacatgaaacccattgcgtttgactgagaatcctgtttaatgaaagcaataaatcatgtcagtgagggaggtctagagaactgagccaaggaaggcgggacaggggtttctgctggcctcaggcttggtcccctttatgatcgacagtacagtgggaaagacaaacgtttcatgggatgtgcctgagagagcccagagggaagctcaggatgcttctagctttcaaacccagcttacctctgccttgagcagggctctagctcctgtgtatgcagaagggccagcctcttcatcatacaatacagattggtggactgagagagatccaaggaaggtcccagattctctcttgtactcatttgttgctaatgtaaagtgctactatcggagaagcactttacattagcaacatggtcttctcaatatgactacctctaaagtaggctcattttatgggtatttacccctgttgaaacgtatcctcaggaggaagaaagggactgatcaggacagcttgccaacttcatactttacctgggcctaaccctgcaatcaagcaccattgggaataaatgattttgccattaaattctaatgtgactaagactctcatcatgctctgagctttggctttccaatctgtaaagtgaggataataatgcttacctaacagggccattgctagggtgaggggagattgcagatatgaatgccctgggtaactgtaatgtacagtgtgggtggtgggggctattcttgcatacagcctgctgcctcccaggcctcaggctaatcaggcctggctaggttagatccatgggtcttccctgcactttctgtcccctcccactacacatccccatgcccttccctagcatccttttatgtgacatcgtgatatcatactgttggcaccatttagccttaacctttctttttaagaaacagacaacagtaatgtggactgagaaatgacaggcacacagaccaatctatgatctttatacaaagagacacattaaataaatacctatttacattatagacaaataatgtagtcagtgtacttagttgtagctgggtaagaatgagcttgtctgtacttcctggctgattgagtgctcttagcaaagtccctacaacatttttcaaacagagttaacctgggaaaacaccatgtgcttagatccaaattagacaggtgtctcaaggaaaaaccatatcagcgctttctcccttgaggtccatgttttaacagtgtacagggaatatttggtaagtttaaatgaatttattttttatgaacctcccaatgcagaggctgtatgctccagagcagtggaaactaagctggaatatgtgagatttatggagcaattggggctgtttacaggactcttaagctctgcctgtattactagcccactgatctggaagggtcacctccagatctgtcttttttctggactcaatttttctctcttgcatgatgataaaactttgagaaagtgcgattaattaatttatggtctatttctcattccctattagatgaaatgttttaagaaaaaatacacagcataattgttttaaatacacctagcacctgtattaaaaacacaggtcttctgttacccaaaccagtaatctctcaactgtattcactttggcactgtatcaacatttttttctgataacaaaaactgatcaaatattttttattaacctatataaagaatttgactgcttatgattcaatacatatgatttaataaaatagattgcattttttaaaataaagaatgatttgaaaaaaggcttatggagttaagcagaatattcattttctttccagttctactcagtatgaaagaggcggcatttcaacacatgccctttcttcagttcccttctttatatgatgacattttggcaagaggatttcttttctgtgtggtagcatttctgaaataattatatgtgggtttgttgtttgttgtttttgaaatagtaggtttacaaaaaaagacccctgtttcaatttgtaaaataatctacttcagcagaaacctaggaaggtcttgtcagtggttttaaatacaagagacttttagtaccagcaattttattcccagactaattcagcatgggaaagagttcaccaaaaacagatgacaaggatgaaatctgtgtagatagaaaactgcttctaatgggtgaaaatcccattttaagcagacccaggtgtgcaagccaattagagaaaatggaacctggcaaacggagagaacgtttccagggtcccctgggagtagcaggttttaatcacagcctgtgtgaggaacacttaactgagatttgggagattatcagaaactattagcacctagtcaactcaggagtcaataagcctcttgctttaaactttgaactgtagttttccactttcttcctaagactataaagacacagttttggtggttacatggagcaactctgcttgctgaattctcactccagagagctctttggattatagcaggaggcataatccagcaagcataatgtccctcaccttaattctcctattcctaagtcttctggttagcaaatagctcttcaaaagagacgtcttcactctgataccctgcaccactcaccttcccttctccagtgccctggataaattcaaagggatattttaggagtgaggaacactgtttggagatgccagacccagacaactctccattctcctgtctacactgaaacaccatgtggtggaggcaggtacacgggctctgatttaaattaagactccatcacttaccatctgggttagatggacaaatgatttaacctctttggagctagtttttaatctgtcaatatgcgttccttaccacatcattgtgaagattaaatttaaaaaataaggccgggagtgatggctcatgcctataattccagcactttgggaggccaaggcgggtggaacacctgaggtcaggagtatgagaccagcctggccaacatgatgaaaccctgtctctactaataatacaaaaaaattagctgggtgtggtggtgcacgcctgtaatcccagctactcgagaggctgaggcaggagaatcacttgaagccgggaggtggaggttgcagtgagccgatagcgccattgcactccagcctgggcgacaagagtgaaactctgtctccagtaataataataataataaaataaaataatagcttccagttattgagcacttgctatgtgctaagcattattgtaagtgctttatgaatattagctcatttaatccttacaacaaccttatgaagtagtcactttcatcatctttgttttactgaaaagacaacccgggcacagagagtaatttccccatggtcagagttaacaagtgtcacagtgaggcatcacaaacagtctgacctgagtccatgatcttgatattgaactgtaatggctttgtggaggtatcaggcattaataataatataggctgttattattcagcatgttttccccaagttgcaagccagtataaaagtctgggccctgctgccgttgctgtcattgggatgttggggcctaaccactaacccctaccattaactgatgttagttacaacttccttcaagtgccacattctaaattacatttctggctccattgagcatatttcctgaagccacctaacagatttaggcactggtcacttgatgtcagccgagcaaggactctagctcagagacaagcaggcaaaaagccacgctttcaccctggccatctgcagctgttgtcaataaagccggttgcagaggatatggaagtcggcagacgcgcttgcatctaagggctgaacacaaggctgtcagctggaaacacagccagtgctttcggctaattcctaacttcctattagaaataaacaaaaagcccgccctactgaatttcccacttggcttctctgcttggcagctagtccctaatgcctatcacctaagatagcaaagatattaggccgggctgctggactagaacaaaaaggatgggaaaggccgcctcttccctgacctctgctccgctgagcgactgatcctgtgggaatctagatgcatcagggtttttggggcgggaaggagcaggggccagcatgtggggtgaggggagtactaagcagaagacaaaagaaggaaagaatgttgagtgagcagagtggacaacaagctcaaggacccattcctgttagtggtctccctgcatcttgctggaagttcaggcccacccagggcccactgagcaagtctgtctttgggtgaggacagaccctgacagactgatgggactggggttgcagggagattctgtctgaggatctagaggctgctctctgtgcagttaaaagtggatggcccagcttgtggctgaggctggaagcctctccctccacagcatgcccctttgactttgtgctgttaacgcctgtgtctgtgggaaagaacatctctgtggacatgctgagtttcctaggcctggatgccacacacacctagccattgttgtcggcatttggtgtcaccatgagcagcttcctgggtgacaagatacctgccggagttgacttgacttttctccccagatgaaaatgccttcctgttgtgattttgtgccaccacgtatcaaatttgggctggtatttcggaggctcttttctttttctttctttcttttttttttttttgagacggagtttcactctgtcacccaggctggagtgcagtggcatgatctcggctcactgcaccctccgcctcccaggttcaagcaattctgcttcctcagcctcccgagtagctgggattacaggcatgggccatgatgcctggctaattttttatattttttgtagagacggggtttcaccatgttggccaggctagtctcaaactcctgacctcaggtgatccacccgcctcaggctcccaaagtgctgggattacaggcatgagccactgcacctggccagctcttttcttccatgtactgtactcattttttaggcatattccatccccttagggcagggctgagtacgtaattggtagggctcagtgcacaatgaacatgtagggagggcctcattctaaagttattaagaattgcaagatgacaatcgcagagcattaaaccagctgtgggatccttccagctcagggccctgcatgcgttctaagaggctacatttctataggcaaggttaactgggtcaaagatgacactatacatttttggtcattttttattttagaatattttaatactgtattaaaagattaaaacataaagattttaatcagtcattactagttcttttttaaatatagaggtccttaaatttgggagatatgaacatctaggcaccccttctattaacacttaactgattctaatcactacttaaccctaattttcacccatccttgagtagcactgcatttcccatctcacaggctcctctgtggctctgaaatgtctcgtcttaactggagtaggggtcatctaaggttgcggcagctgtcatgtaaccatgccacccagagaggacaatttccctggggaaaggaagtttatttcccagttgtaccgcttgaaacccagggagcagaacctgggagattaacacctacagcacagaggacgaaaaacgttcagtattgtccagcaagtcaaggtgggaattccaggagattagaggcagtgccaggtgcctttccaccagttgcttgggtggggtcaggaaaacatatcctcagaggacagaggccaaggctttgcccctctgctcttcccacggctcctattctctggccctggctctcaggttatcctttgttcacctgaagggtcctaactaaagttgccagattcaactaataataaatacaaagttcaaatttaactggatagactgtattttatctggcacccccagtcctaaccctggcaccccccgccccaccctgtcttggctgactcaggactggcttcttaatgactgtaactgctccccgaccagtgctctccccaccagcatctcccaccaggcttccttggacttagctgctgatctgccttgccctgccctgcccagccctctgatggggacttcacagacaagctgttaaccaccatggaagatgccagtgccaggcggagactcatctccgacctgcggtcagctctgccgggacctctgtgcattccttcccagtgcagctcatccttggcactgagacccatggcgggggagggcggagcacaagcttagctccatcaccggcctgcagggtaggctcagagtgcattgaggtggtaactgtggcttgggaatgcctattagacaagttattctcctcaatttcatttcattttaaatttccctttttggaaatgagcatgaaagtattgagtgtcaggaatgtccacatttcttgatgatatgtcattgaatcctcataacaatactatgaggtgagtaatattgtccctactttgaagatgaaaaaactaaggttccaccaccttactattggtagatttcaaagcttgaattaaactctgatcttctaaatccaagcccaggagctgggtgcagtggctcatgcttgtaaccccagcactttgagaggccaaggcaggaggatcgcttcaagccaggagttcaagatcagccaaggcagcaaagcaagaccccgtctttaaaaaataaaaataaaaaaataaggctggcatggttgtgcttgcttatcctagctacttgtgaggttgagatggaaggatcacctgagcccaggatttcaaggttacagtgagctatgatcacatcactgcactctagcctgggtgacagagcaagagcccatcttgaaaaaaattaccccaagcccatgctttattgttgcacagtttcatcattgaccacccaaacagaaacttttgaataattaattgttcatacctcactctttctccaatctgatccctatgtccttatgattttgccactgaaatgcctcttgataccactgtattggcttcctagggttgctgtaacaaatgaccacagactgggtggcttaaaacaacatgaatttattcttacagttcaggaggccaaaagtccagaatcaagatgtcagcagggtcggttccttctggagactccaaggggagaaccatcctgtgcctgtctccttgcttccggtgattgccaacatccccgacattccttggcttgtagctgcatcactccaggctctgcctctgttgtcacatggcttcttccctgtgtgtctctctgtgcttaggtacatctctctctcctctttcttatataggcatcaattactagatttagggccctcccgaatccactatgtcctcatcgtaactaattacacctgcaaaagaccctatttccaaataggatcacattctgaggttctgggtgaacaggaattcttgggggacaccattcaacccagtacaactgctatctctctactccagactttcaccatcaccactgttctgctttgaggctttcccctctccaattcatacattgctcaaaaatttgctttctgaaaagcaaatctgaccacagcactccacaacttaaaaatggtcacatatctaaatggcttctagcagtggttctcaaacttgagtgtgcaaaaggatcacctggagagcttcttaaaactcaggttagagagccccatcccagagcttctgatccaacaggagaagctggaatctgcatttcaacatgcgtaagatgattctgatgcagatggaccgtagaccatgctttcagaaaggtctatagcataaaatgcaaaagcctaacaaaacccagcacacagaaagcactcaacgaaagttaaccatgatgattttttattttcatagctttgctcattttgcctacttttcctgggaattttttccctccttttatcacttggaatagtttcttttatccttcaaaatccagtgacgaggccatcatctctgtaaaatcttcctggacccccttagtgccatattagttactgtcttcttgtccattcccccataattattgctggtattctttgttccattaccatattatgcaaaggaatcacacatatttctgtctacatacatgaacagtttgagggcacctaccattctgtagggcttagtagagtgtctggcatattttataattaaactgcttattggccaggcacggtggctcacgcctgtaatcccagcactttgggaggccaaggcgggcagatcacctgaggtcaggagtttgagaccagcctctaacatgatgaaaccccgtttctactaaaaatacaaaaaattagctgggtgcagtggcacgcgcttgtaatcccatctactcaggaggctgaggcaggagaatagcttgaaccagggaggtggaggttgcagtaagccgagatcgcgccattgcactccagcttgggcaacaagagtgaaactccatctcaaaaacaaaaaataaataaataaacttcttatcacatctcttcatacaattgaatgttcaatttattgttttaaaatggaattgcatgattcttttcttaatttaattcaataattatactagctcctctttcttcctaccacgctgtctgttttctctctcccagatgctccaagtttcacactgtggtcagtgtgcagtgactagtctggctggattgttttgcattccaaataccttatttaggaactagggcttaccacccactcatagatacaaccctcaattctggtggcaggaatgttctttctctgctctgcctgcagaatccataggaaggccaccaaatgctgtgcttcaaactcctaaggaagtttggctcctaccagtggaagctagaagcttatttactggcgcaggccatggaagcgagctgccttggtccaaaatatcatcttttctctctgagaatattatctcaagaccactttatgcaataaatggataaatgagcttttcatgggcctgtaaagatttttgagacttgaaaaactatatgtatttttcaaaataaggaaaggaaactccagaatcaaaattgataaattgaattaaatgtctacaaaatataaaatgattccaactagccagctgcatctgagctcaactctgatgtggttatatatgttctatttcatgtggagcacattttaataattttttaatatgggatgtggtctccgaaagcaaaagtgcctgatgtttgggaagttctcaaaatgatcccatgttgtctgccatgacagagctcacggctttgagtggagtccatgtgaggagtgggagaggagggtccttatctggacagtcagatccagagaatcacatggaaaatcatcccacaatccaggcttttggaatgtggttccacatgtgaaagagcatttgtgtagatgattgctgctcagcttttgacactgaggtccaagccaattctgaccaggccagagggggcaccagaggcccggatccaccaaacccaaagggcctaaaactcacattgtttgcattgcatcaacaaatatctactgagccctgttatgtgtctagaactctgctagtgatggggaacaccacagtgagcaagataggcaccatccctgcctcaaggagcttacagagcagttaaacaaactccaagaagctaaccaccaatagaagaaggaatgcaaagggatgtgcagattatcatgggtgtctggtagagaggttaacctagtctgggagtgagggaggaccactcagaggaactaacatttagtatgataactgaagggtgagtaggagtcagccacaggaaagcgtttcgcacagaaagccccgtgctgccttaacatggtgtcagatgccaggaatgggcatcctctgtgtgcccgctattctgaagccccttctgattggcccagtaacatctctgaatccctgccttggcttcctgatttgccttgagtgctggaactacagatagctttgccgacgttgctggggccctccccgcctggaagtaacagcctctgcactagatggtttgccctgggtggcccatgcaaagctgtactgctgctgccacctgttcccaggtaccgccactgccctggaacaccacaccccctcccaccccatctgacctcctcagacgtcagcccaggtcagagcacactcttgtgtgtctccctcctttggcctcagtgactgcaggagccagccacccaccctattgcagtcccaccatttccttccagctcaggcctcaggttcaaccacaccatgtgacagatcctaccagaatgctgaagtcatagagcaatgtttcctaaactagggaatccaatgcatcctgaaaatatatccatgcactccagtttgaggaacactgcactgaaagataatgcagtcacttctagttgacatgattatgaaccaaacacaaatgtgcgccttgaaacttcatgtcagtactcttgcatacttcacaaatgttgtgaatatagattagatgaggcacataagacacctggaactccatctgaagaggccatgtaattacgaatgtgtattattatttgtcttcatcctgtctgccagctgagagagacagccagcctacatttgctcagcagcctggaactttctcctccaaagaaaacccagttctccctatagaaatccaataaggccagatatttaggagaaaagtcactggtttctacccctcagagattggattttggttttagattctgcttttcaaattaacttgtctactatgcctatctggcctaatgcttaaaagaaaaaagaatgtttgaataacctttatactagtccccaacaggccaagggctctgagaaaatgagaggatctggagaagggtagatgcatgcacacacacacaaacacaacccacgtgcatacacatgtgtgcacacatatgttctaagagtgcccatacaggtgcatgcgtgtgcacacactctcacacacacatcatccagctgtgctgaagtctctgggtagagaaaagggtactgacctgtgtttacactgtgccttttgtctggggtacgcaaagttccttccaaggaaggcaggctttgtcactcctcaccaccccactgggaggcagctgccccaatcaagtcctgggggatatcccgctagagccctgtgtgtcccctctaaactctcctttacccccagcgcaaccctcctcctgaacaccggcttcctgttcctgggcattttgtccttaatccccctccactgtcctgcccactgtcttgtaaggtgggtcggggggtggggggacatacaaaaaaatccaaaatactaagtaagccggggcatctttatctttcctgtgactcttctggtttggtgtgtctgtacttccagggaacttgtcctcaggcgggcctgagtaggagacaaatcttcagctgctggtggggaggggctagaatatttggagttttcagtgcacttattcctcagggacttttttttaaaaaaagaaagcagccgagacccagagtctagcaaggatccatagtcccaaattctgctctggtagaagacctggtaaaatgctgcattggtctcagttttgtatttcgtgttgctttctttgctgggggactcagatattaactccattaatagtttgaatgcagtgcaaatgcttctccttctgtagttattgtttgtgtttagctggtctttgtctagaaatgatcattgctgcaggtgtaggaggaaggggcaccattgtgcagttctcagtctgtatcaaaggtttctgaaattgctgccctgagaagtcaggcaggttgagaggaggggagatctctttactttcctgaggctgttttctgcagtttggggttttggagaaggcatcaaggctgaaggacggtgggatctcccctagggggcctcaaggcaactgctgaagtcgtttttctcagtcctttcaaatcagatcttccttttcttttctttttcttttcgtttttttttctttttttgagacaaggtcttgctctgtcacccaagctgaagttcagtggtgtgatctcagctcactgcaacctctgcctcccaggttcgagtgatgcttgtacctcagccttctgggagtagctgggattacaggcacccaccaccactcccggctaatttttgtattttttgtagagacagggttttgccatgttggccaggctggtctcaaattcctggcttcacgtgatgtaccaaccttggcctcccaaagtgctgggattacaggcatgagccactgcacctggccagatcttccatttcaaacctctttcattctctgtctccctccacctcttggtgctgatttgtctgtcctgaggctttctggctttacaaagcatcttctggcactggacacgttgtctaggaacaggtttcacccccagggccctgtcctaaacactagccctgctaattttggctccacactgtgaagccacccgttctgtgaacctctttctattccctaaatatgccaattctctctctttttctttctcactttccctggagagtagagtctctcctggatgtgcagacatggacagtcagctgtccacgcggtttgctgtttttggtcttgtttcccagctttgcctgccaggcccacctctgagcctcacccacggggcctctgcttctaccatctccaggatcagagcccttgctaccttccttctctttgcccagaggcagtgggggcaggtgaggggaaggccccttgaaatctgggaggataatattcccactccctactccccaggcacttggggcactatgcctgaaaaggactgtttgggagattttgaatctcattttgtaatctctcagccatgcactgtgccaaagggagagaaaattgcttggattcaggtggcacttgaaatattttattttattttattttattttattttattttattttattttactttaacatctactatttatttatataagacagaggcttcccactgctgtttttatcccattcagaacatgttttcatagctgagcccctggccttgtaccttcttcctttccagcctctcagataaaatgggttaattggagggcggagcaggcccagcggctttcccctggcatagaatcgttgttgtgcctctcctagattggaaaaaaagaaaaaacaaactagctttagataaacagaaaagttgcaaagatagtacaggaaattcccatagaatcctcactcagtttccctgttgttaacctgttatattcccatggaatatttgtcacaattaagaaaccaatactggtacattatactagtaagtaaagtccaccctttatttggatttcactagttttctccccatgtcctttactgttccagaatcccatccaggataccacactgcacagagtcgtccttggcctcctctggcctgtttctgactgtttctgactttccttgttctgatgacactggcagttctgaagagtacttactggtcaggtgttttgtagattgtcccttggttttcatttgtctgctgcttctcccatggctagactaaggttatgaattctggggaggaagaccacagaggtgcagtacctttctcatcacaatgtaccaagggcacatgctgcccacatgacttattcctgatgtccattcacctggatcacctagctgaggagtgtttgccagggttctctactgccaagttctttccccactttccattctgtactctctgaagcaagccacactcaagggaggtgggggaaggaggtaagctccaccttccggatgagggagtaccgacacatattacttggaatcttctgtaggggagatcccagacatgttttttaagtaactcagacattccctccagcacttactaaaaggtcagtggtgctggatgtgtggattttgccaggttggtgccacagacctcaagtagagcatctaacagggccataccctgggggttttcagttccttggtatgagggaaagcgatttggatatgcagagtacaggacgtatgtgtataaacatgtaaccactgtgtaaaatcacagagtcattcaaaaatgtttagcaagggaccacaaatgtacagcactctgctgggtgctgaaggtgtggagtggcaaataagactcaatctaggtcccaggtgtggcgggctggaatgccatgcagttaaccagatatctctgcacacccactgtcagcccagttttgaagcagcaattacaagcgtgatgagcaataagatggaaagttccaggtactgtcagagagctcgggtaaggggagtcagtgaaggcctctctgtggacgtgaaggatgggcaggagtgagccaggtgttggcgggggagggacagggagggcttccaaggagaaaagctcaccaggcgagaataatatgtgttaaaaacaaactagtgtcaagagggacatctggaggaactgagagatgcttatatggaaagaaaactgcttcctgggaaaaaaatcacatgataatttagtcatatggaatagttctactttcttaaaataagcctgttctatacaatttaagacataaaatgcactagtgtttgataatagatttatgctttaatattctgctaaatttatatataaacatgcataagattcaagtgtttcagaaattaagtgctaaaactgaaaatgtgtactagagagaagcgtagaaatgactggaaggttattttagtgcaagctgatgtggccccagttctccatctcaggacagaggctctcatttccccagatgctggagtggtgcccactgagggctcacagccaggacatcccagacgttgccttcttctgaggggagctgcccacccacagtatacccctcctgatgactggctgatgcagaggtatcaaggcctggctccctggcctcaatctcagacaactctgagaagccatcccagcgtcagggcttccggtggggtgggttaaggcctctgtgacaactgcactgcagttcaacttcccctctgcccagtgctactcctctcacagcatgtcagatctggttggtccccaacatatgatggttcaacttacaatttttaggcttcttgacagtgcaaaaactatctacattcagtagaacccgtaattccagtagccatacaacttttctgtttctcactttcagtacagtatttaataaactacatgagatactcaacactttattataaaataggctttatactagatgattttccccaactctaggctaacgtgagtgttttgagcacagttaagggaggcaaggctaagctatgatgttcagtaggttaggtgcattttcaacttaagatagtttcaactcacagtaggtttatagggacataaccccataagtccagatcatctgtatggttttcgagagcattccccaataaactgcctacatgaaaatctctgcctcagaatgtatttcctggggaatttgaccctagaaaatacagtgtacagcagatataccatgtgttagtgtcctagtgatacagaaaggaagagcatggtccttttaaatgatagggaagccgggaagggaagtgctgggtagaggagggcgtggtccctggctatggctccacccccacggacctaagtgaggacaggcattttttttttcctgcccaaatgttgcatttcccaagaccaccctggcctgccgcgcccccatcctatgtctataaaaaccctgagaccctagcaggcagacacacagatggctggatgttgagagaagcagatcggtggaggaagacacaagtggctcgatgtcaagaggacgtcgagggaagtatgctggcaaaagagggcatgacagatgccggcatgcctgcaggccattgaccagcactggaagaaggcagagtttggctgggacagttggaggagagcccgggcagctaagtagcctgactccatccctttttggcttccccatctgctgagagctatctgcactcaataaaaccttgcactcattctccaagtccacgcgtgatccaattcttctggtacaccaaggcaagaacccaggatacagaaagccctctgtccttgcaacagggtagagggtctaattgaactggttaacacaagtcgcctatagacagcaaaactaaaagagcaccctgtaacacacgcccactggggcttcaggagctgtaaacatcaacctctcaacactgccatggggtgggagccccacgacctgcccgtctgtgtgctcccctagaggtttgagcagcggggtactaaggaagtgagccactccccctgtcacacgccctgcgagggggacaaaggaatttctcatttcactagggctgctgtaaaaaatttatcacaaacttgatggcttaaaacaatagaaatttattctcttccaattctggaggccaaaagcctcacatcaaagtgtcagtggggatacactccctctggagggtagaggggagaatccttccttgcctctcccagcttctggtggctccaggcgttccttagtctgtggcagcatcacttcaatcctgccttggtctttgcatggctttctcccctgtgtctgtttcttgccctgtctcttctaaggacttgccattggatttaggacccacccaaatccaggatgttctcatcttgaaattcttaacttcattacatctgcaaagatagtttttccaaataagattataattacaggtttcaaagtggatgtgtcttttgggggggccactattcaacctgctgcatacaccaacatattaaagtgattatatcccagggtgggaatgggatttataggtaactttaattttcttctttgtactattttgtttattccaaattttgtacagaaggcatgtataacttctgtaatggtaattttttagagttgatggtttgacctaaagtgtgcagtctggattaaaaggtacctgcctcgtgagtggagggcaagaggtaatggccacagataggctgaaggactctcccattacaaaatgactggatcccaaattcttgaataaagtccagtttttaatacattgccgagcttacaagaagtatggtgaatccctaagttctctcccagtcttttctgacccaaattcaagagttgaaactaaacctgggtaaagcagtaaataaccaagagtgaaagttgacctgagagtaagtgcctatctaggagctagtccagaagaaaaagccttgggctagaggtaaggtaaggctgccacattaaatccagggacctcttaaggggcttatgtggttccaaattaatgcatcatctggatctagacagaagcaaatgcaaactccctctgcaggaaagcatccccactttaggaccatagttccacagattaagaccatgacaatgcaggcttacaatgaaagactgcaaaatgcgcaaggaaacaaagccaccatgtacaagagtcaatggaaggaacagaaaacagatttaaaattattagataaacaaaagctctgcaaggatttctacaaatcaaaaagacaacccaagagaaaagatgaaaggagtcataaaacaggcatttcacaaagaaaaaacaccaatgtttgataaacacgtagaaagatgctcagcttcgttagtaaaggaagtacaggctgttgataaatacaaaatcaatatacaaaaattaattgtagtcaccacctgtgggcagaaatttagtggtttgtttttttaaaaaagatactactgcaaagcaataaaagtagtgtatttcatagaatctaagacaccatcagtgatacgatgaaccacgactttatgcactctaagaaaggaaaaagactgccaattataattgcaagatgccatcaactataagacacaatccagattgtgggcaaaagtgtgagagctatgtggagaaaagtataactttatccaaaggtactaaagaaggcctaaaagtcaagaagtaatctgagttcatagacaggaaaactccctatcacaattacatcagctttccctaaaataattaattaaagcagttaagccaatgcaattcccctcacaatcccaacagaattttttttgagacacatgacaagataattccaaatttaggtgggctgtaaagtattaagaatagctaataggccaggcacggtggctcatgcctgtaatcttgacactttggaaggccaaggtgggaggattgcttgaacccagaagtctgagaccagccttggcaacataatgagaccctgtctctctctcaaaaaaaaatatatttaaattggctgggcatggtggtatgcacttgtggtctaagctactcaggaggctgaggtgggagaaccgctggagcctaggaggttaaggctgcattgagctgtgtttgccactgcactccagcgtgggcaactgagtgacaccctgtctcaaaaacaaaaaaacaaaaaaaaaagctaataacctctgaagaagaagaataaggaagagggaatttctctaccagatattattgacttattataaagtggtgatcaagataaaatgtactgatgccagaatggaaaaactggccaatggaacagaatagagagcccagaaatagacctgccaaatatggaatcttgatataagacagaagtgaagctgccgattcctggaaaaagaaagggctagtaaataagtaatgataattggtggttaataaggcaaaaaattggatccctacttcacctctacccaaatatcaactcttagtggattaatgatttcaatgtgaaagacaaacctttaaaacttttagagagaatactgaagaatatctttatggcttcagaatacaaaaaattcattagacacagagagcattaatcataaaagattaataagttaagctacattaaaattaatataccacaaagaaatagaaaaaacaaaccccaaactgagagatacacaataggatcaatataggatttgtttccagaatatgtaaaagatttctacaaatcagaaagaaatagacaaacaacccaagagaaaagatgaacaagagacataagcaggcatttcacaaaagaagaaacacaaatatgtgataaatatgtggaaagatgctcggcctcattagcaaaggaagtacaggcaggctgggccattttaaggccctcacagtccctatgtaatgcttatttctggaagtctaatcttataatatttcacataccatcatgcatccacatcccacatgaaatttattcattcagtatatatttttgagtgcctactggtgccaggaaatattatatgtgcttgggatgtattgctgaataaaggagacggggtctctgcctctgtgagcttacacatgagtgggacatagacaatgaagagaaggaggtgaactacgtagaagtgtagtgggaagcgacgagtgctgtgggctacgaaagacaaagcagagcagggtgaggagaagtaggtaagagggacagaggctcttggctggtgcaacttaccccacaggtgctcacagcatttccctcactcatcagttcccttggacccttccgtcaggcagtttcaagtactgaaaccccttcctggggtttcagctaagaatggtttagagggctaatgcactcagaggtctttatgggttggtgggtggaagtggagagaaacccttgaggacacctccaccagccccatcctattcagataccagtggcaggtcaggggtagtaaggacattgcatcggcttcccgccatcttctccagcacctccctctcctgtggcccatccagagaaggggcccacctctccaaggcccactagatgggacctttcccagatgagagtccttggacaccaggctgggtggcaggaggggagccaggtagctcagactggacagccggtcatccctgtagacacaggctcacagtgctgcaggaagcaggcattttctgcagtgtgatcctttgatgcacccccttgcacaagaaagaatctacggcagctttctgaactctgcaggcaccacttacatgtacaaatttggtggcgtctattccttgggagttataacagtccaacaaacaagggctcctgtgtatgaaggcccaaagatagggctgccccagcagcagaaacagaccaggaaggcactgcaggccagtaatggacgcagcctttcggaagtccattcacaatgggactggtgtgatggtggccctttctttaccaatgtccccacctgagaggctggacatggaccccccagccaccagcgctggcatcctaactctgggggcctcggttcccctctgtggggctcccctctgtggctccccttgttttcactttggctaagctgcccaagcacaggctgcagctcagtgggattagtgctcagccctacttaatcactttgttgccccccaacctgttcatcaaaagctcctactggcctggacagaggatcagttcatttcttccaggtctgcagagacaaaggcactgctatgaggtccccagagggaggtggccaagtggcttctctttcataatggaattcgacatctccttgtaattagagaccacacaggatgggaaaataagagcagggtagcccttctagcatgaaaacccatccgcctttaccaagagaactgccgagaggccctgcattccagtcccagctgtataaaactcctggcctccttcagtggttatcacagcctctttttcctttgcctgcctcctagatcaaattcaaggtcctgtctctgagacaaggttcatgtctcaggatcattcagtcctcaagaacaacctcccaagtcttgttgttcctgaggctcctgtggcagagaaagacatttaataaaggcattgagggggtggaaatcaaacaaactaaaaccaagtggaaagtcagaatccatccttaaagaaatgtgctcttcccaggagactctcccagggagctggtggaaaagactgggcctgaggaccctggagcgaggagtcaatggaggatgctgaaggttgagaggggcacagtgcgcagctacagtcatcagcaaaagcagcttccatcgtggtgtggagggagcagccagaccattccagcacatcgctcctttgaatgctgggtgtccacgcccagatggcctttccctaaaggaatgcaagcctgtcaccatgcagggtatctgtttgcctccatgccaacagggcagctcggccagaggacactggagtgtgtgtttctatttcaaatctccctgcaaaccactttccttgctaagatgtgtacccctgctaggagcatcaggtttccagaaggaccttattcctggggccaagtcagtgtttcagggaaaattgtttttttccagctacacctctgggactgcctctggagctggggtctattggttcctttctttcttccaggcattttgaggtcttgcctgagagcttagaggtctgcccaagcctctaatcacggctgcttctttgttcttcaggcggtgacctttactgacatcatctcaacccccatctatttgaatctcccattcttttttcctctttctgggttagagtgaaggattttactctcaggggcctaatcctgtcgctcttgtgtgtgactaattccctcccctcccccttggctcctgcaaagaggaaggggcctgttcgcctgactagagggtctgcggcccttgtcagcaatcaaagcacaaacatattcctccgggtgatttcctgccctgagagcccagcccggaacacaagcctcctctgttccctcacagcccaccagtccctgggactgggacttaggcaagaggatttatgatatagaaagtaataagtcacccttccaacctggcaacgtctcgtgtgaaagcaagttgtattgttgttcagacaatggctcccaggaggagaaatagcgtccctcagagccccacagtcctctagtggctgcctgcggcttagagtgtgcagaggtgacccagcgcaggatggaggccttagtatccccagggcaccccatggaccgtggcgggtcagctgtggctatctgatttctgaagttaaaaagcacataattatggtattgtttgactgccaagaattctgggttaatctcagttttattttgactgctacctaaaatagtagcctgtccccaaggacgcagtaaaggccaagaagccaaaaacagaaaggcaggcctgagctctaggaggccctcactcgggagttctggagaggcttatgagtgcatgggatccggtaccgggagccaggtcacccccaggccctcccttccataggcctgtccttagccaccggccatggccgcccctcccccatgggacctggccgagactgtggagagctgcaggatggccagtccccacacacccattgtctccctatgcactcaggacagtccctgagacagtgtggaggtctgcttctgtgatttggggagacaataataataataatagttgtcattactgagcacttgtgatgcaccagccactgatctaagtgctcctgcatatggtaactcctttagtcctcatagccagtaggcactctggcaatctcctaacctggccagagccatatggctagtaggtggtggaaacagaattcggacctgaggaacccttgctccagaggccacctcccctactttgtcacatggcctctcaggaggtgagcagtggcagaacttaaaggctcagaaagaacagctcccattggaatcggtgagaggcatcagttcctaagtggaggccacgagaatgggcttggtgaggggtcgttctccttcttggagcacagatagaagatgtgcctcaagcattctccaccatacttaggtcagcaaacatttaccaagggttccagtctgttctagaggtctcctggccactggggcctgtatctctaggaaaagttccgtcgcattcccaggagaataacaatacaaagtcatgtgtgcttagagaggaatgcttcctgcatgcagtcagggagggcttcccaggggaggggacatttgagttagatcctaagggatgccaggattcttctgggttgacaaagtagaggtgaactctctgggcagaggggacaacctgggcaaaccactgctgtattcctccaggctcaagatgttgttcttgaggattctgttcccaaggattctgagccactgggccctgggctccagtctgcagggcatggcaggaactgagtaactgtcccctcccagctactactaatccctgccatgctgacttcagaggaacctttcctacccttccttcctgccccacctagatgccacccttccagtctgaggcatccctgaacttctaaagtgcccagagctgccaatctagccgctaccagtggccactattccagcggtgctcccagggtcagcctcgcctcagccagaagcacctgcggagctggctcaggctagccctgctgcccgacaccctgatgcactcccaaccctgctccactccagccacctcctgccctgctaatggcagggcaggcagacaccatgagagcgcagggcctgggagttccggcagcttcttcattcttctcccctccccacaagtgagaaaaagacacaaggaaggccaaagggccaggccctcaggcccagggtgtgtaggggcgggtgggtctgtgttcctctggctccggggagcatcctcctcctttctaccttttgtttgtagttgttcatttattttaataaaagtgattctgagtttttattaggaaaaaacaaacacacaaggaacaaaggcagtaggagttttaagtcttggcctgtggaggaggcagtcgcagcaccggagcatcgacccaacttcgggtctccatcaggcgctgtggtctgggaaggcgagtggccatgtaaggcaccactgttcagagagaccagggtctggaggcagaagcccctctactgaatgctcctgcaggcccctgtatcagcagtgaagaaggatactccaaagttaggtcctgttttgcccaagagcacacagccaggaaagagtggcaccagcctccagagtccaggatctttctttctgcagtatctcacaatttcaacttgccctctttgtcttaacacttttttcttaaagcctccagaggaagccttcattcagagatgcaatgtgcaggggaagctgcacgtccacagagctgaggccccaggcaacccagagcatcctaaaaccctgtggaacttcaggggagaaacaggtggaaggagaggccttcccaaggaagtgaggcatagccagctggcagccaccacctcatttctttgagagcttcacaaatcccagtcccttgcttgactgaggatttttataagaaagacccacgggtttattctacaacataccagtgcccaggaaaattacatgagcccagaagttcaaggcaatagtgcactatgattgtacctgtgaatatagccaccgcactccagcttgggcaacataatgagattctgtctctaaaataaaaaattgtaaaattcaactttgagcaaatcataagtgaacattcaaatcttcatgcatcaagggacccaattcctcttcccagaaggatcagagattctctctccatcagaattgccgtaaacatgaacatcatgaaacacttgctgattgtctatgtacaggttcaaaggacttctccactgcagttcagcatttatcaccagtgcttagctcgttaaactaattatgtgcctgcatttccacattgaaagtttaaatatagaggctgggcagggtggctgacacctgtaatcccagcactttgggaggccgaggcaggcagatcacgaggtcaggagatcgagaccatcctggttaacacagtgaaaccccatctctactaaaaaatacaaaaaaattagccgggcgtggtggtgggcgcctgtagtcccagctactcgggaggctgaggcaggagaatgatgtgaacccgggaggcagaggttgcagtgagccaagattgtgccactgcactccagcctggcaacagagtgagactctgtctcaaaaaaaaaaaaaaaaaaaaaaaaacaagaaagtttaaatatagagactaacttactcctttttaatttctttgtcaaagcaaaagctgatgcaatagagggccctcatacaacatggagcatcaaccatttgctaatggcagggtcccagctggaccttccagagtagtgggctctatgagaacctggagatgagagtggggtttatttggaggcttccctttcacccagaaacgattttacaggcggaaaaagataaactaataaacctgcaactctattggtggtctggggaggcaagtggccatgtgaggcaccatcatccaggaatccattgacatctttttgaatatacttcagctgggcgtcatggctcacacttgtaatcctaacactttgggaggccgaggcgggcggattgcttgagttcagtagttcaaaaccagcttgggcaacatagggagaccctgtctctaaaaaaaaaaaaaatacaaaaattagctgagtgtggtggtgcatgcctgtagtcccagctacatgggaggctgaaatgggaggattgcttgagcctgggaggttgaggctgcagtgagccgagatcatgctaccacactccagcatggggtaacagagccaaaccccgtctcaaaaaaaaaaaaaaaaaaaaaaaagaaaaacaatgtagttcagatggttgtgaaaattagacagcatttactttatggccaagcatcctggagggactttacattagttcacttaatcttcatgacagccctttaatgtagctatcatctccattttatagttgaggaaattgaggcccagaggtgtgaagtagtgcatgtaaggccacagctaggatatggcagagccagtagttaagcctgaccccagaatccctgcccttctcccatcatactgctgtgtcctggcccagcatcgctcctcacactgcagcctccctctgcaccacatgccagcgctttctcaccctgctgcattagtacgcattctaccttcatctttggggtctagtggtttcagtctttctagggagagtctgatcatatgtatcaaagtttagaaaactacttctatcttccttcattttctacctgcccaaattccatttattttaccagactcaggccaaatgacatgtcctttgtcatgaaacttctcctcatcctctgattggaattcaacatctgctacaagaatgcaggagtatgtttaaatttattattttattttaagagctgtgaacgcaggaagtttccagagaaagtctttagacacttggaaatattaaatgtgacaaacagaaccaagtaacaaccaagtgaagtgaactttaggcttccctgtctttttagagtaatctgcaaatgaacagacaaaaagttcaaccctctgccaccataaataaaagagatttgcaattgctttgattttgtttttaatattaagcttagacccctccaaaaacgcaggccacactctcagactcttacgcaattttccacaatgagcagccccaataacaaccctgcaaaggaaaccatcctgtcacctgaagacaggaatctggttgcgcacagttctcttatctccaattcttttttttttttttttttgaggtggagtctcgtgcaggctggagtacagcggcacgatctcggctcactgcaacctccacctccctggttcaagcaattccactacctcagcttcctgagtagctgagattacaggcacatgccaccatgcccagctaattttttttgtatttttagtagagatggggtttcaccatgttggccaggatggtctcaaactcctgacctcaggcaatccgcctacctcgacctcccaaagtgctgggattacaggcgtgagccactgcgcccagcctcttatctccaattcttacttccatgtagcccttggcctaaatgcaaaatcaactaacttttgctgcttaaaaaactgcccccaaatttagttgttcaaggcaacaacaatttatttaattcacaattacaaactcagcaattttggctgggctcagctgggcctccttctgggctgggctgggttcactcatgtgtctgtgatcaagtagcaggttggctggggactggttgatctggggttactcagctaggatgactcatctctgctccatgaggtctctcatccttcagcagcctagcctggccttattcacatggcagcagcacagatctaagagtataagtagatactgtgcggtttcttgagttctagctaagaacctctacaaccttgtaacctctgcgttctgttcatcaaaaggccagcccacattcaaggagtagagaaattgattccacctgttgatagaactgcaaagtgttgtggcctcagtctgtatctaccgagcccatctacagcttcaccactcgtgcacctgcatctccctgcctgagtgcatgctctgctcctgagagcatgtccatctcctgcataaagcagactagaagatcagagtggatgccctccagtcagccctcagccaatgaggaggggagctaatggacaaatcccacaagttcctttcccttagataatttcaaggtgtgttctacacagattctccaaggcgctgtgggagattgaacccaagtttcctatggtggtcacctgctcatgaggcaccctttctcggcattcctcttggttgtctcaacgtcccctctaccttaccacactctggggatcagctccctcaagtgatcttgcagtacttgaaaccaaatccttttagggcctggttttggggaaatctatgctaagacagagagataagagtcagatcacccttgatctcacaggccaagctaatgagtttgaatttatcttgtaggtgattgagcttcagtgggttttgagcagagaaattggtgttttacaaacaatattagtggcaaagtagaaactaataatacccagttccgctgacttcaggccagtgctgtgacatcaactgtatgctattgctattttaggctttggatgtgagaatatgcagatcttcttttaaagttcatttatttttgaataagtaatacatacacatggtgcaaaattagaaaagtgcaaaagatcttttgttagaatcatttttcaacaccaaaggagcatttaaatagccattgtgtttttagagtgtgttaagacatagggagctagctcttggctccttctgagaccactcactcctggtggcatcttgcactctcactcctgcaaactgttctgggcccttccaacaccctgcagctcgcaaacctctgctggaagggcaggggagagacgctgacatttgtggcccaaagtaaacttggcagggttggtggatgccatccttgctccctgtcaccacaaataattgcaagctggctgagcgctactcaaacgcattaaggtttgtggcttgttctgacagaaattgaaaaagggcaacgtcaaggccaagcctacagcttttatctcggttagctggggagaggaagagataatgattcacaacactccaggtcttcacatttctcctgaagagccaccatctgtctataacgtgagggaagaagtgctgtcaggttaattgccttgcgtcagccaaaccgtctgcatttatttaaatcaagtcaagtccataaatagtttcgagtgtctgctgtgggccagctctgagctcagctctctggggtactcaagtaagtgtgagccaccagctctggcaccctaagaggcaggctggtgatttggcagttctggtagcttagaaccaggcatgttcagtaagaatcccagccccatcatcaatcagctgagagatcttgggcagctgagttgatctctccagaacctccttttcctcacctttaaaatggtcctgcctactgcaaaggggtagatgaaaatctccaaggcaatctttgtttctgtcatctttcctaggaacttacaacctttccagggaaaaaagacaattttactttgtgaaaagttaagaaaacatttctaaaagataattaactgttcaaaacaaaaaaagaaacaagaaaagaaagtaggtaaacacaaggggtgatgaactgccagacatcagtgtttgctctagaagttgagccaggaagaatagcaggggggaagaacaaggaggtgttcctggtttgtaattttattccatttttgcctaatacaaaattgcagtgcctggcacatggtaggcatgcaataaatattgttgaatgagtgttcaagtaaataataaatgaatgaatattctgtacaggttttgtcactgacccttaggaaaggtacccagaggagagtatgcagagatgataaacagatggaatgggagattttattttcaaaaaaaatgcttttcctgagaaatctttctggtctgtaaaggcaggagttgaaaatggatatgacagaagcttacaaaactgcgaaagtcacggatgagactattatcatcttttttaggtttttaattaatttataaatcttcatttaaatattgtgttgctagaagtaggtacaggataacctttgaactatatgaagttttaggacatctgaaaaaaaaaaaagaaaggcggtcttagttgtgattagtatgttaaaagaatttttatcccttcacactggaggctgaaaatacaagtaaagccaagagggatttgatgaattcatgaaggctgatctcagggtaagttgcttcagattcctcagggattttgaagcttatgttctgaaggactcccatgttagagacagactgctgggctgtggtgaccctggacctagcctaggagcacatttctgtggttttgtgtcccttcagggaatatttaataaactcccactatgtgccaggcagtgttctaggggccaagaacacagtagtcaataagatggtgtcctagacctccaggactgccaacctagagacagaaggcgatatgggaagaaatacatttcagtgtattaagttccataataaaagtatgatggggccgggcgcggtggctcacgcccgtaatcccagcactttgggaggccgaggtgggcggatcacgaggtcaggagatcgagaccatcctggctaacacggtgaaaccctgtctctactaaaaatacaaaaattagctgggtgtggttgtgggtgcctgtagtcccagctactcgggaggctgaggcaggagaatggcatgaacccaggaggcggagcttgcagtgagctgagatcgcaccactgcactccagcctgggtaacagagcgagactccatctcaaaaaaaacagttgaatctataaaaattgtctttctaattttttaaatgcctctcccccacctgcattttagaattcccatgtactcagaaaatgtttgtggatggatgaatgaatgaataagtaagtaaaagaatgaattttggcttccagaaatgggcataattttcaaatagaaatttattaacatttgaaggctcactacagtcaaattcactaagtaaccacttctaagattgctttgtgtgaaagtcctagaggctacatggtttaatagaaaaaaaaatggcatttcagtttttggaaccattgctgtgggtttttcaatctgcaattctagaaatcttgaagggggaagctctatgcaattgcagctacaggccaaaggtcatttttactaagtattgattttagcagcaaggaactcttgcttcagtaagacttctcacacttgccctaccctgaaatgagcacatttcactctgcatgttgctcaggaaggctgcctctctgaagagcctcaacataattcctacagcctggcatgcttgatgacatcaccaggaatttggtgattggaaggcagaggtccaggaaagaatcttggaccaggaatctggacctcattaaataattggtccttctgagaagcttagtcttgggtccatattcatgaacaaagagttctgtggcttcctcaagctgcctttctccccatctacctttcactacctcctgccacttattctccctccaataacaaactgcactaagataagaccctagagtgtgccgtccaatacagaagccactacccgtgtctggttatttaagtttaagttaattacaatgaaataaaattgaacatgcaatttctcagtcatactagccacatatcaaatgcacaaaagccacatatgtctcctggcaaccatagtggacagtgcagagaacattctcatcattacagaaagttctactgaactgtattgccctagagaaaaaggaagatgaaagctgaggatgaaggtggtaattttgaagaaaatgctgataacatctagaccagccatatagagataaggaacattctagcaggaagttgccacaggatgcaaaactaggcaacaagtgaagggtgtgaagagagagagtatagctttgggacgagaacccaggtttaatcctgattctaaccaagtgtgcggccatgaagaggttatgtgaactcttggagcctcaatcttttcataagggaaatagtggtgataatggttcctatgccatagagctgatgtgaaaatcaatgagacaattagcgtaaggtgcttagcatgctgcctggcatatggaaaaggtcaaaaataataaggcagggaggggtaagaaaaaagaaaggagagaacctagtgagaagacagctgacctggaaagaagaaatgtcaagagtatgtttacatggacctagacagtgagcacttttatgatggctggagagtacaaatcagaaggacagagcaacagaggcagctggacctctggaaacctgaggagcacgaggtgaacgtcctctggattaggggagctgtgccaggcggggcacaatcccatatgatccagtgttcctgcccatgtgtggcagcaggaattgtaccactcatgggagcttagctgtactcagctttatgccattgactgcattcttgagaccaagggaagcatgggacagatgtggctttcctgggacaggctgggtgaaccagggtcggggacagaggggtcagacaatgatcaagttgatacagggaattaaagggaagaggataacatttattcagtgcctgctacatgttcagcacttcacatatccagttgcacttcaccccacaacagtagccacctccagtttgtaggagaagaaactggggctcagcagagtgaaggaacttgcccaagatcacacagtcagtaaacgaaatttaggatctcagccctggtcctcaggattgcaaagcctgtgcaaatcagctgtggaagcccctaagctttgaggaaggaatagcaatagagacgtgcagagagggtttgaaaagagttggcattgcatttttttcatcatctagtagagttctatgcaatgtccatgttttgcaggtcacaaacatgaataagacaggattcttgtctgtaggtgcttccttagcagtgaggcagacaggctaagaacaagatgaggacaactaaaggtaaaatgttcaaactcatccctgtaagaaatactttgcttattgagtctctactatgtgccaggtactgtactaggctctggggatactctggtgtgctgtgtttacagaaatggttgcactttccccttttcctatatccacacccctttgcggcttcttccattaaagttgagtctattctccaccgattgaatccaggctagcctcatgacttgtcttggccaatagaatgtggtagaagtgacattgtacctcttccaaatcttgcccttaagaggcctcatacctatccattctcattcttgaaactctgtagctgccacgtggactcccccaggctagctggctgaataatgacagacacatggccctttcactttcattgtcccagccaatggtcagtcacctgacagacatgaatgaggccatttggacccataccatacaagtatatcttaagggaaaggaagcgataattaagccagcctcccacgatggccccagagatcaccattctggtattcacaccatgtgtagtttcctcccacactgcatcaagggtggtctgtgtaacaatggcacatggcagaagggatgatgtgttgcttctgatattagttcacaaaagcctgcagcttctattttgggtgccttctctctctctttcttatcattcattctgggagaagccagcttccacatcctgagaacacccagtcagcccatggaggggtcatatggtaaggaactgagatctccacccatagcctgagaggcactgaggtccacaatgagtgagcgtggcaggagatcctatagctccagatgaccaaagcccaggctgacagcctgaatgtaacctcttgagaaaccctgaaccagaaccatcgagctaagctgctcccagactcatgatccaaagaatatgtgagataacaaatgtttgttttaagctactaggtttgggggtaatttgttatgccagaaaagataactgacaaaaagcgttagctagataaagcagggggaggggatggagtgttccagacagagggaatggcatgatcaaaggtcctcaggtaggagggaatacaggaccagaagaaaccgaaagaagaccaatgcgacaggagttcagagagcaaatgaggccgaaaggttggtggggtcgagacctgctgggtgtggcctgggggtcttcctaacaagtttgcattaggagcaacaagaaatcaaattattgagggaccagcattaggggcttcaaggaaacccagatatcctggctaggataaagtctctccctgccaatcctccaaattagtaactttgggtttttagttttccctactcaaaggtgcccttcaaggtctccaagggaagaggcaaagggagacgtagcaaacatccagcatggtatgggtaaggcttctccagctccagccatgccaggcagccaggcccagcagagagctgtgcttccctgactggtcaggactggtccctccagcaggggcaaagccagaaacaaggggtacaggtccagggagggagcccacttcttgatcagcctttcttggttcccagcttcccagcttcccaccccctatccaccgggagtgagtttatactgttttacagagactaggacacttgaactcatatttcattctctcatggatttcgtccaactggcctaatcttttttctctaagtgacaaagaatctaaagatatggaatgttccccaaaacaactttgcagaaaagcaaaataaacacagcatcgaacaggcccattcatttcatgaattgattatagaaagataatttctatttttcttttaaaaatatatatttaagatagagatatgaaaaaattacatgatgatccatcaaggagatacattccaccatgattatgttatagcagcaaagccctagtcctaatataggacggttgagttgatcagataaagacttttttcccaatctacaatcctatagattgtaaatacaatttttaaaaactacaacagttttccattaaacagccttcctttttctcttcccatctctagtctaggagatattcccctccctccttcttgctgttccaaggacaatcaagggggactgcctgctgagcattcactaatgtcaatcctaatctaatgccagtaagacatccttatacagggtcacccacactaagagagaaggctctgtgtcctggagcccctggccaacacctgtacagatcaagacccacttcactgaagggcaagggaccaatctgaagacagagtgtgttgtcagaacatcagtgcttgctcaaaaccacttcccaattgggcagattcattggtctctctttcccttgagtgtgctttgaacagaccgcaggctggcttggagggacaggaagaagaagagatgcagctgtaaatcagtgtcacctctccaactcagggtcagaggaggagaatgtgcccacctccaggaaggcctgctgttatcagatgtgcctgagcagtcatgagcacgctgctctgctgccctgcagcctgtggactccccctcgttcttctcttttgcagcctggaaacagatgcccttgggaggggaaaagctctgacttcatcggggctcccaggccctcccttttccaaacagaacaaagcctacttagcttatcgcagcacttctccttgtgatttttttttaattggcctcttcacatgtgcaatcgactctcctgatatgaaagttgtgagccctgtttttgcaagcccgaagcttagaagctgatccccacgagcatcaacagaaatcatctgaatgctctaagtactgccagtgcttgctaaaaaataaaacagcctgccaacctcctcctgcctgtgtccttggcacagccctggcggggcaaaggagccccaaggaccccattgttctttggaaagaaagaagcaactccagccaattcaggtgtttgggggattattgagatggtctttttttgtagatatgatgtggtggtgaatagggtaagttatataggggactctatggtggtgacatttgaaaagattgaagagtgaactgaaaccggtttctgtgagcccaaagttttattcagccagtacagttctagaatttgctactaatatgtttattttctcccaaagatcttctccttttctgagagtaatgggacactggggagagaacttatggacaaaaatatggggacagaaaagattatgacaatttgtaaagtgtccacactgttggttggattagctatgtgagatgatgagggagaaagagagaaaaacaggcaaaaccaaaaaaggccccttggaaacaaagttaagatggtttttggactcatcctacctcctgtgggtttagcttaacatcagtcccatctgccagaggccggaggcaaggtgcttaggggtttaattgttctgtgagaccctgaagcaggatgagaagtggcctggtgtcagagtagagcagttggcccattactgaaggtcatggttcagaagttctcaacttactcttttctctattcaggttctatataagtgagcagtagaaggatatggttatctccttcctttattgtagcagtctgcgaagttccatttccttcttgaaacctctgactcaatggctagaggaaccctcccgcacccctcccctcctgtctatgctggcaacttttgagccgccccctcggcttaccaccttgcaaaacctgtcagatccattgcttttacacactgctatttacctcgttgtttattttgtgtatgtgggtcatctgttgtttaggttagattgaagtctggctgtgttggtgtagttagcttttgattatttccagaagaaagatagtacaccatatccatacaagcatttaatattacgttgttttctttttgatctaatgtccagcttcagcctagaaaacatcctgaatgatccaggcttggggaccgtcagagctattattattatttatttatttattgagactgagtctcactctatcacccagactggagtgcagtggtgcgatctcagctcactgcaacctctgcctcctgggttcaagcgattctcctgcctcagcctcctgagtagctgggattacaggcacgcgccaccacacctggctaatttttgtatttttagagatgaggtttcaccatgttggccaggctggtcttgaactcctgacctcaagtgatctgcccaccttggcctcccaaagtgctgggattacaggcatgagccaccatgcccggcctattattattattttaaagcataattatttaatgcggattttgcatatctactgcatttgatccctttctgaatagttttcactgttttatttaattactgtacttcaaaatacagaaattttggaaaacagagaaacactctttggtgtatatacttttagtatttttttaaatgcatatagatttattttctgttttcagcaataatattatacagtttgttttaaactgtatactttttttgtttttttgagatggagtcttgctgttgtcacctaggctgtagtgtaatggcatgatctcagctcactgcaaactctgcctcccaggttcaagcaattttccttcctcagcctcccgagaagctgggattacaggcgcccgccaccacacctggttaatttttgtatttttagtagagacggggtttcaccatgttggccaggctggtctcgaactcctgacctcgtgatccacccgcctctgcatcccaaagtactgggattacaggcgtaagcccctgcgcccggcctaaactgtatactattaaactgtatattgtttactttagtaatagatcatgaatggattcccatgttgctatagaaattataatggctgtgtaatattgaattatgtagatttatataagtaattctccattattggacttttatttatcaaacatttatataagcacttactatgtgccaggcatagttctaagctccaaatagatattaactcatttaactctcataataactttatgaggtaagtactatttacatccccattttgcagatgaggaaactgagtcacaggctgactagcttgtcccagggcacacctctttgtaagtgatggggccagattcaaacccagacgatctggctccagagtctgtgctgtaatcacagtcctctgcttgcttccctctacctctattgaaaagtaaagacctttctttcctgggagaatagcttaatcttaataagacttccctggcaaataagggaactgctgtcctgtgagtcactgttatttgtaattaattgtaacctgctgagacaacaggcaaagaaacatctaggcagaatgggcggtgtgagctctgcagcccagagaaggtgactccaggaggggctgtagacttgaatccaaccaggctgaggtccaggttactcacccactggcagaacccaagtgactctgcctcccctgaagctactgtaattgcctcacacccacctgagatggtctttcctttgcattctactacaggagctgcttcatctgacccaagctggcctggagaaaggaggaagaggcaaggtaggaagtggcctggccccctgctgctctgccccagagtgcagggcagaaactgcagctggagctgtggggtggtgttgatccagcctacaaagtgacttctggggcagtacctggagtgtatgagaatcctcttgttaacctgcagaagctccagcgtagttgtttctgggtgactctaggatccttattcatcgcagccttgagaccgggctttggcttcagccacctcctttcctatcctctcccttccagtaatgacaatatgatatcatagctgaccataattgttctgtctgacatttaattcattctaactcattaaattctcacaacagtgctatgaggtagaatgatggttaccataattatcctcatttcagtggtgaagaaaggcagccacagggaggctgaataacctgccgtaaggtggggagggtttcaggtgctgggagcaccacagagttgtgaccttgacttgtatcccaaacagaccctgagaagggagcagtggctggaggggaaactgcagttgaaccaccttgctcctcttaaccctagtgggaggagaagttctaaacaaacaattggcatttgacaggggagtgttagggctggaggtggtcggaagttatattttattgaagcaccttggcagttgtttgcagggctggtagtgggtttatatggcataacattcctgctctctccctgggaggtctgtcagttttcctttatttccgcatttacaagggagcccggaacacatacaccctacattcaaagtcaatgtcacagggtaaattggtccagggaggaccaattactgcagtcctaagacctgccactctaaatgcacgagatggagatgcttacataccacccagcccgtgaagttcttttccacgcagaaaccccacaagttgggttcccacctggatcaggactccacccccttctcctaaacatggaaacaaccccgggtggagctagaaccagctcaagtcagacctcccagtctaggaagatcattggtctaacttgataacaatgtatagaaaagatgctttaaacagaactaggtaaggcttggcaaaaactggctttcctgcagctaaatgcatgctgacatgtacctattgagttttggagcaactaactcttaggaatgtgtgtgtacttttgtcttaggaaaaagacaaaacctgccatagtccttgaaggtaagtaaaccatgaaaaatagaagtgcaatgtctgataggcttttaaaaagaagaagaattgctgctctcctagttggagccacagtaatgttattacctcgaataatgaggcagtcccctgacttggccttctaccatctattctccccaccatgaacagatggatcacttaaaagtacaatagatcatgccacactcctgcctaaaaactttcaaggacttcctttcacaccctgatggggtccacactcctcacagggcattcataatgcacccctgactctggagatgtggtgaagtgtagtataatagctaagtgctccatggctatggcaccagctggaatcctagctctgtccctcactagctgtgtaactttggccaagtatctctacttctctgtgtctgtgttttcattcgtaaaatgagaatagcagtacctaccttatagatgcatgtaatgagcacccaacagccatcacagctgtttttattattacttttgacctcatcgtctctactttccccacccccacctcattacactccagtcacaccagacttctttctgttcctcaaatttgccaaacttatgtctaaatgtggacttttgccctagagtgagtgaaactgtctgcccacacccactcccactcaggcctgtgagctgctggtttcttctcattttcagattccaaatgaaggcacctccacaaagaggccttctctgaccacctattccaaatcagtcctaagtctctcactagccctgtgctgccctatggcaatttctgtgatgatggaaatgtcctatataccactaaccactagccacattggctattcagcacctgaaatgtggctagtgtgaataactgaatgtttaatttcacttaattttaattcatttagacttaaatgtaaataaccacatgtggctcctgtattagatagtctggctgtagccattacctgactcgtgcactcgtcactccctggacttgtcttgctgattcatttgtctgttgtttgtcatttgtctgcctcccccaaccagacagtaaggtcaacagaagtggcagagggccttatgcaccttgctcaccgctgtatctccctgtgcctaggagaatatctgggtctttgtggggctcaataatattgttggataaataaatgaatgggcatatagaagcactctgtaaaccaaattacataatataaatgtagtatattatcattatatgtgtatataatttgaaagcctgcagggttatctcttttttttttttttctttttaagagacagggttttgctctgtcacaggctggagtgtggtggcaagattatagcttgctgcagcctcaaactcctaggctcaagcaatccgctggccttagcctcccgagtaggtaggactacaggagtgtaccacgacacctgctaattttttaaatagagacagagtcttgctttgtttcccaggctggtcttgaactcctgcttcaagcatccttctgcttcagcctcccaaagtactgggattacaggtgtgagccactgtgcctggctgtgtttcactttttaaaaatccctaatacacacacagctgatcgttaaatgtcaataatttttaaaagttgttttcctgtttggagtgcattttttatgtcttcaagtgagacccctcaccacacaggtagtatatatgataagcagtccctctggaaacctaaggagggcctggcctgatcacagttccaattccaggcaacttctgagcagctgtctttgagttaagtaaagcaggacacacctgtgagctcttctgcctagcacaggccgcggtggccagccttggaccacagagggcaggctctctttgctggtccctgggctgttcatctgctgcccagagatcactgttccaggcttgatcaggatcaggatcaggtctgaagcctctgacatgcgtgggcagctgccattctatcatgaaaacatgagttttcctaaggggattgcagtattctggaaattaaaaacaaggtaggagcaagtcgtctccttcctgtgggagtagctgaagctcagttctgaaatacaatgcctggcactcctgggagggctgggacctggcctgttccatgccactgggcggtgtgcggtttccaaagagggctggggctgttatctgacctcctgtcttaatgaagtgctttggcttcatgtctgcctctgagagagctctgtgactggagcagcagagtcaaatcgaagacaggggacatccccccaacccccatccccacccccacctgggcctgagcccaggaactccatgagcacagactcactgccacttccattgctcaaaaccagctgcagggtctgggaaccaggctcaacttgctgtgccaggccagcctggacctcctctgacctgggcctgagctgataagttgggggaacagtcaggagacagttgggctgaggttgtttttaagactcctctgtggcccatgtgcttggatttcttgtcaaaactctccctcctgacctgcctaacttgcccctccccgccatgcctaggcacacattttcttcccataatatcagacctgattctcagaatgggtacagggcgtattcatgggggcgcagcttcaggaaggggcctgctgcaatggcgtgctgtgcttgggggcatgaagtgtgcaggggtaggtatgctggccctgagactttcccccgtgagaatttcattgccacagcgccagtgggtggatcgatagctttaggaaggtgaggtttcttttgtggagaaagcaccaggaacactgtgtccacccccaaccccaccccaagccacaggctcctggatggcctgggttcttccactacactcactcagcccttctctatgtggtgcccatgcctggagcacagcccagtcccaccctgcccctgagggtggctcacatgttcttaaggcaggtaccaggaggatgactggccactcagggatgcaggaagtggcttttctgcatggcctgcctggtgagtcacctggagaatgctgggcccagttcagtcctcccagtcccacaaggcctgtagataccaaaaatggagacagaatcatccttggagagaggcccaggggcaggcctgggaagcaggcagagtggggacaaagagggccaccacataaaacaggcccctgtgggcctgcccagcccctcatcacacacggtggttggtctgtgcagtgtctcttttgtcccagtggcttcattttgtttccactttttataaatgcttgctaattcggcttcatctttttcaaaataataatatgtcattgtgaagagatgtcccctgccaggcatctttagggcttttctcagggcccaacagaccgatgcacatgagggcatcaatgccctcccccagcctggtgaaccctgacttccattccaatggaagacacgtggggtggccggtctctgcccctctcgaaggcacgttttgggttggaaggaggccttgggccccctaaggcaagctcaataagggaaccagtgacagcggagaactcagccacacagctcccttcaaggcaagtggggacctcacgatgaccgctgtggttattcagtgcctgcgtgtggcaggccctgtgctccatgctcctttgacatcattgggtctaattctcaagggccagtccaagaggcaaatattctcattacgcccattttacagtggggaaacaggagcagagaggtgaaggaatttgcccaaggtcacacagcttcaagcagcagagccactgctcaaaacccaggtttggctgccccgaaggctgtgcttttaacagcacaccatctgcctcccacctggtgaggtccgctgagggtgcccacatgcctgccctgcgctaggtcctgaggggacggcagacgcctgtgggcagagcctaccctccgcagtagctcagagcaatctgcttccctccccaaaaggcctgagtcaaaaccctctccactgatgaaatgtttcttcctgtggaattccgctgaaagacagctcccgactgtgtccatttgttctccacaggagaatcctgtaggggaaagattatcaaaatatttgccggccttgcagggagtattcagagtcgttgccggagtgctactagatgtgtgaggtgctgctgttcctcctggcttctgtttgtatccatctgccaaggaggggagaggggcagaatctctgtttaacctataggtggaagctatagttagcattctatgagcccatcggggatgctcaggtacagtgcagatgtctgccagtggcatgtccaaataaataggcatttaaggatttcctaggccaggcgcagtggctcatgcctgtaatcctagcactttgaaaggctgaggcaggcagatctcttgagctcaggagtttgagactatctctacaaaattataaaaattagccaggtgtaggggtgtgcccctgtggtcccagctactcaggaggctgaggtgggaggatggcttgagctcaggaggaggaggctgcagtgagccaagattacaccactgcactccaacgtgggcaacaaggctagaccctgtctcaaaagaaaaaaaaagaattttctagtttaaagcattaggggggatctaaactttgaactgggtgaagtgcaattggcatactcctggagtcttgggtgtgctgagcccccagggtggaggaaaaagccttgggttttttggtcagaagatctgacaacttgactagctctgcccttgactggccaggcaagtccctcacctccctgggctcattgccttacctgtaaaatggggtggggtagccaggggagatgatctttgagaggcagggcagcatctgggagccaggctgtccaagtcccttcataagagctggcaaatggcgggcaacctctctgggtctgtttcctcatttgtactgtgtgtatgtgtgtgtgtgtgtgtgcacctgtgtgtgtgaaatgggtctatatgtaatgtctctggaacagtgcttggctattacataataagcactcagtaaacttggctattattatttatggcccctctccactcccacatgaactaaactgtgggtcttggcaatcatcctctgagagaaaatgctttgtttgagcagtgggttgaaaggctggctggagggaaagaagattcttccttgctggagtttaaaaacaagacatggggccgggaggaggagagaatcactgaggccggtatatgatcacctcatgagttcttctgcccatccacccccgcccccgcaacaaggtacagctttaatgaggtgatttcacccctacagaaatcctcgaggttggggttggggaggcaaggagtgtaaatgtccccagcgcccagcctccctgatagcatcttggaagcatgaacaggaagaagactgtagggagattggcttcaagtgccgaagcagaactcttcaaactttttctgttcgttttcactattttgggtttctctcccccgaagggaaacactctgcaggtgacacagtgtgagttaagaaaaccccatgtgtcggagccagacagaggggagaattcaaattggatctctacagtttactggccgaccagggttatctcttctctctgaggttcagttccttcatctgtaaaatggagataatgatacttgttttacagggttgttggagaattaaatatgaacatatatgtacagcagaaagcaggggttcagaaaagctaggtcccctgcgctgcatcccctccctgtctatgcctaagagggtgctccacttgcctgtccaccttctgtaccaagccaaaaaagcaggaggcacgattcccttgtgttgtgtgctgttagctttcagaacaaggctataatcttcctagaagctcctgggcaggttagaacctgtgggctgtcgtcagtagtggatgctgttaaggtaaagctataaatacgaatgaaacaaaaggagaaaactcaacagccccctttcacctgacattaggccacagacagattggccacagacttgacttagcagcgaaggttgatgctaaaggctgagcacagtggcagtcacagggcagactaaggacacctctctttatcaagtatcctccaccccactcaggaatgggttgttggagtttaggtggccagggccacagtcatgagtatattgccttctctcctctggccacggaggcctcgtggttggggtaggcttggagtgagtgggatggtcctgaaggggttaaaggaggagtagggcacagtcacaggcctgggaagcatctcaatgggctgaaattctaagcccccacccagtaaggtccttggggatcccaaagcccttgtcatctatcaccagatcctgggttccttttatgttctcctaaactttctcatggctgctaccagtgtcttatctgtcaaggttgtgacaatccaaaatggtacctttttgcagattagaaataggctcccctttccccagcaaatgcagtcctgcgccaggacacacagcttgtgatacaggtgcataggctagatttcagcccccagttgcccccttggctgagctgccttgtcctgcttcccatgctctgcttcagtggtcaggactggccatcctgcttccgctgctgcctcctctgaacttgcttctcctgcctccgccgtagcccttcctgtgagcagagctggctttcagtaggacacagaaggtagcctggatgtgccagcttttctagccctctctttgttttgtttttttgtttttgtttttgttttgagacagagttttgctcttgttgcctaggctggagtgcaatggcacgatctcggctcacgacaacctctgcctcctgggttcaagcgattctcctgccttagcctcccgagtagctgggattacaggcatgcgccaccatgcctggctaattttgtgtttttagtagagatggggtttcgccatgttggtcaggctggtgtcgaactcctgaccccaggtgatccgtcgtctcggcctcccaaagtgctgggattacaggcttgagtcaccacgcccggcctagccctctctttaaaggggcttgtgacccattccagggctgggtcagaggacacttgaaggatgccacagagtccaattgtatagtattctctctggcatcattcagcacatcaggcccaggtgaaggtctccccatctcctatagtagtgagaatcccccacctatccaaggctgatggcagtgcccccaagactgttcaagagagtgcgtccccaagtcctggggcctctggcatcaatctcggcctcttcactttcctcccagcagggcatgtaggctgtcttataaacagcgtcctgggtgcctgctctggcatctcaggatgcctgaggtgggcaggtaagtgggctacgccctccctcccagctggactatcccctcacaactgggttacacaaataggaacagcctaagcccttagggtttagggtagtctgaaaacatggcattttatgattccatctctcccccttttaaactcacatgcacatccctgccagaatatctggaccacctgtttagatgtgaatggtctgaagccaagtttctggtagctttgccaatagccaggagaggccactccctttgaggggcagagctcgaggtgcgctgtacctgggtggtcctgctgcttcactgtgagaggctaagggaggagaggagggctggcttcagacacatttgtgggtgcacggagacgccagctcccagtcactgagtatcaatcagggctggaggaggctgtaacaccttaaaacagtcttcaaactttctctccacagctaatagctggatttaccatataatctggtaagtggaaagtaacacaggaacacgcttgagaagtgccaacccagagccaaaagagaagttgctggggacacgatgcctgggcaagggatgggagttggttagatagagaatgaaagaaactgtaggagcaatggcttggaggcaccaaataaagggtgagttcaggggaagcatcctgaggaatttgaatttccacttatgggtggcaagaagctcttgaagggctttaagtggtagagggatggatcaagcttgcctttcagaaacatcactctggggcctgcatggaagacagaatggagaagggcaggatgggagggagggagaccagctgggaagcaatggagagtccaggcgagagaggaagggaccctgggccagagtggtggtgggggaaggagaggagggcatgactttgaggattccttagggataaagtccccaggccttggtgagagattggctgtgtgttatttgtgtgcgggtagaaatggagagagactgggacccagggtggttcccagggttccagcttgggcaatagctggatggagatgccatcctaatatgtgggaattcaagagaagaggaagctggctgtggagtgtgcaaattttaaaccgtctgtcccataatcaacatttagcaaaccatttggatgtgaaaactaagctaaagaggcagagctgggcacagtggctcatgcctgtaattccaactactcgggaggctgaggctgcttgagcatgggaggtcaaggctacaatgagctttgattttgccactgcactccagcctgggcgacaaagcaagatcctgtctcaagaaaaaaaaaaaaagagagaagcagtagcaggttgcattatactgtggaagtatgtgtgataaccaggcagagtagaccaagtgcaggacctggatatgcccattttcaaggtggttggggaaagaggacacacagaaagacaggctggaaactgtcagagaggtagcaaaagagtcaggagaaaacggtgtctcagaggtcacaagagctgaaagattcacaaaagaggaagcagtcaacaatgtcaaatatagcagaaaagccaagtaacacaagttctgaatcctgtccacaggatcatacactgaagaagtcattatcaacctcagggagcgcaatttcagaggaggggctgaggcaggcctgactgcagagaattacagagccttcagtgaaaggaagacaggagattggataaagatggtagataggggcataaaattgagcaagctgttcagggcaagggaaacttgagcagcttaactggctgagctggaacagccagctgagagggaggcattaaagatagagagaaagagggtgatgatagagtgggatgggaatgggatggatggcagcaagaacatactgggtgggtttctactgaaccacaggagtgagacagtgaagagacaggtggagaggttgacagtgatgtcagttccattgtagggggaaaaggagtgggagttggagcctgatggcctcatgggctctaattctagatgaagttgagcttaccctagatttgtgatggggtgggcctgcagggttgtggggtttctctgaagatttcagagaagatggaatgaattaatctgagcgttcctgagtaagtacaacagaaggatatgggtccagactgacaacaaactggctcatgtgattaaccatgggtgggcagggaaggaagaaggaagcccaggaggggcctgatagaccagaatgatgtcgatgcatgacaggattatgctcaagggccaggtgccagggaacaggaatgtgggagggcgaggggaatgtgggcagaaagaggctattggcctgacgatgtcaggggaggagcagtcccagggaataacaaggcccaggtgggccagagtgtaggctgaggtggagcacaggtgaaggtgatcagagttgggaggtcattttactttgaggctggagcattggaggtgctgtcacaggacaggagtgggtggctttgaggaccccagccatttccagggtgaattaggaacagtgtttggtggattacaacaggaggagtgtggtttggggtctcccaaatgtgtttgatcataaggacacatgggctcttgttaaacattggctgccaggtctcacttggatctctccaattcagacctctgggacaggagccaggggatgtgcatgattctgatgatcaggtgactttaatgatcaggaaagttggagaaggttgatattaagaaggcataggcctccaagtatggagaaggggactatagagaagaatggatgagaggtttggaaaagaaaggggtagggagaagaaagaggaagggaccaggagagccatggagagtggagtggaggagagaattcatgcccagaggactcacattttggatgctgagaaagaatgatgtgatgtgaagcactctggagtcatgactgggctcagtcacagtagccgggatcccacggtggctgggagggcgtcagtccctggaaagtctcctctttttgtcccttgatgattcatgcagggcatttcaggatcccggagctggcaccagattgacatggaagtggagttgccagccaacagtgtgatgtgatttccacgtgccaggggagctccccaccctgtgctctgtgagcatcccttaccggaagttccaccaggagctgggcaaggctgaagctaccaggtgtggagggaatgacgtgggctttagaatcctggtcagatctgtattctcatcctctgatactttttagacatgcaaccttgggcaacttagcctctctttgcacctcaatctcctcatctataaaatagggataataatacctgcctcaaagagctgtcgtgaggattaagtgggcaaagcacacagagtgccaagagtaggtgctcaggggctcaagcaagaggcagagccttggtggtggagaccactatcagctccactccacactgagagcccagagcagatgggagatggacagtgggataggagcacaagaggtgagcgtccctggagctactttcgagtttctgccccctactagtcaccaaaatcacagcagtccgtgtttacagaggcatcttacctgtcctctatttttactgtgttaccaaggtggtaacagtataatattatttttgtataaagtgttttaaaggaccacctgatctgttgtccccagcaccttgcactttgggggacgctatgtgttcatcatcaatatattctgaaataagaaacagaaaccagaaatttaatcatccagtacccagtccacaagaaaggccaatgactcacttcagaatatgcgaggattgttcactcatttccttccatgtggcgtgtttgtcactgcctggtcatgctgtgaggaagagctgctctcaccttcatgttcatgaacctgagacagacgaggtcacatggagatcactcaaggggttctttcttcctggaaatgctgacaactgagaagtttgcctctcacagctgtatgaaaggttttgtgaggaagaggttagggcagcaccaggggttagccccccaaagtgctattccctaagcctagtacaggaaaaagaaatttcccctgtactgggtagaaggatgactgctggcttgctcccttgcaggagggttgttgagttggagcagtgcctctcacacaggtcactgggaggcttgttaaaatgtgggttctgagtcagtgccttagggtggggctgagattcggcatttatggcaaaccccgggcactggagaggcagctgctccacagccccaggacggcgctaggacacacctgtgaaccttcaatgtgggttcctgccatggggaaaattcaagtgtatgtagaggcttgactgtggttcctgacctgcttgagacccccacacactctgaccctatgtctgaaactctgttcaaaagtccaaatctcaaatatctatggaatgcctagcaagtgccaggcactgggctaagtttacctaacccagcttgcttgcttctcttaagattcactgtgccattccacaccacgctcaagcaatcaaccccaaactctcccactcactctgaggaacaagggttcacactgggagatgaagtgggcagtggagtcagggaggccagtttagggagctccacatcccagctctgtgaacttggctggttactctgcctttttgtgctttcattttctcgtctataaaaagggcttaataacccccacctctctaggttgctgaaaggattaactcagatgatgcacacaaagttcttagccctgggctggtaagcatagcttttatgattcatatttagtttgtgtttcccccatcagaacctttggtgctctctccctctttgcagacacctaggccaattcttgtgtgtctccttatgcttgactgtgttactatctggaaattattcttaccatttggaaacctcagtactgtcgacagcaccattaaaagcagttccaaatggttaccacacaagaggaggcaaaagcagtgccccacagcagctgtgtgtgcactggggaggggggttcctgtgaggaaggaaccagagaggaaagggccaaactgacagcctcttgcagccctccagcttgctgtgccagctgctcttgcactggatgccgagctgtgcggcgagcacttcattcctaatgatgcagtgtcagttataaatcacttatttaaaaatcaaactggccaaccctagattgtctttatcatagcaccactttcactcacttgcattccaaaggaattttagaaacattatttaacttttcatcatggcatttttcaaccatatgcaaaagtagagagaatagtgtaaccaagtccagctttaagagttgtccacattttagcagcaaaaggtctcttgagtgaaagagaatggtgtgggatcgtacacccctgccactcacgtgggagtgaattgtacatattcatgtcttattagaaaaaaggctgagaactcttggtctttcctgtccatttccatttgcattttttttttcctggaaaatgggataatgacccttactttgcagggattgactgagcctgaaaaatgggctgctggtcagagcctcacagatgcacattccttcctgggctctgcctgccccttctgctcctgggtggaaaatgaggaaggaacaggcacaagcaggaggctgctgagctgggagcaaggaccaaggctctaatctggcccctcccaccacccactggcaaccacctgcctgccaaggccgcctgtctcttgcagggtggattgtgtcctgctttgtagaatgataactcctgtaaaaataagcaccttaaacagccgagagaaagggacagtaatctgaccccaggctgtgtgtaccccacagggaaggggtgtgtctgtcatacttgcccctgcttcgatttagctctgaagtgcaggggagaccatttttcccactcagcaacagcagcctgtgaagtaatgggaggctgttccccagtgggaccattaccactatcatttctataatgctttccttctgagaggctgaagtcaccacttcccaaccctgatagccccacactggctcaggcagtgggtgttgtggaaagaggatgggatgtggaattagaatgtctcaccttcagtcctggctctgctatgtaatttgctcagtggccttgggcaatccctgaggctccatattctcctcctgagtatagtgatattttaccccagaatgactctaaaactcatacacatattattcatcttaatggtttaattggactcggtttaggcaaaactgtgaaacagaagtgttaatttagcattttctactttttcagtcagattccccctttttcccaagttccccctttccactcacccttgaagcacccaataatgtcaggcagccagtcaagaaaatggcctagaaaacgaatatacattaaaggcctagtagtttaatctcgatagtcaaaatagtctacatttatcaagtgctcactaagtgcctggcactaaacatattttttgtaattttcacaacagcatcatgaggtatgtaactattatcctcatcttacatatggggaaactgatctagaattcagacagttgctaggaattgcacagctaacttgcaaaatctgggattcaaatgcagatgtgtctgattctaaaagcagtgctatttgtttatttagtctttttgaggcactgaaccctagtgattaagagcacaaagtctgaactagatggcctgggttcagagctcagctcctttacatattgctatatgacctgggcaaggaccatgtcctcatctgtaaaaggggaaaagaacagtgccaccttataagattattgtcaaaatcaaatgagttaatgtatgtagggttcttagaacagtaccaggcacatagtaagcactgtgtaaattataaaacaaaataaaagtaattagtgataatcagaaaaaagtcagtttagaataacatgaaagaaaaggagcatccctttgtgctcaccagtcagcttcacttctcggtttgatgggaggaaattcttcaagacatttgtacataatcccacacaaatgcacacaattacagaagtctgttattttcacatgaaaagggcaacttgtatttttcacctaacgtttcacagctgcctatcggtacctatggaattacctcattcttatcagctgcagagtgcatgccaggtatagatgtgctataattaaataattcctctacagattatctgtaaatgatgctgccatgagcattttaggatgtttatcttagtatgtacaggaaagtgaacccctggaaggctgactttgctctcagagactgagttggtacatccaagcaagtcaggtttttctgtcagtctggctccttctgtataggggagttggtgaagcataaatgctttctgttccctgcatttccctcaaccatctgcattcctcctgcgctagaacaaggcagcacagctcatcatcaccacccacccccaaccccagggtagcctgaagcatctaaactgagccctttccggtcataactcaagaaggcagtcaggtggccatcgccactaggttttacatacatttgtttcctctctcttcatttccataatcaagctccctgcccccctacaactcctccctcttctttatttttatgggcatcaccagcatcaacagtctgtccccagcactttttttttttttttgagatgtagttttgctcttgtttgctaggctagagtgcaatggtgcgatctcggctcactgctacctccgtctcccaggttcaggtgattctcctgccttagcctcctgagtagctgggactacagacgcgtgccaccacacccggctaatttttatattttttttagtatatgtgctgccaaagtgagcactaatttttgtatttttagtagaggcagatttcaccatgttggccaggctggtctcgaacctctgacctcaggtgatccactggcctcaacctcccaaagtgctgggattacaggcatgagccaccacgcccagcccccagcacttttaatctctcccttctctgcgttcccacagcactgggagctctgctgcagctcatccttctctcactccagatccatgccatgttccctgctaggatgaaagtcctggtaatgtgatcactttcatacctcccagggctagtgatgctttccatatggtagatgctcaatgaatttttaaaactttgtttatatttttaaaatatgtttttgaatttgtttttaagtaacattttacatgataaaaataatatatgctggccaggcatggtggctcacacttgtaatcccagcactttgggaggccaaggtgggcagatcacctgaggtcaggagtttgagagcagcctggccaacgtggtgaaaccctgtctctactaaaaatacaaaaaacaaacaaacaaacaaacaaacaaaaacaaacaaaaaaaccttagccaggtgtggtggcacacgcctgtaatcccagctactagggaggctgaggcaggagagttgcttgaacccagaagatggaggctgcagtgagctgtcatggctccaccgcactccagcctggccaacagagtgagactttgtctcaaaaataaataaataagtaatgtaaaaaaaaacatacatatatatatacacagacacacacacgcttactgtaaggaaaaactggaaaggaaagctgtgtaaatgaggaaattaaatcatctggaattcctatccagagacgttttggtgtatttctttgaattgttgaattaagaagataattagtgaaaaaaaaaagctagtaattagactgaggatgtaaatgggaaacaggctccagagtccggtgataagagtaagtcttgaaatgggtggttcaaatatagacaatcaggttgaggtgtactttgcatagaaaatgagcctatgttgtcaagaagttcatcttttcttcactctgtcactatttattcaatagtatttactgaggtttagtaagccatagtcctcagacaatgatttctctggccaacgtgatagtaagtatgcagctatcacacaggccttttggaagctgagttgacttccctgcctagtagactggacaccaagttcatggctagctcttcaggggcaggcacctagagggtaagacttctgaaaatattgcagaattttgcctttctggtccatatcagtgttgccagctctttgtatcagtagttatgatatattaacttcagggaattctctatctttctttctgcagttgttcaagttcagcttttctgattgatcttccttggtgatagcttaagcacttgttattccttacctgttactgttagggcttggcaaagcaagaactttagggattgttctttgttaaagtgcatttcatctaatgcctaccccagctgcctgttaattagtgctgttacgggatgggactcaaccaattactttgtggcaggaagggatcaactccaggttgagtgctccctgacaaaggcttttgtgctgctcagaagtcattgttatgttgtctgttcatgtgtctcttgggcaaaggaacccagggttgcaatatttaaaaatttaagtgtggctgggtgtgatggctcacgcctgtaatctcagcactttgggaggctggggtgggtggatcatttgaggtcaggagttcaagaccagcctggccaacatggcgaaatcccgtctctacaaaaatacaaaaattagcctggcattgtggcgcacacctgtagtcccagctacttgggaggctaaggcgggagaatcgtttgaacccaagagacggagtttgcagttagctgagatcatgctactgcactccagcctgggtgacagagcgagactccatctcaaaaagaaatatataaataaaaataaaaataaaataaatgtttagatgaagcctggttgtggacttgaagaagtttgaattctaaaattgtttatagcatgaccaacatccaggggattatatttatttagcctatggggagatttatgatgtaatataaaggtgaaaagccaaaggagttcattcattcaataagtactgagtgccaggccccaaactaagaacaaaacaaaggcaaaaccagatatagatcttagagtctatagagcaacaggtattcaacagcaataacggaaatgaataattactggctgtgacaaattccaggaaggagagggtgctgtaaggcacatttaactggggaacctgacctatgctgggtgtcagggaaggtttcctagggaatagaacatctggttatttagtttgtggtacctgagtcttctcaccagtaaaatagggatactaccctctttgactcacaaagacactatagcaagagtggtcatggacaagaatgagctttgaaaaatgctcagcgtttctaaaactgagtttgtccctccagccaaagggagctgttctccagctttgacatctgttgccaagccaggcagttactcaggcactctgactgaagacctttgataattctcctccactctgccaagcagcaggggtcagacagacctggggttagctttggttctgccatttaaatctcatttgaacttgagtaagtttcttaattggtaaagtcacttttctcatttgtgaaatggggcaagtatcgattaatggcttaaagcttgtaaagcacttagcatagtagttggcatgtagttacttctaaaccaagtacagctaatgttatcgtaattgttatcattgctaattattaactttttttttgtaatggggctcactgtattgcccaggctggagtgcagtggctatgcacaggcacaatcatagcatactatagcctcaagttcctggctgaagtgatcctctacctcagcctcccgagtagctggtactacaggcatgcaccacagtgcctggagctaattaataactcttgtcaattatttctttgtaataactttggccttttacctctattcccaccagcctagagaaagcccttgtcatttggcaagaagtgattccatagccttctgatcagtgcccccaacttgtctctcacttctctaattcattctacttgcttcctaaaataacagtattttgcatatgtcaccccttttaatattatcattgaaaaatatgtgaagctcatagcacaaagagctaaacttcctaatgtggaaagaggtcctagataattggtaagaaaaagacctacaaatgggtagaaaaacaggaatacaaattccaaaaaagaaaaaaaagtctactaaacatgaaaatataagcatcctcacttattataaaagaaatgtaaattaaaattacactgaaattcatattttacttatcaagttgacaaaaattgaaggggttattaataacaccttctggccaagctgtggggaaataggcattttcttacattgctggggagtagaaattggtacaatccttatagaaggcaatttggcattatttatcaaaattacaaatgcatatacccttggactcagcaattttacctctggaaatttattttacagaatacttgcacattttatttattgccatatggtttgtaataagaaaggattggaaacaagctaaatgtttggtaaattatggttcatctcttcaaagaaatgctatgcaaaaaagaatgaagagagtccctctgtactaatatatgaaaatctccaagatatattaagtggtttttaaaaagcaaagtgtagaacaatgggtatagtatgttactttttgtgtagggagggggtaataacactcgcacacacacatacacacacacacacacacatagaaactctggtaggcacatacaatattaatagcagtactaatagcagtacttatttctagtgggagggggtctgggcagatgggagacagaggtaagaggggaacttttcacaggataccttattatatagttttaacttgtgaaccatactgcaatggttctgtgaatactacctagtcaaaaaattatatttaaattactcccactattaaaccattaacatatattgagcatctaccatgtgccaggcccaggggatacaaatgtgaatgtggttgtggtttgatggaaagatccactgaacttaaaatacctgattcaggtcgggcacagtggctcacgcctataatcccagcactttgggaggctgaggcaggcagatcacttgatgtcaggagttcaagaccagctgggccaacatggagaacccctgtttctactcaaaatacaaaaattagctgggcatgctggcacgtgcatgtaatcccagctacttgggaggctgaggcaggaggattgcttgaacccaggaggcggaggttgcagtgagctgagatcacaccattgcactccagcctgggcaaagaagcgagactgtctcaaaaacaaaaaacaaaaaacaaaaaacacctgattcaaattcagattctgcttctcactagctatgcatcttggcacacagtaggcatacgacaagtatttattgaatgaatttatggttgaagttacttaaccttcctgagtctgtttcctcccatgtaagatgaggatagagatgcctcctatctctcagggatattgtgaagacaaatgatagaatgtgtcatcaattctagtgataattaatgaaacctgctatgtgctaggcagtttcacatccattatttccttgacttctcatggaaacctgtgaggtgggcatatattcacttactcatgaggaaatggagggactgaggggaagaatggcttgcccaaggttttcttctggtctttctttattgctacctcccccatgctctgcactagaaactttgtaggttatgcagtagatactgtatagtaggtactcagggaactttgaaaatcaagaaaaactaatgtttttccactgttctcagtgacacctcagagcaacagaaaatcagtaaatgaatttcggatacttcgatttagaaatatactagctggtctgtttgacattcactgcactaaacacttgggggaaaatacaacaaaaatcaaatattcatgcttctaatgaagtaggaaggataaagactaacccacaaaaacactcataagcgaaaggtactcattctaaaggatgctgcacttagaatcttgtagacttaccaacaactgtttctaagagggattaaaatggtacacccaatacagtacaattaaaaaaaatttctttggagtaaaacatacaagcagagtcatgcacaaatcaattgatttttataaactgaaggacaggtgatttttataaaatgacatggattaataaatagaatattatcagcatgcagaagtcacctctgggatccctttctgtcataatccacagctcaatataaccactgtcttcacttttaacatcacagatatgctttgactatttttgaagtttatgtaaatggaatcatatagtatgtacccatttgcggccagcttctttcactcaatatcctatttgtaagattcactcatcttgttgagtgtaaatgagttcatgcattcttattactatgttgtatgttacacagtttatctctcttctgctgatggacatttgggttgttttctttttggccgtcataaagagatacattataaacatttttcaacatcttttggtgaatatgtgtatacatctctgttgggtgcacacttaggggtggaattgctgggtcataggatacatgttaatttagcttttctagataatgccaagcaggtttttaaagtggttgtaaaaagttcattttgacgagcagtatggtcaggccctttaattttagtcattctgggtggtatgaagttagatcacattgaaatatcaatttgcatttttgggatggttaataaattgagatattttccatatgtttattggcttttttgagaaatgcctgtttgtcctctcttgaggacagttgaaatattctgcctgtttttaattggattttctgccttattctggctgatccgtaggtgttctttatatatctgtaaacaaaccttttttggatgtatgtgttgcaattatgttttctcactctgcggtttgccttttcactcgtggtgtcttttcatgaacagaagctcttaattttaatcttgtccaatgatgagttttttttctttatattagtactacatgtgtttaagacatcgtctttgtctaccccaaggtaatgaagatttttttggacattttctttggatcgtgttattggtttactttttacctttaaaatccatctggaggccgggcgcggtggctcacacctgtaatcccagcactttgggaggccgaggtgggtggatcacctgaggtcaggagttcgagaccagcctgaccaaaatggtgaacccgtctctactaaaaatacaaaaattagccgggcatagtggcgtgcgcctgtaatcccagctacttgggaagctgaggcaagataattgcttgaacccgggaggcggaggttgcagtgagccaagatcatgccgttgcacaacagcttgggcaacaagaccgaaactctgtctcgaaaagaaaaattccatctggaattgactggggatggggggattcagttgatccagcatcatttactggaaagagagagctaatctgacccccaatacagcacagcagcacctgacataaatcaagtgaccacatattgtaaatctgtttttggactttattccattggtcagtttgtctatccttctactatttctatgactttataatggatcttgatataagatagtgttaagtcttttccagtgggctccaatttttcaccccaccaaatcatctagtgctgaagtgccaccgccaactcgcactttgctttcaatacgtccatacgagtgcaattgatttgcctgttcccgtggatggttcatttgtggttacctggggctttgtctcatcaaagcccttcacattgaaagccagccaggtgtctgcagacgagcaaagcagatctgttgggtaattaaataacgcggggaaggggaaggagtggattcgacgaggctgtctctggagagagcttcagaaaggaagtgatcgagctatacttgaggactggctccttggggagatacgaagagagccaaactctaaaatccgggcagaggagggcctggctaggtcaccgaatgtaaatgtctcggggggttccgcaaggcagcgcgaatcggctcgccggggtggggccgcggagccgcaaatcaccagttgagggccggagtgcgcgccgccggctcagagctgcgcctgctgctggccgggcgggggacggggccgggaccggagccggagctgcggggcgcaccggctagacgcgcgcgggattctcggcgggcacgccccgcggaccatgagcgtccccagctccgggagcagccgcggcgcgggcggtgcgaggccggccgcgcggcgcctttgagccccagccggaggtccagagatcctgagagcccgagcgcccagcgccgcgccgggaggtgagtctccgccgcgcgcccagcgtcctcggggtgctgttcctcccggggcgcctgggcctcccccaccccggtgaggacacgctaggaagtttgttggacaaagttaggctctggggaaagtagagccggcgtttgttggtccctacccacccccgccagcggatttggcgttgggggcgggggtgactgaagtggggctggggcttgcgctctccaggccctccgagcgcgctgggactccccgagacgtggcccacggcggggagcgctcagcgattggcggccaggcatcttgctcggtggcactcgagcggcatcttcccgggcgctggcctcgcccgaccccctgcccgtcggagctgctctgccggccaccccgccctgtcccgcccgtcccctcttcgcagaagccggccggggtcgggcagatgcgagggcccagagcgctctggtggaagcccaaggctccgaggaggcgagtttctccggtaatctcttgggaagtttgcaaagaaagcgaaggagcctgccctgtaactgttgacaacatctccctccctctctccctttgttgagaaagaatgaatagttggttgtgttgctccctctgcgtcgcggtggggagaggcgagggaaggcaaaggaagggagggacggtgggaaggaggttccgatagatcgtacagcccaactgtccttacccacttaggccgctgagggcgccgccgctttaaaacggtgtaatcaggtgtagacactcgtcgaggaggaggttgagcggactccgaagcatctggcaaggcggcgtgttccgtggggcggcgggtcgggtcatggttggggttaactcgcttgaagcaaggtgcaaaggagaaaaaccattttcctaacctcatatctgttttcgcttaaagctgttagctgagatggaaagtagagccgtgcattcagattgttttaaaccttgactttatctcccaaggctacacagacctccccaaggaaagtacgctggccgagggaaggtcattttgggagctgatagcctcccttgtgttgcctgggactgagttgagatcctggaggctgggagaggcctcagtgctgggggtggggcccagctcaacacaggtccaagtgggaaggggctacccgggtaacaatgggaagcccacaggcaaagcgcttgtctgcgggcgtgccagggggtattgaggataacgtaaagaccttgccaagccaggggatcccacaccactccaactccaactttctctaaagtgctgctgagaaggctggcatttccaggatgactaaccaaggtctaaatctcctgttcatataggcagaactgcttgtcaaatggatgctaatcttaagaaccttatcgggtaaatcctgtactgtgttgcttgaaatacaatccatggaggaattattcatacttgaatcatttggctagacttcataagtttacttcaaaaataaagagatactcttaattcctaaacccaagcaaaacttcattttaagtggataagccaattgaatatgtgtggttgtttcatctcctctctccatctgactctccagagaagttataaaactacagatccaagttgtaaattctctgtcatggggcagccgagacggttacatttccagagtttaaaatataatgaaaagttcttaaagctcacatcagataaccattatgagttaaacttgaaaatatcccgtttcagaaataaaagagtaaaatccaaacaagtgggctgcttatctctgcctcagcttgcaagatcatcagtttctttgagacatcattgtaaagcaagtgagttgggcctcagttcacaaacatttcaaagcccagcgactgaccaggcccaggaaggcagcacatgtggtaaagtttgtcagcctcgctcttgttcctgatgttcacatgagtctcagattttcatatcaagatgcagagtctttgacttttgtataatatttcaaaatctggcattagactgagtcaggacattgtgtttgttttcctgcacagtagagagaagtcagatggccagagtctcacctgggcttttttctaaagactgcatgtaggctcacttggtttgcctgtacgtgtgtctgtgtctgtgtccgtgtccatgtcctacttggcttggtgtctttgcatctattgttctaggttaaaacgtttccctccccatccttcccagttgcagtcttcatttgtgaactctcagagttacttcctttgtgaaccctcagtataacagagatacagtgactcttatctgacaagatagataagagcagcccctgtcctgcttagaggggacctgctatttactaagtgtttgcagtatttcaagaactttgtatacacaatcacttttaatctttacaacaatcttatgaaatagctgttaagtcattttttaaaatgagaaaccgtcaggttgagtaacttgtcccaggccatacagctggtaagtcagtggcagagtagagatttgaacctgtagatatctgcctccaaagcctaggttctgagtcataccattttatttttaaaaaatcaaatggtacataagaagtatataatgactagggacattgagacagaaatatttccaagtggagaaaacatgggagccagaggctggagacttgggtttagtctccatcagctgtcattccaaccgcttgttcctatggcaagacctttgcatttgccagatcccttgcctggaacccccttcagacctttttttgactggctccttcccttgccttttttcaggtctcatgtcattgttaccttttcagagaggccttcccagtccaccctaatgtaaagtagctctccacccgcaacagtcatcctttgtcagttcatcctgtttatattccttagcgtgcttacaacttggatgttaactcattttcttgtttgtataggttggattcctccatgagagcaggagcttgtctaatttattatatccttagccttggtacaccataagccctcagagaatatatatcaaatgaacatttatttcccttatctagaaaaatggactgggaattaccagtacttatggtcataatttattgtctgcttcctccagagtattattagcttcatgaggacagaccacttctgtcttgtttaatgctgtccccaacacctagcatagtgccagccataaaggagaccctccatgaatgtatgcattgaagaatcaatgtttctattgattgaatgatactccttcatcatcattgaattctgttttgcaggtaaacaattatgactcaattgctgtgtaccaaaaagactcactaatccagtggttctcaatcctggcttcacattggtcaatactggagactgatgctaatgtcccgcccacagagattctcattttattgttctgggctgaggcttgggcatcaggattttaaaagcttcccagaggattcttatgtgtagccaggttgagaaccaatggtttacgtttttatagtagaactcattccttgctttggtccttataggcttgaagaagccatggtaagagagagcaggggtataattcatgggtattgtatgattcctgacagtttaagaggtacttcacagctgttatcacatctgataataacaagttaagggatctactctctggtttaaatattgcctttatgttgatgattcctaaaaatctccatctgccctcacttctaattgtgcataccagtatctaacctcctcttagaccaaattgtttgctgatacctcacatgcagcagctccagtgctgtgcttggttcctgcaggggtgggtccccttctgaaactagttggcatgttacagcatcgcaccaccttctgtggctgtaggctccttccttccagccagatgcctcaagctctgatgtctcatcactctctcctttctctccctttacccagctgctgccccaggtcagaattcttcattgttcctccatgggtttcaccatcagcctcagtaacctccctgcctcctttttctctcccctccagaacaaccagagtcacctacttgggtacagactgggttcggtccttcccttccagatcttccctagcacttccagtcaagtccagacaccttggcagggccttcaagactccatggtctgatgctaacctaagttgcttctgggaaatgcttctcggcttcactcgagccacagcacacaactgggaatgtcctgagcctgtggggtcacttccatgcctttatgcatctgccatcctcccgggaggcttttccccacatgttaacttttcaaaatgctttgtctctattgttgccctctctgagccttctcaagtccttttgtcaaaattaattgttcctttcagcataagggcctctatgaattattctctcttagagttcatagtcaggtattgggccttaggcatctttgtttctccaggtgtcttgtatgaaataggcacttaaatgtttgttgaattgaaggtaagaaggggaagtattaacatcccttgttattggagaataaattgaggtgttggtaacttgaaggacattttagaacactttaggacaatcttgaagtctaagtagatcttggggaagcagagaggaaacaggctgccaaaggcagtggtgctagggtgacttttgcccatcatgctattggaaatagatttgatcaacagtgtggccctatgcacatgaagaagttctgtagggtgctgcaggcctccccacgaggttctttgaaatgacccagtcctgtctgtgagaagtcacaactgtggtgtgtatgtgtgtgtgtagggtggaagaatcctagtcggtttacgtcacttgtgttcaggcggtggggctagggagtttggtttcctttctaataaggatggttagcattgagcaagtgctgacagtgtgccaggtactggccagagctgggaggggctgcacaggactctgtcctattgttctgcacccactgtgagcagaccttctgtgtggtcccagttggacgtggagcaggcagcccccagaattactggatttgacaatgaaccgaggacagagttaagattgtacaccttcagtaaagatgctccttccatctcacccccaggacttctgtactttcccctatctcatgtggaagcagtggaacgtgtgtgttttgttgtacacacacatacaaacacatgcgttttctttacacactctaatgtcattgtctcggctccacttctatcagcttgtggagggttgcattcttcttggttgtcttcaaaccacgtcccaagtccgcagttcctttgtagaactgactctgcagtagtgctattaagtgaggattttcatgcaaagctcttccctgagtaatgcagtggaaagggtggtttgtgaggaaagagggctgctgggttggagaacagactaaggggcagctctcctcaccagcccgtgggaagggctgtatgttgggcttggccaccctgcagtgctgtccagaccagagtctgatatcatgactagtataagacagatcctggagcctctatctccaggggccagcctttttttttttttttttttttttttgtctcctatttcttttcctctgtgtgttggccttaaaaatgtattatataatttgtcttaggccaaaaccatagtttgctttggagctggaggcactgactctgctcagggtaaatgcttctactcatggtcctagataggagagagtgtcggggctacttgctgcacacagcctgacgtgccattctcctttccctttccatgcttcctttgccccccaccattttttttcttttcttcttcccttctcctgtctcttcttccccgactgtacaggcacccatgggcattacctaaccctgctggtggcaggcagatcctgacccctctgtgggggccatgtacatgcagcccccaccccagtggctttcctctgcagctgagcctgctggtgtatggcagaatggcccacctcctgaccctgaccctagcccgtgttcactaattagagtgcattgatttatttataaacactgggtctttgccagaaaaattctgtcccatcctgtgtagcacaactgaggactggtctggcactgaagacaattctagcagctaaagaatttcaataatccctgcctgttcttatcatttacagggcagtgaaaataatgtgagctaattatctaacagtttataatattttctttcgtacatttattactgcaactatgagtcctctcttaatcatctttttttgctggttgtgcatggcttatatgcctctaacaactctgaaagtgtttgccctcttggttttgctgccaacccaggacaattcctatgtaggatcatttcaggaggaagataagtaaacttcccattcttattagactccactagtgatgccattaaatgttgatctgttaatggtctgtgaatatttcattttatgtggcatatttccatttccttttgtaagtaggaagtcagttcttgtgactctcatagatttataccttcactcttttctttcccccttagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcaggtaacttctgtaatttcactagtgaagatgatttgtcttaaacagctttttaaaaggtttttatggccgggcgtggtggctcacacctgtaatcccagcactttgggaggctgagatgggtggatcatgaggttaggagtttgagaccagaccaacatggtgaaaccctgtctatactaaaaatacaaaaattagctgggcatggtggcatgtgcctgtaatcccagctactcaggaggctaaggcaggagaatcacttgaatccgggaggcagaggttgcagtaagccaagatcgctccactgcactccagcctgggcaacagagtgagactccgaagtttttattaggaaaaacatcaaacatacacaaagttgagcgaataattaactcccatgcacctgtcagccggctccaacagttaccagctcaaggccagtcccgttttgtctgtactcccacctacttccctcctttggtattattttgaagcaaatctcagatttcatattatttcatctggaaatattttggtatgttcctttcaaagataaggactcttattttaaaaactgtataaccacaatgtaaaaaaaactataacacctaaataaaaaccacttcttaacattatgtaacatttgaggatattttaaaatccagcttcctctcttaagtcccttaaaagaaagcccaagtattttctttttatcatagcatcagattctgaactatgtccatccacttctatagagatgccaggatgtctataaattagaccccatatctccttatatttagttgtcagcatgctgaaataaaattttatgtggatgcaccagcaggtcagcttcagaatactttaggacaagaattgatttttccctctctgtgacagagatctgggtaaatgagccttatggttgtaaatgctttttctctgggtttgtaatgggcctggctgtgattggtttctgcctgttagagctagtttggaaactgcactccttttcctgttggggaagatcagcagcctgtgatgctatctggtaaagaatgggactgtttcttttgttatctctctttttgtccaagcttgtcgcaaagccacttggatcctagctcatttatttgttcaatatttatatatggagcacctatattagagtatgttgatttcataagccccagggcttaccaggaaaattctgctcagtcctgattatcttaaatgaagggctggtccagcattgaaaacattctagcagccaaattattgagcaatctgttcttgcccttttatagggtggtggaaatatgtggactaacagggtagcagtggagcatctgaagcaatatcttcccagagtttacattctagtgagcgcattaggtagtatatacaaataaataagacaactgcagattataccaaatgctatagaggaaatggagtgatatgctggagatttattggaggtggtacgtttttggtaggatgaacaggtttctgagatgatatttaagctcatatttgtataatgagggaaagcaaccatgggccttccaggctgttgcaggcatggggaagtcaagtgcagagaactggagatgggagcaagtttggcatgtttgaaaaccccaaaaggaactggaatggcctgtggctggagtgtagcacattgagaggagaacagtgttggtgttggtgcaaagctaggcgaacaagagttcagaattattctcagttccataattgcagtagtacaagaagaaaataagtggaggcccagataatctccatagaaaccactagagagccctgaactgcttctgtcaccagattaggacattccttggggtatcctgggggttagaaggccctggaccggctccacaaaatctaggtgggtgacctcccagctcagaaagttggcaggcagccactgctggaatgggtgaacatggaggtgcatacctgtgcacaggattgttaacatcgcataattggcacttaaggggcaagaatgcaggaggtgagcagcaaagacaggtaacttctggcctgctaaagatgagcacagatgccaggctgtgtgatacggagtcagaaccaactgttagctggcttatggtggaccgcttttcatttattaacttaaactgtcctgagctagatgtctaccatgtactagacacagacagtttatagacttactccttgaagttctgaggccctggctaggtgccagctcttacaaagggaaactccacactaggggggtgggtggggaggcagtagtgatggagtcacccttcctatcttggggaagttcttggtaaacacccaaggtccaagctgtcaagctgccaagagtgtaaagctttttgatttgaaaactgacttggacagaggtcatatttctgtaaaagatcttatcggagggtgggtgcaggtcctgagtttgaagtccaggctgtggaagacttaacaagcactcctggtttagggtttgtttatgattgagagctatattaatccaaattcacatctttttttcttaactgaaaatatcttattgttaaagatgaatacaggaagtaacaaatgcatatccctcaaaaattgtgctgagtgagaaggcacatggttctctgttaaagggtcgtaaagtcctaccctgctctgtactactattaatatatttatttctctaacacattaaaaaaaaaatctcctgaggtgttcccaattttgaggagtacaaaataccttatattctttttttgttaagtattcttaataagattataagctgcctgaattcctttttgaaaccagcaatgatataaacaaagtttttgcatatgcagagctaggaccaagcagcctgaatgagaacccaaggctctagagaaggaggttttgccaaaggtgccacagcaaaaatacagtgagagaaatggaacttctcattcaactcttccagttgaaaggagctgcgaaacaccaaccattcactccagctcagtcacctctttttttcttttcgtagtgaattcaggggttaatttcagttgacagtgacttgcccagatgtcagctctgaaaacattgcatctcatcatgttgggtattggcctgacgggtattggcatgaagatagtgggccgccttggatgtctcctgcctcctctatcttgctcagagggaggccctccagataagcacctctttgtcttgtgaagtactctgttgcaagtttgctcttttccaaaaaaatatgtttagcttgttaatcattaaaaagtcacctttataggccgggcttggtggctcacgcctgtaatcccagcactttgggcagccgaggtggacagatcacgaggtcaggagttcgagaccatcctggccaacatgacgaaaccccatctctactaaaaatacaaaaaaattagctgggcatattggcgtgtgcttgtaatcccagctacttaggagactgaggcaagagaatcgcttgaacctgggaggtggaggttgcagtgagctgagatcacgccactgcactctgccttgggtgacagagtgagactccatttcaaaaaataataataataacctttattataattgaacattcattgaaaatacatcctctcggaggcccaagacaaagcagaggaagtctcctctttgaccttaaaacttgcatgattaagctttcatatctacatgtgtcatttcctccattattaattcctccattattaattatcccaataattataacatgaataattatcctaatattattaattgttatctcctacattttatagttttcagatagcttaaaggatatgttcataaactaccttgtttgaacattgtaaccctgtgtgagagacatagcagatttcattatgaacattgttatcaccatcatcagtgtcatcatttagagttgaggaaatgggttcagggatgttgaggcacctaagatcataccttaatggataactgagctaggattagaacctagaaagtattatagggccttccccagacagtgtgttccatagcctccgaagaatgttggcaccagctgtgggcatcctctgagctatcttcttgcacaggggtcagtaccctgcttgtattcagtgctttggacacctactttggggagaatggagccttgcctgctgagagccaggcagaaggcaggcctggaagggggagttggtcttctcttttggtgactgtatctcttggctttgttgttgtcttggctgcccttggatgtacttgtggttttgaaagagggccaaagccagaagccagggagctcttaaacctgctgcttgatgtcacagaaggagcctttgttctgcaagcagacccaggtttctctgagaggtctgcagacaggatttcctcttgacattcacattgttcagctgatatccccttgattcatttatcttcaaggatgaatttttattattatttatttttatatttttccataagttattggaatacaggtggtatttggttacatgagtgagttcttcagtggtgatttgtgagattttggtgcacccatcacccaagcagtatacactgcaccctatttgtagtcttttatccctcgctcccctcccactcttccctccaagtccccaaagtccattgtatcattcttatgcctttgcatctcatagcttagctcctacatatcagtgagaacatatgatgtttggttttccattcctgagtcacttcacttagaataatagtctccaatctcatccaggtcactgcaaatgctgttaattcattctcaaggatgaatttgtattcaaatctggaatcttccttgggctgagaggggactggttcctgttgtcgggatgtctgtgttgctaggatagctgagggatcagtgcttggataccattcaggtctttttcctgcctgtgggtacgtggaggcacacattcctgggaacagctgtgagtgcctaattccttcggcctcttgtgctgtgggagcatgtggtaggacaatgtggtgtttcattagtttgcatgagtggaactgactgactcgtcacaagtgttttaactgacagtggccagaaagtctgcagaattatccctagttaaaatgagcagtacattttcccaggcagtaagtaacctaccctgtcacaatgtcagatcttcaaggttgaagcaaagatgtaaggtccagaatctatgcagcttttttcctctaaaacattgatttaaagccctaactctgggctgtatcaatgccctcatctgaaaaatggttttagttattcctcttcagaaccattggtttctgtaactactgccttctctttaacaaagcaagatgttccctcagacacgcaaatacaccagcctttagctcagggttaatcagaaggatgtacgatgcgaaggtccacatgcaaacatctgcagtttatttatacccaggcatgtctgctgtctgcaaattggaagctttttgtgtactttttggagaaaaaaattggattttgagttaaaaaaaaaaatcttgggccgggtgcggtggctcattgcctgtattcccagcactttgggaggctgaggcaggtggatcacctgaggtcaggagttcgagaccagcctggccaacatggtgaaaccctgtctctactaataatacaaaaattagttgggcgtagtggcacatgcctataatcccagctactggggaggctgaggcaggagaatcacttgaactcaggaggcggaggttttagtgagtcaagatcacaccactactctccagcctggatgacgagagtagaactccgtcttagaaaaaaaaaaagaaaaaaaaaaaagcttttattagattaatagattctatttaatagaaggtatacttagcatagtgacaatggcttaacagcccaagttcaagaatgtttctgaaaagtaatagtccatgggttgaattgatgtttttataagtttaaagttgagttttagtaacattttgaaatacccctcggtgtttgaacgcagctgttgcgaatggtttagtgcattccgaggaatggtgaatgtcccggtccctggtggcctctggtgtgctgaggacaggagcagctgggtcagaggtgagctcagcccctgcatcttgcgctgctcctgggttgaagaagcccagagggtgggaagtgcctgcagatctaccagctgtctgatggttgtcctaaatcctctactgacaaggatgatttgaacctaaatgccaggatctacgcattctcagctgttctggggcaaaaaaaaattgttaacagattgcaaaccacaaccaagaaaatgatcagagaattacacaatgcagtccttgttgagtggagctgtgtaacatctcctctggactgccccctcctcactcccaccccaggacagacctgttttaaatcatgttttttttcaggccaccagcatgctatttgggaaaggtgaggtattttagtcttctgggtttttcacgcccctcaatatatgttgaaacaccttgtaaacagaggtgctatgcagttataaattactactcatattcttatcacatgtggatttgcgagccagcctagcctggctagaatacacaagctggagaagtcttagttgtaagctaaaggagtagttgctgtggttgattggaaggagactgtcctcagggggattggtctaggtggccagaccggcctgagccacatggctgatatgccctcaggtcatgcttcggaatggtgtcactatccagtctgtcaccaagaggctagctgtgggattggatgtagaatttcaagctctcttcttagaggccccaaagacaagcatatagggccttgtttgaaggactgtgctgttatttacaagttagagaggtctgagaaaccttccctagttgccccagcttttatgcagtgtgatctgtctgtaggtccagtttgcctgtgagtataatcactgaagataaaataactccttttgtgaagaggagaaaaaacacaagacagataatccagaggtttcagttcatatccttgtttttgccacttattagatgtgtgaactctatagcaagttctaaaccataaagtgggagcgtaaataacccatccgagaagtgctatgaaggttaactgctcactaaatatgaaggctccacagaatctcagagctctgactttcacacttgaccctggtacaccctactgggaatctgcgttgagcaggtcccatgcctgctcctagctcccacctggtcaccagcagtttcttcttctcctgctcagctctgctgggacgcctggctcaaagccactgaggcccttgctgggatgtcgacgtagccgtggctatcaaagaaagccactagtgaccttgacgctgattccagcagcctgacttggtagctttgtgaccttgggtaagttattttacctttctgagtctccatgtcctcaaagggtgactctaaggatcagatacaatctcatgtgagggtgcctaacacagaacctggcatagaggaggctcagactgatggatttccttccttccttcctcctggaaggctagagctgggaggtgcctaatcctttggtgtaacctgagatcacgttcaatgacggcagcttctgtgggagaaagtttctcacatgttgatggagtctggctggaatccctctatctgagcctgccctacagcaatgagccttggccaacactcaacagtttataggtataacaactacgcagtgcactaaaatatcagcataccatcgtactaatacacaaaacagagcctgtcttcagtgaacgggccccgagcctttgcctgattgttcttgtgcttaatatcagtgtctttgctgtttattcttcgatgcgtatttattagcttgttttatgccaggcattgtgctagatgccaggtacctagtgaagcacgaaatagatgtatcccctgtccttagggagttctcagtttagggggcattcaggcaaatgcatcattaagtacgtaactacaaaatgaggaggtacaaggaagatacaacatcagaggaccccaagttacttagactggtggagagaaggcctctctggcatgggaatttgaagatttgatataaaaagagaatatatttcagtaataatttttatgtaaccgtgttgaaataatgtctttgaaatagtaggttaaataaaggattaaaattaacttcagctattttttaaattgactatcagaaaatttaaaattacccatgtggctcacgttgtgtttttattggctagcactggtctagatttgggtaaggacttcagattttctctgtagggcaaaaggaaatctacctttaaaggattttaagcaagggaatggcacgatcagtttttagaagattgctttgtctccctgtggaggaggattgatggagaagaggatgaggagggaaggcaggaggtggttgtaaaagtacagggagcaggtggggttctgcactagcgtggtggtagaggagagaagtctgtggattcgagatatagtttgcaggtacagtctgccatatctgctgaggtttggatatggtggggtgggggagaggtatagtcaagcatggctcaggcagctgggtatatgggatagggcatttgctgagatagggaagcttgggagaggaccaaggctttatttgtttggttgattgcattttcttagggaagggggttatggtagattgctgagaatcaggacttctgtttggggtttgctaagtttgagatgcatgcatgtctaagtggaggtgttaaacagacaggcggttggaattatgagcctggagctctgcaaaaaaggtctggcctgaaaggtataaagttaggagtctgcacagaagtgaaattaaagccatggaaatggatgccatcgtcaaaggagagatctagagctctatgtaaagagtaaagggaaggaaccctaagaacgacctcagaggaatcccagcacagtttgttccagggagtcagcagaggaggccgagtgcagagaaataagataggatatggatagataggatctggatagggttggtgttcaaaagaagatttttttttttttgatgatagaattcaataggagactatcttgccatttaaactaaagcatattttatccactacttgatttttttaaataaggcagacatgttttcagggccaccctccctggggtctgtgtcagcagcatggtgattatactcctgtggtttcttcccagcggtcctggacattccccaaggaccctgtagacagaggaggtacatggacactgcagtgtctgcctttgcctaaagggtgatggctgctttttcaaggtttaggtaggtggccacgttgaggatgggtgtctgcccgggaagacaggtcaaggggatatgttcctttatctggtaggcagaagcccttcctcttagaggcttgaggacattatctcaaaaccatagcatttttattctgcctctcgattagttagaaaaagcctttacaaacacactctttcagaagccggtagggaatgggtgggggtggggtagatgggactggtgggattggaggaagggcagatagatagcagccaaacaaagcatctgcttttatcagaagtgctgtgtttgagcttagacagcctgaagcctgatgattcactgatgccagatcctctctgcctgccaagagacatactggccttgatacggtttttcttgttcttaccctattcaatttgactgactgctgccaagttaaaatttcaacagtggcttttagcttcatgctgtcactagaattctgctgagcccaggttaacccatgactgggtcaagtttttatcaaccagtaccactgtgtattagtcttggattcctatatagactcaccatagtgtaatatgcaggatatttaaatgatgctgttttaacatgattagggaaactgcctgaaaaaggagttgaattgccattcttttcatgaacacagtcatcaggcattgcaatgttttcagataagatagacactgactcatagaaaagtaggaactgggccaggcgcggtggctcacgcctgtaatcccagcactttgggaggccgaggtgggcggatcacctgaggtcaggagttcgagacaagcctgaccaacatggagaaaccttgtctctactaaaaatacaaaattagctgggcgtggtggtgcatgtctgtaagtccagctatttgagaggctgaggcaggagaatcgcctgaacccaggaggcagaggttgcagtgagccgagatcctgccattgcactccagcctggggcaacaagagcaaaactccgtctcaaagtaaaaagaaaagtaggaactcgctgttgaaatgaaagaaccaggcattttagaagtaatcaggccttagaatctctgacagccagggagggaaatgtgttcttgtctatagtctaccctagactgtaagaaaaaggattcccaaggtcgaggtacatgataaacacaatcccatggcctcaagtttaaaaagagaaacacagttcaggacaattaaaaacaatgctgtgaccccagttccaaaggaggaagaggtatgtggccatccagatagctcttctgtttaaggatgtgaatgaaagactgactccagtctgaacctgctcctttaaaggattcccccagtgtggtaatgaggagccagggccactttgatgtattcattcacaagtatgttgaactttggtgtgccaggctttatgctaggtgctggagattcaaagacagaaaggccaggtctttgtgcatgtaaggagccctcagaggaaggatgcccatttgaactacctctccttagcagcacctgttctccatcttctttgcaactgacctaatttctcatccacggtatagccctttgtattgctccactggattgataagcaatcctgcctttcctgacctctgaccttaacatctttccaggtatcatgttactttttctccttgacttgctgactgcaggtggcactttctagataaccctttcctttggacctgccttctctgtgctgccacttcctctgtgctttcctgaccttggaccctgagccagacccagggaaggtcgggtcatgcaaccaaggtccatatcagagggtggctctgggctgtaaagaaacagagtgcagagtgaaaagaggattgtgaaaaatgtgaagggtaacaaaagggctttcagaagttatgtttggaacaataagaccaaagagaggggcttgtgagagaaaccaaactgctaagcttctgttcagcttgcatttttttccatcaagaaatgacttctctgactggaaagggtaggataaatgtgaagcaagaatcgctggcctggagtagatgaggccatgacaagagactctaatgccacccgataaggtgaagccccaaagtccaagaagactgagggagtgtgagactgagatcatcaaatcatgtgatgttggaggaataatggagtaacaagaactacaggaaggatgcaggtggatacatagtttaatttttaaaaaaggatttagagagagaaaagctacaaaatgataagcttgacatcgatctcaggaaatattctattataaagtggattatcaagacaacgatttttgaatacttgataaaggaagcagtcatcgttagtagctatcagggctttgctaaaagccagtcataccagattaactttagttcctggggttacttggttggaagcttagaagaatgttgagaaggcatgcatgcaaatcagtcactggtgctatccgtggggtgaggaaaattcaggctagatgataatacaggaagcacgctggaggctgtgtcccctgttttcatcagttaaaaaaatcttctagacaataatattggcatacagatcacatacatgaatgacaaatctaggggaattgttaataggtcagagcaacagaaatgagatttttttttaaaaaaaaagagatcttggtattttgaaacagcaaaccaaacctagttgaatacaacttgagagggagaaagaaagactagcaccagagtccaaaaccattcattacaaatgaaagtatggggtttggctaaacagccacacacgaaaaatatttcaagatctggagaactgcagcctcagaatgagtcagcagcatgctatggctgttaaagaagctcccgtgattttcaggagcattaactaaagttaatattctgaccatcggagttggtcacacatggctgcccaaatcatacctggtgaattgtttttaactctagacatcagaaatggaaggtgaatctgcccctgactgcagagcagtgagcttctgtttagacctctcctgctttgaagcacttctattgctttaatcatgaagtatccctaacattcttctgtattcgtgaaaaggaatttctcgcatcacgtgttaaccctgggtgcagaatataaaatgagtgtcagccttaatcctgctaactgctagtaaaacatactttaacaaataagatcaatgggtatgttttaagatgtggaagactgaatctcttctcatttattttgcaaggggatgaaacaaaaatatttaagcgcacatctagaagttttatagttctctgtttaaagctacattggggctgggcgcagtggctaacacctgtaatcccaacactttgggaggccaaggtgggtggatcacctgaggtcaggagttcgagaccagcctgaccaacagggtgaaaccccgtctctattaaatacaaaaaaatttagccgggtgtggtgatacatgcctgtaatcccagctacttgggaggcagaggcaggagaatctctggagctcgggaggcagaggttgcagtgagcggagattgcaccattgtaatccagcctggggcaacagagcgaaacttcgtctcaaaaaaaaaaaaaagctacactgggccaggtatggtggctcacccctgtaatgccagcattttgagaggccaaggctggcagatcacttgaggtcaggagttcgagaccagcctggtcaacatggtgaaacccataccgtctctactaaaaatacaaaaatttgtaggccgggtgcagtggcttacacctgtaatcccagcactttgggaggctgaggtgggtggatcacctgaggttgggagttcaagaccaacctgaccaacatgaagaaaccccgtctctactaaaactataaaattagcagggcgtggtggcgcatccctgtaatcccacctactcgggaggctgaggcaggagaatcacttgaacccgggaggcggaggttgtggtgagcggagatcatgccattgcactccagcctgggcaacaagagcaaaactccatctcaaaaaaaaagaaattagccaggcatggtggcgggtgcctgtaatcccagctatttgggaggctgaggcaggagaatcacttgaacccgggaggtggaggttgtagtgagccaagatcgtgcaattgcactccagcctgggcaacaagagtgaaactccgtctaaaaaaaaagaaattatccaggcatggtggcgggcgcctgtaatcccagctacttgggaggctgaggcaggagaatcgcttgaacctgggtggcagaggttgcagtaagtcaagatcgtgccattgcactctgggctgggcaacattgcgagactctgtatcaaacaaacaaacaaataaataagcaagctagctacattgcttttaaatttagcaaaggctatatgcacaatattcccctgcctgcagtaagaaagtaactctttattgggaccttaatatgattcccaacatcagtaaataacctgctaatctaagcacacactagctgatatttttccaaaaatgtcatttctgcactcaccaggcgtgtcccattttaagcctgtttgttttctctttttcctggtaaacagatagaaatggccctatggtaaactctgtctgttctcttggttatctccctgattaagtttctccctggtattttaaacatgttcagagagattcattttcaacaagatcagccagcctctcacagtatcactttgaaaacatctggtctcattggggctggggagccaggcgctgctctggcagcagtgctgttctgttgctgagggagttctgtctgaggccatcacagttcggtcgctggcctgtggctaaattatctccttaatgagggggcctgtcaatccaagaacaacatttctctcttgttccctctctccttccaatgttttattcccttagtgaactcatagagtgtagtgggaggaaggtctaggtcttccgcgtattagagaaaacacacacacacacacacacacacacacacgttcatttattcaaaccaacatacatggagcaactgcacgggaggtacaaaggtgaatacagtgtggtccctgttcttagtgagctcatagtccagtaagggacatagacgggaatacacatggtatatcgaattgtaattgtttgtcatcacaaagttttataattcataggaaaggagcactgaggagatgtcactgattgtatgagttgtgtgtgtgggtgggggtgggaacgtgtggtcagagaagccagggatgaatgagaagaggatggggaccccaggcctattgatacaggtaattccaagtagttaaatttgctggagtgtaaggagcaaggtgaggagattaggctggtgagttgggcaagaccttagaaccgtgattgtcatctaaaaaatataaaatgagaatgctagactgtcccatgtaataaccttatctaatagaacattattatacttatatatgtaaccatatatataatatatatttctattatagtagaaggaatattgtccagtagatgcaaaatcttcatagacttaaagccggttgctggccaggcatggtgtctcatgcctataatctcagcattttgggaggctgagcagggaggattgcttgagcccaggggtttgagaacagcctggacaacatagcaagaccccatctctacaaaaaaataaaaaataaaaaaattagccaggcatggtggcatgcgattgtagtctcagctactcaggaggctgagtcaggaggattgatttatttaaccccattaggtcgaggctgcagtgaaccaatgttgcaccactgcactccagcctgggcaacagcaaggccctgtctcaacaacaacaaaaaacctgttgctatctctgtttcccctatcccttcattccctcttatccccagctaagattttgagatgttgctgaagcttcatgctggagaacaaggggtgaagcctctggattctaaggccatatacacatgcaaatgagcggaagcccccagtttgcctgtggagggcacactgtctcccagttgtgtagttcacctttcctgattgtgtgacataccctggtgcatgggttggttaaatggtagactagtggactccaaggctgaggtgtttgttcctcatgggccccactgcttctggtaaacagagaggttcagcctactggctacactcatcttaaatcttgttgtgttacattgtaattaagtgttctaggaatgagttcattcaggatgaataaacaccagcaaagcaagaactccatccaagacatgtaagccttctagtccctgccctcagtaagttctaaatctaaggtttttgcatagcgcttttatatccaagaaacttgctcaactttcttttttgtttttgagacagggtctcactctgtcgcccaggctggagtgcagtggtgccatctcggctcactgcaacctccacctccagggttcaaacaattctctcatctcagcctccagagtagctgagactataggagtgtgccaccatgcccagctaatttttgtatttttttttttgtagagacggggtctcaccatgttgcccagactggtcttgaactctgctcaactctcttagtagctctgcatagattctttgtgtgttctatgcagacagtcatcatttgtgactcattactgttttgaatcattacaaccagttttgttctttcttttccagtcctgataccttttatttcttttactttatttaactgtactggctaagacctccaggacaatgttgaaaagaagcagtaacggactgggcgcggtggctcaagcctgtaatcctagcactttgggaggccgaggcgggcggatcacgaggtcaggagattgagaccatcctggccaacatggtgaaaccccatctgtactaaaaatacaaaaattagctgggcgtggtggtgggcacctgtaatcccagctactcgggaggctgagccaggagaatggctcgaacccaggaggcggaggttacagtgagccaggatcatgccactgcactcctggtgacagaggaagactgtctaaaaaaaaaaaaaaaagaagcagtaacaagcgacatgctgtcttgtttctgactgattgattttagtgatgcttctaatacttcaccatctagaatgacacttgctgaggtttttggcagatacccttttcaggttgaagcaattctcttgcatgtccagttcattaagcttttttaattccagacattatgaaaaggtgaggattattttttctttttcttttcattttttttttttgtgggccatacatcagacttaaaggattcttttaatgcttttttcatcaattcaatgttcaaaattatttttctcttttaatctgtgaatgtggtaaattgtattaacaggttttctcatgttaaactgtatatgcctggaataaactttatttgattatgatatatattttatacattcttggatttggtttgtcaatacttttttaggatttgttcatacctactcatgtgatattagcctatgcttttcttttactgactttgtctgtttttggtatcaaagttataatgccctcttttttgtctctggaagagttcatataattttcaagtaataaataattccaaagtttggaagaatttgctatatagtaaaactatataggcctgatattttctttgtgggaagatattgaactacttcttcaggtttttttaaatgtttataggattattttgattttctgtttcagggaaccaaaaaagaaacctattgtctctacacaaatgctgatgggaaaaaataatggcaataatttttctcctaagaatccataaccacgggtcaagtctttatgttggttgggaattcaaattcctattacctgctttcagataaatccaaaatagagaaatcaaagtgtctgggttggcagtgcccactagtaacgaaacaatgcaaatcttttttggatgaaaacttgctcaacagaatgctactcaggttatccacaaatttggctgaatgtaaattccctttcagaaacaaccatacacactggaaaagaagccccaaagagtgaaagtcagcagaaataacaatagcctgagacccacaaagactttagatattagaggccgggtgcagtggctcatatctgtaatcctaccactttgagaggctgaggcaagaggctcaacatagcgagaccctgtctctgcaaaagattaaaaaattagctgggtgtggtggtacatgcctgtagtcctagctattcaggaggctgcagcaggaagatcgtttaagcccaggaggtcgagactgcagtgagctatgactgtgcactgtactttagcctgggtgacaagtgagatagtctcaaaaaaaaaaaaaaagacttcagatattggaatatcagatacaggctataaaataacgatgtatggtacatttttttttaaaaagataaaatcataagtggtctcagaataaacaggaaaatataaaaagaacctactataatttctagaaataaaaaactataatcaataaaaatataaaacccaatggctaggttaaataataaattagatatgactggagaaaatacttatgaattaaagacagaaagtaatcacacagaacatagcacagagagaaaaggcaatggaaagtatgaaagagacactgaaggagaaggaaaagccccaagtacatttaaccagagctctagaaggagaaaattgagagaaaggaaaaagcaatggtcaaattttaaataataatgagaaatggtaaatcttcacctagacacattgcaataaaactagaccaccaaagacaatgaaaagatctcaaaagcagtcaaagggcaaagaaagcacagtaacaattagactgatagcagattttcatcggccaaaagggaagatgaggcacttaaaattttgtgcctatcaaaactattaagaacaagggtgaatacagagactcctagacaaatgaaaacagagaatgtcctgcacgaagaaggaaaaggatgccaaaaggaaagcctaagatctaaaaatgcattcttaactagtgtctgcacagctcccttgttttgttgttctctgcttttccttcatgggttgactatttttgttggtctgaagggatcccttaaatgtttgtcatgtttcattgtactttttgggaaagatttatgtgtccataatttgaaggatgtgaaagactctcctaaaagagctgatttaccagttgagagggaaggagagcttatttgctattcagtagttgtgtggcagcagtcatatgtgcactgatagccacagaagtaagtagtaatgaagagaattcttatttattcagatcccagtggtcttgaaagttagtatagtatagtgcttggaggcaaaggtatttgctaattcattgttaacaaatggattgagtgcctgccatgtgccaggcatgatctacttagtttccttggaaagaattctgtgggtgtccttacctctctcttccctttcactcaccaaagccagtcatttatcaagagctatctattcttggaaaaatttcttaaatctgtacaccatccccccacctcccacactctagttcaagtctcatcatcatctctcatccagatgatgccaacatcctcttctttgggctttctgagtctatcttgccctccagctaatctgatttccatgctgctgcagggggacttttcaaaaacacaaatctctggttattttccagcttaagatccttcaataaatcccattgctatcatgataaagtctaagcatgtttgtgtggcatccaagccccttgtgacctggccctgcctcctctccagcctcagctcccagccccttactgttcctgctgctgccccgaacgctgcgcttaggtttattgttctcttactcaagaatccagcaaatgctcactgggcaactgccatgtgcaaagcactgagggtaccaaggtgagtaaactggacaaagcctcacccttggagggttgtattccaggggaaagatagaccctgagcaaacagacatttactataatatcaggtatgatggaaaaaaataaagccagattagcagatagaggggagtggtggggcaaatctaaataggctaggtaaggaaggtctctcggaggaggtggtgtgtgaacagagacctgaatggtgggagggagcaagcccctgagtatctggggatgaatattctgggcaaaagagtagtcagtaccaaggcactgaagcagaggcaggcttggcatgtctgagcaacaggaagaaaaagtcagtatgtgactgagatggaagagtggaatagacaatgagcatgttcatttttctttgctgtgtaacaaaaacttggcgacttcatacccattcattacctcacggtttctgtaggtcagaagtctggcttagctcagctgaggtctcagttcagggtgtcccacttaggatgtcagctctggggaagaatctgctcccacactcattcaggttattggcagaattcagttccttgcggttgtaggactgaagtctctgtttcctggctgtcggtggtgagggcagctcccatctcctggagaccacttgcagttctgtgccataggccttctcataacactgcaccagcggcagggtccctcacatcagatccccgtcatacttcatgtcaggcccacctgggtgatcactgtctcgtaacatcaactgacttcagcccttaattccatctacaaaatccctgtgcagcagcactaatctaaacaccagactaatttttgactgagtagctaggggataggaattttggggggctgtcttaggaattctgcctgccaccatgaagttggactggtggctggggtcaggccaaccaggctcatagggcatggtgaggacttgagggttttgttctgatgaggtgggagcagcctgagtaaggaccatcgtggctctgggtagagagcaaattgtggagctggcgagatgcagaaggtattgcaggtgtccagcgggagatgatggtggcctgcgctcaggtggcattgactcctgaacagcttgcagtcccccaaatgtaccatgttgccttgtgtccctatatctttgcacatgcttctcctgttgcctggagcatttcgcatcaccacctaccccatgtggggcttcttcactgaaacaagtccccactgagtgctccaaacctagctcagatgctgcctggaggcctctccacagtgtttcccacccactggcaccttctcgccaacctgagctttgttgggtctgttaagctgtcttccgccctgtgctgtaacctctctggagtcaggggctttgtgtttggttcctgtgtttccattgtctagcctagtgcatggcatattatagatgcttgatgatgtttgtgggctgaatacaagaactatgggagatgactgggcgtaaagtagacatgttacgactgttggaaagctcaccctgtagagggaaagagcatatataaaaaaatatacaatacagtgaactggaatacagacaccatgccaagtgcacacaggaggtgtgccacctctacagattgctagtgtgcgtggagcttaaagggagcctttatcctactcagtctgcagtagttggcgctagcttttcacattcctccattgcatgaaatattgatagtattgcaaacaattccattttgttatatctaaaaacatttgtttggcaatactcttagccattaatttattcaataattaaagaagtaaacagtcattcatttaaaacattctataacttaagactgacaagtaaccttccttccctatctgtatttcaactacttggaaaagaaggtctgtactagtgaaattttgctgaagagtaggacctcttaattcaaaataacaaacacttacagatcaagtgtccttttaagagggaggaaattgtcaatctggttactaatgagaaacaaactaaaatagtaagaatatcatttctgcgactcaactaaacatttctaaagtttgaactttaaaaagtgggatgctggaaagaatgatttaaccagagtagacacagtgatgttatttaaaacttcataagcttaaaagcaaaataatgagggagtccagtttcaccctgctggcttccctgttggccattcacagtggggcagcgtgcctgccaggaggggccgaggtgcctgccagaccctccgttgcaagtagagatgcacccaccatggaatcacagggtgaggactcataattggcataagccaaaaaaaattataaaaaaaaaaaaccttttcatttatatcgccaagtttctctgtttgttttctagtgatctgtcttagagaatagaaatctgtggtgcaagaactgtttgctgtacagtcttgtgtaaataattggatattctatttccaattagaggctcggtctatagggccaactgtgatgttttctagctccctggaaagggtgtctgggtgtggagaatgtcttctttttggttagcagcgattgggtggctggctgggaaagaagtagacacagcatttctgcatttaaatataattttaatttggttcagattttttaaagcttttggatttgtaatgcattaacttggttttatgatactgtccttgtattctttcccatgcttctctaaaaagggtgaggagaataagcagatccaggaccccttggagccctgtaactagaatctgagaacacttgaactcctgtttgctttcagaacagaatgaacaaggctcccgtagcaggccttgctgggttcacctgggagcagcactaagagggaactttagtcttatccttttctcggctctcaaggcgttttagatgaagaaaagcagaataatttcatgggaagtgccaaataccccctcagaagttctctgggtagtttgcctaactttttttggcctcactgccagagagcaccgctggtttgtctgtgtgtggccgcatgggctaacatgttgacatggggaacccggtgtggatgcttccacaggcctgatgagatcagtgctgacacgggcttgggaggcatcctaaatgtgatgccgcttctcttggcttcccttttataaaagggggaggggaagggagtgtagggtaggggtaaggccagagtgggagagttacctggcaacttctctgtgcctttttgtagcctcagtgttgaatggtcaactgtacatctaatcgacttctttaaccattactcctgagagcctctaacttgctggccattgtaccaggacatacagtctaatgtagtccacatctggttcaaacctcagactcctcttcctagctgagtctcctctgttttgtggtctgtaagttgaggatagtacccctttcttcacaggattataaaaattaaatcttctaatttatgtaaatcactagcacaaagtaaatgctcaataaatgttttcttgtttcctaagatagatacagtctctgctctcacatgctagctttttccaacagtctggacagaggaccatccagcttcccatctgccagatgaccatggaccttcacacccatcttggaaggcagttcatcccattttcagatggtgtagtttttggaaagtacttccttaagtgaggtgaaaatcttcctccccgtaggtccctctggctgtgcctaaacggaatatttgctccttcttccatacagaagtcctaagctgttactgacaagcagcctgtgtctaccttctccccaagcccactctcacccaagctaaatgttcctcttccttttggttcttcccatgttatgtggcttcagtaccttctctctctacctggttgctggttttctggacctgtcctggggagccagtgttctatttattcctgttttatttacttttagggtataagtgaatattccagatgtgctctgacaaatggctcctacctcctttcattcatggtttttaatcttctgtcaatgtagcctaacatcccactggcatctatgataactgtatcctgctatttcacaattaaacttggtcaatcagatttcacatctttcccatcttctacttgcacaagtggaatttttaaattagaagttcaaattttattcctgttctgtttcatcgggttaggttttgcccatcaccgaattttttggggagaggggaagaccttattaatgtgatttaatacacaggtcacacttataacacttaatatatgcccacatattacttactaatgccaggtgctgttttaagtattttgataaatttcacctttgctctgtctccacaactatcctatgatacaagtactattattcccattttatagatgacacaactgaggcatagagaggttgtggtcacatggtgaactgtgttgagattcacacagtagtaagtgatagaggcagtatttgaaaccaggtagtctggctttatagcctgtgttcattatcactcagctggagtgactgttacatgaactagcccttctggttttcttttttgagacagagtcttgctctgttgcccaggttggtgtgcaatggcataatttcggctcactgcaacctctgcctcctgggctcaagtcattctcctgcctcaggcttccaaatagctgggattacaggcgcttgccaccacgcccagctaatttttgtatttttagtagagactaggtttcaccatgttggccaggctggtctcgaactcgtgacctcaagtgatctgcctgcctcggcctcccaaagtgttgagccaggtgtgagccatcacacccttactcgcacacattacaggtgtgagccatcgcaccctcctaggcttcttttttttttttcttgattaatgaatttgatcactgtgccatcagagttctcgtttaagggatcataatagtatgaatggaatggaggcttggatggaacacttctgtccacttataaggacctttctagataatcagtggtttgttgttgggcttttttttggttgcgggtagagtgggtagagtgctggctgttgagttcaaacaaatctaccttacggaatactagataacttggggtcttataaattgtttggtcatagcaatgtcatgacttcctcaacttccttgttgaaatccagatatgatttaattatagcattcgttagatctgctggtctattcgtcatatcacaaaaggcaatatagtcagatttgtgactgtaactcttttttttaggtgctgaacaagtcattctggttaaattttgcctaggacctgctgtttttaccagatttatttgtaaaacccttttccttttgccttttttttttcccagctacatgattttttttttcctttcaccttttgaaagctgaaacaatctttttttccctttctctagagaggcatgtgaacactcaccacacttcctaagctagttctctttggctaaacctcaagctcttgggaaagaggtggataaccagagttggccaagccaggtgctgtgtgtgggtggtttctggggcagcactggctgcagttagcagtgtccccacacaaagatggaaccacctcaagacaaggtgtcctgtgctgtccccatagccttgcttgtctgtgcagacccagcactcaagatgtcccccaacccacccctgggtgaactcccctgtgctcctgtttggccctccaccataacacacttctcttggcagaagagaaggaaactaggagttgctgagcaatctgtgtcttcccttagcccagggccctttgcttccagcagttggctctccttgttctcagtcttcttatcctagttactagagctttcttatgcatcttaatttttcttctctggttccttgaagctggagctggtattcaagaagagttccctgccctctaaagcagggaacagtcagtgagagcagtcagtctcactgtggaagttaggtccaagcagggggaatgacagctaatgacacagggcagcctgcaggagtggtgcagaccagggaagctgcagccaggagccaggctgagggaaggtacctcagggagggcttcctggaggaggttggaccaagacccactggctgggagaggccgtcttggctggagtgatggcgggcctcagacagaagaggaaaatgaggctcctcaggtaacttggggtttccaaatagctggtcctcagttttgctgtcaggacactggagtactgttatgaattaggaaggtttaatcacaagtaggaggaaatataagcaagcactgactgatgatagttaatgttagagattttaggagagaagctgggaagacaaacctcaaacctctttagccagttaacgaaaaattctctattttattctttctttttcttaattatcctaatgtcattcatttaagaccttaatttttaacgagtctccttttgggtctctatttcagtcaaacctcgttgaagaccatcccttttcatttttaatgtgtaatttccatttaccaagagtagcttttggtacttttaccatttaccaagatcaaaccatttacctctacacatagcacctctctcctccatcccattatgcctctcactaaagcagaactacaaccctcacctcataagccctgcttttattgcagacatttcaagggaatggctttggatggctttaataaaattttccctaatttgagtcattcatccaatgctatgtcgtgtttgattgacccatgttactttcctcatgtagagatagtccactggcacccagatatttcagaattttaagtgaaaaagaaaagatggacccaggcgcggtggctcacatctgtaatcccagcactttgggaggccgaggtgggcggatcagttgaggtcaggagttcaagaccagcctggccaacatggtgaaatccccatctctactaaaaatacaaaaattagccaggtgtggtggtgcatgcctgcgatcccagctactcaggaggctaagtcaggagaatcgcttgaacccgggaggcagaggttgcagtgagccaagatcacaccattgcactctagcctgggcgacaagagcaagactcgaaaaaaaaaaacatatttcaagaaaacaatacataggaactttatcgtacagctggtctcagatgccattgtttggggctaccttatacgtgagagcgcttcaaatctcctttggtactttagttactaagtcataaccaagagcagcaaagtgagggtctctttggaagcagagtgtccttctatttagaagaagtgttttctctagaatatcactgtcccgtagaactttttgcagtgttggaaatattctataattgggtcatgctagctgctagccactagtgtaactgaggagctgatttgtaaattttatttggctttaatttaaataaagcttgtttaaacatcttaaattttatacttctgttaacctgtatgtttttatgttctggtctcaggaactcttttttacccctagaacattttaccttttctggtgaaaaggatttgggttcccagcaaggaggtgcatctctaagacagcaaatttgattaggcttcttaaacagtcctatgattctgtgggaggggcattcatgtttagagcaaaaattcaccacacaagaatcattcttataaaattactttcctttttaccttctttaccaaaaatacctctttaaatctttaactttcttttcatctcttatttcctgattcctttaccttgttttagacataactctatgaggtttgagttagacaaagatattttacctttaataagaacattaaaaagaaaatgttttcctgtaattcttaaatcagaaattacccagatacttaatatcaaataataaccttagattctaaattatgacaagtttgtttgtaagcatttattccattacatttatctgattaatgtaatagtttacctagactattaacaaaaactgtgatagctaatatttaaagttattttccttttaactatttttatagctgtgaatttcaggtatttacttaagtaataaaacttatgcttaattttaaggttatttattccaataactcagcatttagttattttcattaagccaacaatatttcataggtatacacaagcaaagattattctgtcttgggctgggttttatagttgataaccctcatggcaaatgttatagtattctgcagggataaacattgctagtattttaccaataatttttttttttttttttttgagacggagttttgctcttgttgcccaggctggagtgcagtggcgccatctcagctcgccgcaacctctgcctcccagattcaagtgattctcctgcctcaccctcccaagtagctgggattacaggcacgtgccaccatgccaggctaattttgtatttttagtagagacagggtttctccatgttggtcaggctggtcttgaactcccgacctcaggtgatccacatgccccggcctcccaaagtgctgggattacaggcgtgagtcaccgtgaccagcctaccaataattttaaagccaccttatttattaaagattttacttaagtcatgggtatctgggtaatttccaatttaagaattacaggaaaacattttatttttaatgttctcattaaaggtaaaatatctttgtctaattcaaactttatagggttatgtctaaaagcatttgactagtcttttaagtatctgattaagtgcttttatatattttttaagccaattaattagagctctttatatatttttagtagtgaaacactgtttacacaatgtataaatacatagaggtatttaggcatgctgatagaaatacattttatagattcataaagacttcctttttccttttttctagttaaaaattcttaataacatgttgcatcactctaggcagttctcagctaaatagtcctaaattttcatatgaaaggaaagaacttaggtgaagatccgatagcaaaatttacattataagctacagggagaaaaagtttggtgtgctagagggaaattaaaataaatttagctgccaattaaacataaatattataaaattatatatttatatatcatgtatatataatgtataatatatgcatatcataaaatgcatatatagtctataatggccttttaaatatacatggatacatatatatacacacacacacacacacaaagatcctgtagctttactttagtactttagccatgaaataagtataaattcactggcttgcaagaaaaaaaaaactgttagatccaaacagtggtttttatctcagtggaaaagtaacagcagatttaaagtaggcagaaaggaagacagaaaaagagaatttaggaactctatagtttgcaggtcgaccctagggttctttttccttaatgtaaatgtgcacaaagaccatattacttctattttacataaactctgggaagtagaggtgccataaaacctacagagtactcaaaaggggatcattctccttattttctccttatttttagagtatttctttctcacatttttttttttcccccttgaaaggaggaactgagctctggcctaggatttttgtgtggtggatggatatgtgtcctggatgagccattttaaaaattaatttgcactgaggatttccctgcagggttgctgcacattgtggggggccaaccccctagacactcccacgaggcccccagtcacccatgggcgctttttggctgggaggagcaaatgccctttctcttcagagctgaaaaaactcagtctctcatttacctatgaaaacaacagttcagtttctcacgcaaatatgcacagtcaagccaaattgagattaattctgagagaaaaagcaatagaggagaccctttagaatgcaccttcgaactggaattaggattcttaaacaacaacttcctaggagaaaaatcagctcaagaataaattaaggaccatcaaccaaaacaggaggtccagagctcaggaggacttaccagttccaccagaggagaagctcaaactgggtgaggcttcaatgggccctggctggtaccttagctccagttttgggcaactccttcagggtcctgagtcttctctgaggccccacatgtttgggcatcaaattattgtcaatgaaaagagtcaaactctgtaaaatatttgaagagatttattctgagccaaatatgagtgaccgtggcctgtgacacagccctcaggaggtcttgaaagaatgtgcccctggtggttggggcgcagcttggttttatacattttagggaggcatgagccatccgtcaatcaaatacttttaagaaatacattgatttggtccagaaaggtgggacaactcaaagcaggggcttccaggctgtaggtgaatttaaacattttctggttgacaattggttgagtttgtctaaagactggggattgatagaaaggaaatgttcaggttaagataaaagattgtggagaccaaggttcctttgaagtcttatagtggctgtccttagagacaacagatgacaaatgtttcctgttccagtctttaaaaggtgctagacttttagttaatttctttaggattgggagggcctggaagaaaaagatttagctatgttactagagattctttacagatgcaaattttcccccacaaaggacagttttgcagggccattccaaaatatggcaaagaaacatgttttggggtaaaatattttgactttcttgtcacatgttatgccagagtcagattggaaagtaagtcacgatatatagggttaaataaaacccatctgatgagaatttatggtttgtagggcatgactctccagaccccttagataggaatttggacaagattaaaaaatctgagcttagtcctcagtatgtatccaagatatacaacatgatgctatggaatacatgcaatatttaaaaggttactaaagttgaagcaaattaacatattcatcatctcacatagttatccacttttttgtttttgtggcaagatcagttgaaatctactcagcatgaatcccatatacagtacaattgtattacctatagtcctcatgttgtccattagagctctatgcttgttcatcctacgtatctgctgctttttatcctttgacctacatctccccatttcctctgccttctgcccccatccccataactactgttttattctctctctgtatttttaaaaaaatttctttttttttttttttttttttttttttttgagaaagagtcttgttctgtcacccagactggagtgcgatggcgtgatcttggctcattgcaacctccgcctcctgggttcaagcaattctcctgcctcagcctcccaagtagctgggactacaagcactcaccactacgcccagctattttttgtttttggttttttttgtgtttttagtatagtagagacggggtttcaccatgttggtcatgcttgtctccaactcctgacctcaaatgatccgcctgcctcggcccccccaaaatgctgggattgcaagcatgagccaccacgcctggcctcttttttttttttgagatggagtttcactcttgttgcccaggctggagtgcaatggtgtgatcttggctcgccgcaacctctgcctcctgggttcaagcgattctcctgcctcaccgtccctagtagctgggattacagacatgcgccaccacacccagctaattttgtatttttagtagagacggggtttctccatgctggtcgggctggtctcgaactccccacctgccttgatcctcccgccttggcctcccaaagtgctgggattacaggcatgagccaccacacctggcccatatgggggaataaaaacactgggcacacagaacagtaggatgaattgctgagattttcaccaggagtgggtgggtaacagccagcgatgagaagagaaggctccgttccctccatcacccaggcactgggcaacctggggcagcccctccacccacctaagcctctctcttcttactgtcaatgtgggcacaacacagttactggtggggacgttctggggattaacccagacaccaccagtgaccgaaagtgccacacgttcccgtacccagtcctgcctgtctcccacctctgccctcccctgagctctatgcttcagactttcactttctatgctcaagtaaatctagaattaccacatgtaaatactctaacattctggggcctgaatttgacaggaaagcatgtgggagcttctagactgaggtcatggtggtatctcccaccccaccacacacaccctgttgtgaatactgcctgggagatggggcccagcttagtaacttagtgaatagggtgaaataatgttggacacattatactcaatgtaagaatgcatcgttcccaaccattctcatatttatattttctcttttcagggatccacatcttctggacccaactgtggaatatgtgaaggtaggaaatgagaattaaacatgtagccgtgaccctgggtagtagatttcccatttggaacacagagttgctaaataatgctgcagcctggtttgtgtaaaaagctgattagactctccaaaacaacagggaggaaatttgactcccttaggcctttggtaaattttgtaggggtctcacgtcatcctattacaggtacccttatctggccttagagccaggtgtgttttaaaattcagagtttgtttgtttgttttccagaaaggtaatatggtacgtatagtaatactcccagagaggtttggggtcagcactccataatcacactcattattttcacagtgacaagtaagaatattcacactaagagggataaatagatgacaaatgattttgtgtagttcaggtcacattttgccaccaaatgagtttgctgccaagtaaggtttttttaatgttagtgttcagagttttttggattttggaatgtagatgaggaattgtggacccatatttaccttcagtggaggaccgaaggctccctgagattttatgagtcatcttttccattccaacagccaccctcttgttcagggctaatctggggccaagtagtaatattaggtacttagttactttccagccggactggcggtcaatgcttctaagtattcaacccttctaaataatgtatttcttcggagcaggaagaaaagatgcttttcacttcttccctctgcctccgcattttccagtgttgctgtttgctttattttcttttatttttgaaactgtattctgtcacctcctacagaagaaagaagtctgattctcacatttggtttcttggatttatgacaacatacttattttttgggagaaatcgtagcaagagttagagtttagaatcaggagtctcattccaccttcgctatcccaaaggcagcagcatcctagtttcagagtatgtaggcatgtcgcttttgtgtgtacccatgccttcccccagagttctgccatttcctccctctttaaaagaccagaggatggacggaagaggaggaagctccagtagaaccacttggccacttggggcggtcgtagtgaggtttgttggaatggaggtggatattcttttttcccatctcttatacctgaatgacaactgagctgtgttttcatgggagaaaatgtataatcctaaacctgcagggctaccacaccagaatctggccagagctttataaatatgtatctgtgtccctcccggatgcatcacatgttttgtgcaggttgtgcattgcaaagtattagaggatgctatttgcatagactgtgatatgacttaacaaaaaatgcactctagaattctgcagtgtgtaacaacagctctttaaaaatcactccatgccttgtttcagaaattggctatctcctaccacgggccagtctggctgtgctcagcaagtgtactgccttcttcttactccaataccagttttttcttttacaaaagtctaaacccttttaagataatttggtagtgcattctcaagctaaatatagaggattttggaatggcctgtttaggtattatgcaagctattgcatctcatttatgaatatcaatcattgtgagttgagtggtattgacaaagaagagatattggagttgtcagtggcttctgtttatctgggctctctttgccttctcctgacagtgagatgtgatggaactgctctttgaggttcagagggttctccttttcaagaacttgttgaggtattccgaagggtaccctttcctcctaacttgatctgaatctagtcagagccttataaatcatgtgtctgtatccttcctgaatgcaccacttttttttttctttctcacttcacccttggtttagagggatggtttgggaatgtgttgagccaatgtagggtatgtattttcatttgcctctatggacactaaggctctgaaagcacattcatagaggtctctgacgtaaaggtccaaggggacccagggacccatcttcttgggttgggtctgttgtagcacttctcacacttagttgccctgtggagccgggctgaccagtgccaggaaggcctcataagttgatgccagctggtgcctcatggctggagataaatcaagggaggtgagagagttgcagctaaactgaggtgcagtttgacccccttaacttcttatctacaatccgcttgtgcacttaatgcctcttgagcttggagaaaagtagttctatgtgaattatgttgtgtcataaaggccccttccagtaggttcagattcattggccgaaaaaaacaagcatcaagaagccaaattttaggatccattttgactccagaatagggggagtcttatcctatcctgagtctcatccaggcaggggaagcacccagttgtggccaacagacagcagtccaaatactggcaggagctccagccccaggtctccctccctccctgtgtctttaaatgctgctcccctgctgggtgcggtggctcacacctgtaatcccagcactttgggaggccgaggtgggcagatcacccgaggtcaggagttcgagaccagcctggccaacatggtgaaaccctgtctctactaaaaatacaaaaattagccgggtgtggtggcgggcatctgtaatcctagctactcgggaggctgaggcaggagaattgcttgaacctgggaggcggaggttgcagtgagctgaagtcgcacgattgcactgcagcctgggtgacaagagtgagactccatctcaaaaaaaaaaaaaaaaaatgctgctcccctccccatcggagactttccaaccatcttcccttggttttttcagtgcccagatagaagagagaggtctgggactgcctcctgcctccttgggtctgggagagacaaggttctgaggctgaccctcatagctcgtggggcgaggggactgcagtgtcatggcaggagagagctgggtggaggaagaatccaacattcagctctggcagtttgtatgtgtgtcctcctagcaccgtgcaccgtttgtgttgcagtacattcatgccaggtgaaaggggaccggtttctcggttgcttagctaccggtcgttcatcccaagtggaatggaggaaaatatgcatggctgggaagccccagggctgttgggcagctcttttaccttgtccagcaggctggcctcctgctgggactcctgacagcaccaagaccccaaaggctcaatttgatatttggatgtgagaggaaaataaattgcagatccaaagtagtccagggatttggggaatctcattcctcactgtttccgtctctttaattctggcacttacaggagagaattttgttttttttcacatttttcctaaccttctctcctcacaattttttccccccacagtagctcagaacatgatcatcttgatagtttggttttaacttttgtctaatcatgaggtccttttctgtggtcaaacgtaattgattctgtttccctgcattgaaaggaaagatttcttccaggttggaaagctgaaccctccagagtggctccaccttcctcctgctgtttaccatgtagctagtgacttcggttcctggcgtacagctctggaattttcctctgcgtacctagcataccttaccctagataaaaccaaacatttttttttaataggaggaaatatcttttagagccaataaccctaggcaaaattatgaagtagaattttatctctatactgctcaacctactcactgccccattgcacttgcccagatttttacttcgttaaaacacaattacactgtgtccagtttcttagatcactatcaagtagttgcttagaaaatttgataaaatagtagtgctaaaatgttaataaatgataacagctccatgtgttccccttcccagatagctgtccaacagagattcacatcccctgagaccccccaccccagggagggagctgggtccacactctggttctttttgttttgagacagagtcttgctctgttgcccaggctggagtacagtggcgcaatcttggctcactgcaacctccgcctctcaggttcaagcgattatcctgcctcagcctcccgagtagctggaactacaggcgtctgccaccacagctggctaattttttgtatttttagtagagatggggtttcaccgtattagccaggatggtctcgatctcctgaccttgtgatccactcacctcggcctcccaaagtgctgggattacaggcgtgagccaccgcgccccagcccacacttttgttctaattagcaatgtgaccctggatttgccacctgctctctgtgggttccattgtccccacgatagaaaccttggagtgggctattgttccttctagcttacgtttataggattctccatgcctagaataggctggagaggaaaatcttgtagccagtggtaaggagttcttaattgtgcgatatccctgttgatcctaagattgccgtattgattggaacaggataccatttcatgttgtatcttggatatgaagaccaaggtcatgatggatcataactgccaccaccatgttcccagaagagtggaagttaccccagcactcctgcattgctctgtgatccattatggttcacttctgtaaccccctttcaacctatgaagcctaggctcacttccactctttatcactctcttccttttattttcccctggaactgcatctttaagcttcagaagttgcccccacaaccagcactaaatataaatgtatattatctcctctgggtgcgatggctcatgtctgtaatcccagcactttgggagcccgaggtgggtggatcgcctgaggtcaggagttcgagaccagcctgaccaacatggtgaagccccgactctactaaaaatacaaaaattagctgggcatggtggcaggcacctcaggaggctggagcaggagaatcgcttgaacctggggggcggaggttgcagtgagccgagattgggccattgcactccagcctgggcaacagagcaagactcgtctcaaaaaaaaaaaaattttacattttctccttcccctttatacctatattccttttagcctcaagactagtgctgctttgtttgttttgttttttgagacaggggcttactctgttgcccaggctggagtgcagtagcaggatcatagctcactgaagctttgaactcctcggctcaagcaatcctcccacctcagccccctcaggtaactgggaccacagatgaccaccaccatgcctaatttttttttattttttgtagaaacagggtctcactatgttgcccaggcttgcctcgaactcttggcctcaagtgatactcctgcctcagcctcccgaagtgctgggatcacagatatgagccaccatgctgggccaagactaattctttttggcctcttcacacaccagccctacagttattttagtaaagagttcttttctaggggtggtttaagctgtagttttttaagggaggaagtgattggctagggcagggctgggtgatttttcttttagaagaagtgtttattatacattttccattttaaaataaattgtcctcaaaaaagttacattagaaaatatggtgaagtagaaaaaaatattggaatgcctgttttttttgtttttttttttcaaattagccatgaataggcaagtgtttttttgtggccaggctgtaaacagcacgcttgcccgcctgtggacaaaggcctgctctccaggctaccgcagtgaggaagtgtcaggacggaatgcaaccttttgttcctggctagattcctagtgaacgcatgtcctctttcttttgtagtcagccttggtgggttcttgttagacccactgtgagctgtaatagaatgacctacagtctctgagcttgttgcgcaggttaggagaagaaaggacaaggctgcagctgttatcctgagtggggacagagccctgcagcttctcccttcacagtgcagatgaccccagagaaactcaggaagctgtcctttctggggtcaatgctctgaaaattctccttccccaagggtcttctaggtctatagacgttacaggccatccaaggctcagatctcagcaaggccatttcctgcagccggctggggatatattaggtcacccagcatatttaaaaaggagtaattatgcaaattccaatgccaagaataagtgccctggctgccggagacctcagtggagaaggggtgatgtgacttcagctccctttttgtgctcaagatggctgcagccatggtcacaattaaatagctgtctttgagagaagccttttcttccagcaggaaagcaggccagtctgctctgaattagccagctcacaaagccatgaaagggacttacaaaaacaatggcacgctgtacattccatgagattttaacaagttatatgaaccaaataatgggccgattggctggctctgcaggtttttgcctgagtgtgcacattggcagagccagcgccatcccctgtgggaccagagatcaaacaccgccagcagtgaatgtaaaacagccctggcccgctctggggcccacatgcagagggacgaaagggagctcccatccaacttcttccactccaccccaaaaacattctctgcaaatattcttgggaggttcggtgttactacagttattaaaaatgctgaggtaggatgttcccacatcctaggtatggatgacagtctccctcattcagtggaatcttatccttcaggtctatgaaaatgtggccatttataaagagtaaaaccttatgaaaacacatgtccgtataaaagtctatatgcatgtttatagtgacattattcgtaattgacaaaaacaaaaactggagacaaccccaaagtccttcaactggaaaaaagtagtacacccatataatggcatattatttaaccttaaagaggaatggacttttatttacttatttttttaagaaacagggtctcattctgttgcccaggctggagttcagtggtgcaatcatagctcactgtaacctcaaacttctggtctcgggtgatcctcccacctcactgagtagctaggactccaggcactcactaccacacccagctaacttgtttattttttgtagagatggggtctccctgtgtgcttgggctggtctcgaactctggccttcctcctgccttggcctcccaaagtgctgggattacatgtgtgagccactgcttccagcctaggagtggactgttgatatacgcagaaacacacattgtgttagtctgttttcgtgctgctgataaagacatacccgagactgggcaatttacaaaagaaaaaggtttattgaacttacagttccatatggctggggaggcctcacaatcatggtggaaggtgaaaggcacatctcacatggcagcagacaagagaagagagcttgtgcagggaaactccgttttttttttgttgttgttgttgttgttgttgttttgagacagagtctcactgtgttgccctggctggagtgcagtggcatgatcttgactcattgcaacctccacttcctcggttcaagcaattctcctccctcagcttcccaagtagctgggattataggcctgggccaccatgcccagctaattttttttgtatttttagtagaggtggggttttgccacgttggccagcctggtctcgcactcctgacctcaaatgatccacccacctcgacctcccaaagtgctgggattataggcatgagccactgcgcccagccaaaactccccattttaaacatcagatctcatgagacttattcactatcatgagaacagcatgggaaagacctgcccccatgattcaattacctcccaccaggtccctcccacaacacatgggaattcaagatgagatttgggtggggacacagccaaaccatatcatgggtgaatcttgaatacattacgttgagtgaaagtagacagtctcaaaggctacgtactctaaaattacatttgtatgatattctggaaaaggcaaaacttatagtgacagaaaacaaataaatggttgaaaagaggttggagaagagatgaagtacaccaaggagcttccagggatgatagaaatagaaatatcgtgattgtagtggtagttacccaactggggttggctgtcagtgctcatggaattgtactgaaaagggtgacttttgctgaatgcaaattatacccaataagcctgaccttaaaaagcaagctaggctgggtgtggtggctcacgccctttgggaggccgaggcaggcggatcacaaggtcaggagttcgagaccagcttggccaacatggtgaagcccctgactactaactaaaaaaatacaaaaattacccgggcatggtggcatgcgcctgtaatcccagctactcgggaggcggaggcaggagaattgcttgaacctgagaggtggaggttgcagtgagcaaagattgcgccactgcactccagactgggcgatagagccagagtgtatcaaaacagacaaaaaaaggcaagttaaagccttgtatttcagtccttaagtgctgccacctcagtaggagaaattttccattttgagatgggccacaccagggaggccagacccttgatgagatggaaaaagtgccgagcttgaagatttttgactgcagtggctcattcaacagatattttttagtatataccatgtgtttgtaattgttcagtcaggtcagaccaggtgggaagaaagtgttaccaggagcctaacctgagatagtcgcagtgggaatggaaagttaggccacatggtgaagggcttttagagatagaattaagacccagttattagggaagctgagagattctaacaggatgtaaatggtgcaggtgagggagagaagctaggggcagttcctgggaccacaccagtacctagcattgtgccagaagccagtaaatagggaggaaaggagatgtccatttggaaaccttgttaccacagtgacgttaatcttcgagcatttgtggatatctttagaccaaggggtcagcaaactatagcctaagaccaaatctagcccaccacctatttttatatgaccactaagctaaaagtggattttatattttaatatggctttttttttatgtggagtttcgctcttgttgcccaggctggagtgcaaccatgcaatctcggctcactgcaacctctgcctcccaggttcaagcaattctcctgcctcagcctcccaagtagctgggattataggcacccgccaccacgcctggctaattttttatatttttattagagacggggtttcatcatgttggtcaggctggtcttgaactcctgacctcaggtgatccactgcctcggcctcctgaagtgctaaaatggcttcttaaaaatcaaaagaagagtggcaaaattacataaagttccagtttttatgtgcatccatagttttattggaacacagcaatgcccattcatttatgtattgtctgtggctgcttttcctataatggtgggattgagtacagattctactccacttacgatggggctacatcccaataaacccatcatcaattgaaaatatcataagttgaaaatgcatttaatacacctaatctagagaatattatagcttagcctactgaatattatagtttaccccagcatcacctaagagtatcatagtgcatgttgctaggccagaaaagatcacatttcaaaatttgaagtacagtttctactgaatatatatcacttcagcaccgtcgtaaagttgaaaatcagtggaaccattgttaagttagggcctctgtagttgtgacactatggcctcaaaagcctaacagaaccttttacagagttttctgacccttgctctaggctgtttgcacctttgctgtttctgttttgccttcccaataatgcataacaggctttcaacaaaagtgagtccttgggcaaattttatgatcttgcacaatcacaaggatagtgcttttgtcacactgtgcaggatttggacgcatctctgcatcttatgaggtgtacctgtcagctctgagcagcatctctctgctgccctggtcggttctggcatctttagcccagatggatgaacaggtgtgtgggggcagcatgggtacttgaaccctgactgctcctgcctggggcttgcgtggataactcctcaggccagacactgctttgtccatgcagcctgagatgggttttcttgtgccacaagtcagagagaagggacttctcactgggcctcctgaacttgatggtttgagataaggtcaaaccctggagctgccctctggaggtgctgaaaggaacatggtctggccagtgagaggaataagaccagatttacattctgtgtgaatttgtattctgtgctgcaggcatcagccttgaagctgaggcaccatcctccctaactcgaggaaggattcttctgagatcccgaactgtagggatgactgagagactcaaaaactaacaggcaggcaagaattgaaactgtggcttctgacgggactcagctccatattggacttcgaatctggtgtggcctgtccacctctaacctcatctcctgccaccccaatagtcactgtcctctgccaccctggctttccctagtgtctctggggctttgccttcccattggcctggaaggttctgaggcagaatagctgagaggtttggagtgagtgctaggacactgctgtgggttgaattgtgtcccccaaaagcgatatgttgaagtcttaacccccagtaactgtgaatggtgaccttattgggaaatagggtcattgcagatataatcaaattaagatgaggtcatatttgacaaggatgggccctaatccactgactggtgtccttataagaagaagatttggaccagacacaggtgtagagggagaaggccatgtgaggacagatagagactgggggatgagtctgcaagccgaggagtgctagcaaccaccagaggtgaggaagaggcaaggcaggctcctccctgcaacctttggagccattgtggccctccggatactttatataggatttttagcctccagagctgtgagacaatagaaacatttctattttaaagtagccaagtttgtggtaattggtcttggcagtcctggaaactaatacaaatccagagcccggttttagccgtttcttggttgtatgaccttgggcaagttactgaagttctctggagctcaatttccttaacagtaaatgggaagatcggggattaaacagtgaatacatgtgaagttcttagttcttagcacagtgccccacatgtacttagcactcagtaaataccagctatatggctggttcatttgacacatttcactgcctcagaacagccttccctgacatccgtactaaaagcagtccccaagtcactatctcattactctgtatattatcctcatttgtcccaaattttatttattttattttttttgaaacaaggtctggctttgtcacccaggctggagtgcagtggcgcaatctcagctcactgtaatttctgcctcccaggctcaagccatcctcccacttcagcctcatgagtagctgggtctacaggcatgcaccatcacacctggctgatttttgtatttttttttttttttagagacctggtttcaccatcatgttggccaggctggtctcaaacttgtgagctcaagtgattcgcctgccttggcctcccaaagtgctgagattacaggtttgagccaccacacccggccttatttgtttacttttaaaaataagacttctcactagcatgtgagtcctgaggacaaagacccttcttttgtttagtgagtgagcacccacaccagatgcacaagggcgtttattttaatttttaatttttgtgagtacagagtaggtgtatatgagatattttgatacaggcatacaatgtgtaataatcacatcagggtaaatggggcatccatcaccatttatcctttgagttacaaacaatccaattgtactcttcagttattttaaaatgtacacacactgggcacttaaatttagggaagggggaatgaggttgttctaaaaattttatattttgcaaagcaggtaatgctgatgtctctaaaatttttccagaaatccttcggtgtttttattgcaaaacagcaaagaggttcccgcacctaacctcagtctaccttctcttgcccacctggtacaggataaaaactgtggggttgctgttgtcaccttaaatactcacatatttgggcagagatatacactgtttttaaaagtgtagttctggcaacttctatgacttagacctatctactctttgggagatcttgttaactatagggagtcagtaacttcaacaccaaaacgagaggcctggattgctagctttagaatcatttgctgttaagctctgccctctagtgctcatcagtgtcacaacagttcagcatttggctacaattcggtttctaaatattctaagagcttttaatattaaatgtaatagcatgtcaggacttgtattcaacttcagaaagaagagctgtgtttacaatacatgaaaatgcagatttaaattgtcaaggaattttattattagaattaattgtcaatgttcttgaatgaagagctctaaaatgctatgatactgtatgtagattttgagataggaggtttgcatttggcccaaagtgttacctccggtaaccaagaagtttcctgggaacaacttgtatttgaattgtgatttggtatctgaaaaaacatctcggcttggcaggaaggatgctggtattgggtaaggcagaagactccatgcctgggagacagcgtgtgcccaggctgactggagcaggagagaacagtgggaggagccttgggagaagcagtaggtgctccatgttgcttgaatgggaaaagagattccgagaagaagatcacgttaagaaatgagtttgggaggaatttatttattgccaaactgtctaactacatataactttgcaacttgcttttttcattggacatcattccatattaaacgtatgggcctccctccttctttcgaatgggtacccagtattccattgtatgaaatacagttatagttaactagttgcctactgacatttgggttttgctaatgttctgttagaaacaattttgtggttagtacatagtcatttagtaagtatttgttgagtctcttccctgtgctggtcactgttccaggggctgaggatacagcagtgaacaaaacaatatccctgcccctgtggagcttttactctgggggtggaggactggaaagacaataagaaagacagtcaagtcaatcctgttagctgacgatgagtgcttagcagaaaagatgcatcagggaaagcagctatgaaagttggagtaaggggacattaaattttagatagggtgaccagggaagggcctcaccaagaaggtgacttttgagtggaaatacaagtcaactgtaatgtctaaggggaagaagaagggcaaggctttgaagccagggtccgcctcttccatggaggaacgaggaggccagaggctggagctggtgaaagcagctggtgttagagtggcagaaggtgatgtgcgagggattgtgtgtcagagtaaagacttcaattttttctggaatgagatgggaggcatctcaggttcactttggcttctgtgttgctgctagactgcaggggacaggggcagaagcagggagaccagtgaggaggctactgtgattgtccagatgagagatgatggtagtttggacctgtgagagcaggggaggtggtaaataagggggttctaggaatgtaacgtgaaggcagagccatcagcacttcctgatggattggacatgaggtgggagaagagaggagccatgcttgacactggtaggatggtgctgttgtcagtggaggtggcttggtgtgcgttagtgtaagaattttcagaagataaaaatctaggagtagaatgattcagtgtcacataatgggtcaaaataaaacttcttggcaaccgaaagttttttttatttgtcgtttcttacatttttctcagtttctaatttttttctaatagtgtttttatgatagttacttataaaaataaaaacacccctgtaattatatcccttagtctactccataggtaagatactgaaaacttatggctcaatcaaaattatgtaaagcaagtaacttaaatattagagcagaagttcttaaattcatttgtctcaagactttttaaattattgaggaccctaaaaagtttttgttatgtgacttctagctattgatactcatcatgttagaaattaaaatggaatattttaaaatgtttatttaacttatttttacttgatgagcatttcatgtaattcatttaaaaataagaataaacccattatataccagtgaatgtacatttgtggtaagaatgacattgttttacatatttgcacatctctttagtgtctgatagaacacaacttgattcttatatttgcttcggtgttcactctgttgttttgtgttactttggttgaagtctcaaataatgtggccctgcacaggtatgcagttcagaaagggaggagtattttaatagcctcttcagatcattatagttgttggtctttgatactagagttcaacaagttgtagttccttaaaagttaactgcaatgtggactctgaaatcctgtcaatgaacttgttttatttccttaaaattcaatttgaatggatctctcttgcaatttgaatggatcttttacccatgcatgagtttatatcatcatgcattggccatttgaaaaatattggtttacgagttatgcagatcttataaatgttacatatttcactatgtaatatcagaactcacattcattaatatgaccaccgatctcatcagaaaaatcattaaagtattggaaagctgtcaaactcatgtggtgaatacaagttttccaaaattctaattttcacttgaaacctggaattttatcattggcaacaaacactgtctgttgttttccttgaagtaacaggctcactttgttcgtttttcagaaaatggctgccaaataaatacccgagtctgaataaccaagtttgtcagacattctttgaagtaaaaattgtgctctatgaaaaagcagctagttgagcccacaattcaattgcacagttgcttttccttcacacaaactctgtgcttggaaacacagcagaattgttttctgtgcatgtcctgttgcattgtatagaatactaaagagacatgtactcgagggcccatatttaataaagtgagtaattctcactgcttcatcaaagacttctaggtggaactggctatttttcttcaattctttgagccaatgggagtcaagagtgcaatggcccctggtagagtttggtgcctctgccttgctttgtgctgaggcaccaggaattaacccatcatagcttttgcaccaccagtataaatgtcaacccagtgaaacaggcaaaaaatgtctctgtattattatgaaaataagttttgacctctcagacccccagaagaccccccagcctgcagatcagcctgtggaacacactttgagcaccactgtaccagagggtcttttgctacttaagagactaaaagctgcaaaaacacttaaaacacaaataatcccctcttgtttatctaaatccatatttatttctctagcaaagtttacttttaagctcagcttgcccaacagttgcatttacatttaaagagacttgtttttaatgtaggaaagacattaaattttcatttaaaagtaaggaaaaaattgagagtcaatccttgaagtaagggttctcaattgtgggcctgttccttgcagtggagtggattgtgacacctctggaaatgctaactctatgtaacataaccaagtcatgatatactgtaaagatctggttgctcatcatatactataaagtgctaggccagaagcaattgtaactctcctctcattgctttatattaaaactctgaaaaccccaagcttggtgaggccaaggctgggttatggcaaggtgctctgcctgagtatgcaagtgtagtcgagggagaaatttgttgcagggatccatttacttgggacaggctggaagtgcgcattctcctgatccttaagcttttattaattgctgcagccttggctccttctatgctcccagtgtggatttgctggctgagctccatccatcctttatgtgaatgaagataaggatgtgtcagaccctgggaatgagaacatgctgtttggcccttcaaggcaatttcctttcgagtcccagccctctccagatggcatctaattgtttcttgaatgacctcagtgtccaggctgcaggaacctggtctgagaagccatttcacatatttattagcctgtggatgagaacttactatataaagcccccattcacattctcaaaagagctttttgtacagaagaaataaggaaactgatggactgtttcctgtgaccaccagtcttcagccggattcttatttttaccaggcccaggtgggtgtattttgaaggggtctgtgtggtccagctgaatccatcctggttcagtgccctcctgtctgtctcctcatggtctctacatgaaagccttgacagaatagagtcaagtccccttacctcctggtttcaggattacttgaacagagtacaggtagtgtgagttgggaattactgcattctggaagcctctcccagtttggaatcccagctagttcaaagtttgagagagtaaaatgactcttttatttttgagatggagtcttgctctgtcacccaggctggagtgcagtggtgcaatcttggctcattgcaagctctgcctcctgggttcacgccattctcctgcctcagcctcccgagtagctgggactacaggcccccgccaccatgcctggctaatttttttgtatttttagtagaggtggggtttcaccatgttagtgaggatggtcttgatctcctgacctcgtgatccgccctcctcggcctcccaaagtgctgggattacaggcatgagccaccgcgcctggccgtaaaatgactcttagggccaaagtgggaagcagccgtaattcagccagaggctggcaaggctggcttacccggtgaggagcatgacttctgtgtggcctgtcatccctcacgcctctgcagttctgaactatttttggagagacagggaagggcccctaccttcttgcaaataccatgaacaagagccacgtctctagaaatatgcatgcacacttactgcacatcttagttccaggtgtttgtggaccccaggttgagaatccctgagctatctccaaatgttcagtgggcccctatcatgttcaggcattccaatgatgacaataagacatgggtcatgaggccaacagacaagggcaccagtcattttaatgagtgcttcagtagctgaaccctggaggacagggttggagctagggcttcttaaggggagaaggaaacccctacgggcccacacagactgagagcaggggctcccaaacttccaggccatgtccacctaaggactgtctaaggagcacatttgggaagatttgaatgtgatttggagatgatgtaaacgtcctgtcctttgacctggaaagaagtcatgagggttgccctcgcaggtgactgtaccgggaaaagctcacctggcctcaataaggggatgtctcagccagtacctctaaattgggtcctgtggccttccacatagcagaaaagccttttggaaacatcctccaggagctgaggatggtgctgatgccacataagcagggctgagaatgcagtttgtttgtgctttcccctggctgggaggtgctgggtgtgggagcagaactcacccctacaccagtggcacagtacattccaacaacatgaatccctctccctcttcctagaggcaaattcgtgtattgttatccttgaaaactcaaggcaactcaattatttccatggaagtccctggaatagactgcaaaacaccattaatttccattcattgctgacacatgagtgtacaaccctattattaatgggtgtataatatgcatgttttcatgtaacatcagttcatgttggctccttgtagcatttctcagatacagagatcacattttatacacataatctccaacagagccagacacagtatgttacatctccatctcaagttttaatcttacactgataaggtgagcctgtaaacccaaattgatggtgtgagctaggaaacttacctctgggaagggcaggggtggagtggcctgggttgatgactacttctgggaaggaaaacatttttaggaccttagtctcttgcatctgcctctctcagcactttgaccacattctcttccatcagcttctttatgcagtgagggcctggctgtgggctgctctaggcttatattcttaaggcttgtggtccaaggggaaaaggggatgtctctctcagccctagtttgaaaagtctcagggaaggactctgtttggtctcatgtcattcacctgcttactcttggaccattcagtgttcagtattctgattggctcacacatccattaaaaggatgaatacacatgctactcagtaaagcttttaaatataatagccaccacctgctatctataccattcccccccttacatttttaggatcagaagtatattctgctatatttctattatctctattcaggatacatatataaaatgttgagacatgaatgctaagttttgcgaaaaaaaagaaaatcttttcaagtcctattcccatctttccctagtttatctccctcctggtttatgtactggatacccattgcctccaagtttgccagatttgctactgttacagagaagttatgggcagggggtggggatgtccagaggggctgtggatccccagcccatctatagcttgtccttggatggattcccacatcttatcacaagtgacccaaccgggagtcctggtgttcctggatagttacccagatgggtttctgctgctctccctagtaattctcccttcctccacccagcccttccacccatttggatatacactgcaaggcgtacccaaatctttgagccactggcaaaggaatttattgtccccaccttggcaccaggaagggcaaatattgaccttctggatgtcactcctgcagacagcattatgcttggcagttgactacgttaggaagtgaagaaactggccggcagtcaatgaggtccttccatgcacagaaccctctgaattggcctcttcctatagaggaaggggtactgtttgtgtttccatgtgacaaaagcggtcccttagcccttcttgtgcagcaagcctttgttgcctcctggttcttctcagattctgatgtcagcatccatctctcccagccctgcactttcctttcagctgtgagcggaataggacctctgatggactattgcagatgagatctgctgcctgtgttgccaagagtatctgtccctctgttggagggaggtctgcctttcagatttgcataagataaagcacttctggtgaccaggtgttctccgtgcttccctcatcacaccagatagagccagccattctgattcgttgttgttttaatcattaactttaagagctgtttgatcccacatgtgaaatggagataataatactcctctcctagtgtgactatgaaataggacaccatggtaaaagttctctgtagaagtgctggctcctggcctggcatggtggctcacgcctgtaatcccagcactttgggaggcctaggagggtgagtcacaaggtcaggaattcaaggccagcctggccaatatgatgaaactgtgtctctactaaaaatacaaaaattagcccatctctactaaaaatacaaaaattagccaggcatggtggcgggtgcctgtagtcccagctactcgggaggctgaggcaggagaatcacttgaacccgggaggcggaggttgcagtgagctgagattgcgccactgccctccagcctgggcgacagagtgagactccatctcaaaacaaaaacaaaaacaaaaacaaaaccaatgtggcttctggggacctttcacatggggtgagtgaggtgaaacgatatctgtgacggctgcaggcttcttcaaggcatctctgaagtctgtggtgaggaggggttgttgagagtcaaacttgtagctcttccaattttctgtcctaagtattacatgcaaacaaggtccatccacccactgagtgaaggggttcccgtgctggttaaagctgctccagcggccataagaaactgcaatactacttgcctcaaggctatctatcccctcctcttaccagccacatccctgctacaacccgggtgtgtgcaaggtggccagccagggtgctttatcagtccgtactcacttctgtgaccaccaaggtattctcacctcccttcctacatgccactgaaagtctttctggatcagaaggaattttttggtcacgtgactctttgaaattgggtaaaagtcataacccctctcctcaatgaacacaacaatttgtatacagtttctagtggcccatggaagccccagtccacccctaggttcagaactcctcatctggactgattctcacagctactttggcaggatacagaattatccagtacgtcacttagatggtaatgcccatgatcagcttatgaccatgaaaaagagatattttcccactgaaatattttgtttgcatggctagaatttgcttgacaacagaaaagcgattgataagaccattttctctccaggctggaatgggtggggttactcctgactccacctctcacctggtactgaccccgccctccgcccctgggttcctgccttcctaggcgggtgatcccttgcaggcaggttcatccactcagccacttggcagcctttctaggtggagatagggatgtgtggctttagaagaatgcactgtaactctggcagattcctgccattagggacttgagagaaggagatctaggcagaaggcagtatctgggaggacacagagagaaagtctagagagggcagaggggtcacaacatctgaggagctataccagacacggttgtagttctagaattggttggtatcagacaacccagtaatacagggcggggaaatatgaaggagtcggcatgtgagaggtggttctctggggatgctaaacacatgtggaagatctgttcccagggctgaattgcagggccagggcaggaggaggtggggctggaggagtgaggatcctgtagggcatccaatcaggactgaggctgaagtccaattctgcaactagcttggtcccaaggcaatgggaaaggaggggtaccacccaggccccataggcagagggggcccacaggatccccagtcagattggctcagacaagggtggtacatggagagctggtagttgtggatgaacccaggagtcccctgggttaggatcatgtgagcagatgctgtggatacacctgctgcctgttaaacaactcctaacatgacagagactctggagtagacaatcctgagacatctgggcaagtgtgattaaaaccatatgtggtatttgaataagcagttttagaatttaatgagtaacatatattttaaggctaaaagcttttagaagtctccttattataccagctcctaagtataccagctgggagccagccagtggtcagtggctcatggcatgggtgggtgtccactctcttctcgtggctacaggcgtggttcctgtagcccagcgtgtgggtgggcgtgtgccctgcgagtacagtggggaagatggggtttgttgtcccttctttcgaagggggaaggaagctcatgtttgtagagtgcctactatgtgttgggtgccaggccctccatgtgatatctcacttgatgcttacaataacttggtaagtctggggaggaaactaaggctcagagaagttaattaattccccaaagtcacccagctagctagtggtgaagaccagaacccatcctggctcgctctctagcctcctacctccagggtgtgttacagagccattttgaagacaagcaggtgtctgtctcacagctcagttttggaagatgccattttgcagaggtgcttgtgagacagagaactggcgcagtggaggtgggagagaggcagctgttcctggctggtaaggcctccagagggcctcgcagatgcccgtctgcccatttctgcagcactctgcatgggagggacctctgaagggctttgtggtcgttgcctattagttgcttacatagctcatgcctaccaaaagtggatggaaagggaaagagaaaagtgtacagcaaagaaaacccaggagctgagatggcaggagaagtaagtgattgctccaggtgtaattgcttgcatagtaagtgtagaagaaaaggaatcttgggaagtaggtggtgaatcatcttggatggataagactccaaggggtatatggatgggcttctagtggatacaagaatcccctgaagcagaggtgtccaagagggagaatgggttcttagtttctgtttctggttgggccagtaaagccccttcctcatccctcttttccacttatcactagagacagaaactaaaaaccatggctttggctgggcacagtggctcacgcctgtaatcccagcactttgggaggccgaggtgggcggatcacgaggtcaggagatcgagcccatcctggccaacatggtgaaaccaagtgtctactaaaatacaaaaaaaaaaaaaaaaaaaattggcgtggtggcatgtgcctgtagtcccagctactcgggaggctgaggcaggagaattgctcgaacctgggaggcagaggttgcagtgagccaagatcgcgccactgcactccagcctggcgacagagcgagattccgtctcagattaaaaaaaaaaaaacaaaaaaaaaaaaaacccacggcttcaggctggtaaatgcctaaaacagagcaaaacggaacaacatagtaaagcggattggacaagttctaattgtaaagcattgcaagtatgtgtcttttgctctagaaggagggcccatgactttcatagaatctcagagaaggccaagatcatcagatagtgagtctgccatttgagagcttgggattatgtcctgtatgtattctttctttttcttttctttctttttgcctgaacgctaaaaacagaaaattgagcttgtgtaatataagatttctggggtgacaccaggaactaggtggtagtggtagagaggtgaatggggcagaattgtgtgtgatagcgtaagaaagcaaaacagggcacagtgcctaattttgcttcgcattactcagttatacaattttaatagctagttagagaaacagaaattggtaagggaagacagaaggcccagcagagagaaatctgctgtgaagactgtactttagtctctttgtttatgtgctaggcagatcaatattgcttccggatagagaccatttaacagccatactctttcatccccttgaggaatctggggaaactgttagaccaggatatgtacagcacgcactcctaaatgtactgtctgtgttcaccagggcaggcgaacgtcttgtccacagcaatacacaaagggggccagagggcgcaggcattgttgcctgccctcctcccactaagtcttgtttgcattccctttcggagcaagaaatcaatcagatttgcatatagggaaatgtgtagaactgtctttggcagcttctgtagctactgagcctggctggaagaggagctgaccttttgcacaaagtcctttcctcctgtcctccctggtttcccagctctcctccctcaggccctctggctctttgtgggaaggtgtgtgagctgctggcttatttgttcagaatcaggcagagatagggtgggtgctggggaagtcttgagaagcaaggctgcggatcaacttgcccctttatctgcctagggcttcccaggcacctgccacactgctctccacagagccgagtctgcagaggctgtcctcaccgtgacgccaggctggtgctgagtggggcaaggtccaggctaatcattgcctacttcccagggcaccaggaaagatggagctggttgcatcagcctcatgccctggctcattaaagctgtctttgttcagcaagagccagatcacctgggtttaggggaagcaaaaagccagaaagcattgatctttaggggagagggagtaggataaagggtcttagtagttgccacaagatgttttgagctgttctgatcacgattactggtgttcacccctgaccgatgtccctttgggcaggaacaagccaggccttgaagcctggggtgagtcactgtcctctagccatgggcagagtcactgtccatggggccgcttgacaaagcccaagagtgcctcagtgtaaggcttgatgccctgattctgggctgctttggggagggtttggggctatgggcagtattacgttccagatgtgctgaaacagtgaaaagcaggtacctagcaggcatatctttctcctgccatctccctccatgccctgttggagagagggcctacctcactgggagcctgatcttctagcagggaccgtggtgctttgggaaaaggactctgcactcactctcttggcccttctcagctgaggggctgctgccaacaggaagcatgtgtctgctgaatatggctggcaggcagctcctgtttccatggttactaaatagggcaggttagtattagggctgcccaaggaaaaactggcattgagggcagtgcttatgcaggggtcttcctccggcctgccttaaccccctttttgaattagagggtgggcaacatttggcctgaggtaatagaggtttccttcaaggacccacctggcttcccagccatggctttaatcacaagtgtttccctcggtgcaaaggagtgagccttccaggcagccagagaagggcggtggatgggagttcaccctgtaggaccttttccagagctcagagctgcctgactgggcccctcccttcctcagtccctgggagttccttagaaatgccctcccctatcccgaaaggggcatggtgtttagaaagccctgtatccaaatttgatgagtcccaaatcccacacaccagatcatcagaaagtggcccactgccccaggtcacagccctttcacggggctgtgtgagtaacaggtttaattataagacattaaaaaatctatttgtgtttctatgtgatcagataccagattctgcagtctgaggttggagtccctagccctttgttctctgctgagtggtacacaggtctggtcctctatttctttgtaactagaataatcattgtggggagaatgggaggaattgatcagcgtaaataggcagcgtttaaaagcttaacaagtcagtgaagggcactttgagaatgtatgcaattatcatctttagttacaaaaacaacacgttattttagtctctctccttgaccgtttcaggagaaaattgattaaaacctttgagtgctgcttcagaaattatttttggtgtgaaataaaaataaaagatgcttaggaaacagttacctaataagattagtcattatttaatcccggtggaacaaattctttgggtattttggagatattcttagaataaacagagaaaacctcaggtaacaagagctgtgataccacagtgacctaagtgtctttggttttgtttttaccctggctgtggagcactttattcgtaattctatgtgatttacatgtctgagttatttgcatattactttcaggaatgcatttcattcacgatttctgggggaagggtgtctgggcttcggagtctcttggctgactaatctcacgaatttctgtgcaggatttcagtcactgcccccctcccttttctcaggcctgggatggtgcctgtctagcctcttggggaggtttttagcttgaaggaatcgttatttgctctccaaggagaataccaggtgaaaatggcccattctgtggtggctaatggcctgattgatgagtcatgctcacagaactgctggggcctgggcctggctgctcacacggacttaccctttgaactccatctaacggaaatgagggcaagccagaaaacgcttcctcacaggtgcggtactggaccttcgaggacagtggggacccactgaccagacagtcttcaagggctcttccagctcagaaaacccttctgagttctgccaccttggtgcttccttctaggttctctggtggactttctgtggcctgggagccgtcaagactgcagaccagacctccagagtcagagaggagaatgagtgagggaggaaagcagaaaggaagtcatcgcccacactcgctgtggcaatagcgcctcacttagcagctccatccccatgttgacacgttgatgaggccgggcccttgcccttgcgtgggtgtgagactgtggctctccatacctgctcactgggcccagagcaatttcctatttttgtgggcagacttgacctagtccaaaggccaaggtctcccgaggatttgacgctaatcccgttggatatttctcatacctccctcatgcctcatctggtattgttcctttctggactgaatagatcttgtttcttcctcattacaagtttctgcctgtgtgaagttttagaaagcttcaggacacattccatatttgaggccgaagccacaaaaagttaatatttggagcggtaggataggagaggaagagctacaggcagaaatctggatttgattaaaaaaaaaaaaaaaaaaaaagaactcgttgagcatccgctataactggaatgaagggaaaagcagttagttttccctaaaggtgttatgtggctcttggtaggggtagaggcctcaggtcgcagggaatccaggagggccttgcttggctgcgttggatgcgaggtttgtgtgcaggatctaggttacgcaaagtgggtaatcagagtggcgatgagtaattaaagtgaaggatttaaaggaaggtataggacaaacagttgagtcagaagtgggtacacagtccccatcctcccaacaggttgcacagccaggtgggagggcatagggcgctcagggtgtttgctgacagacttgctaattaaacaccaaaaggcaatattgctttgccagtagtgatggctgtgccaacgttatcagctgcaaactggctgccaggagcatcttaattaaaaataaacagctctggaggtgggcttgggagagtgaggacagggatcctgcctgggttacttagtacatctagtatttctcctagggaaagtcacttttaggccacctcctttcctcaaaggagcctctgttcataacaaggtggtgtgaatgtacaacttaccctgcttccttaaacctctgggtgctggagtgacaagcagacagaaccactaggagcaggtcgcatggtacagttcagccccagaaggaaattctgggtcgggggagaggggctgctaatgatttctgcctggtctctaaattgaggggacagctaaagcccaaggcctcttctaagaggggttagaatttcatcagaaagcaagtctggtcacatgagaatttctggcactgtgtgcatggcaggctggacaccagcctgcgagaattgagcgagtggatcgtattggcttcagcagaggggaaaagtcccagactagcctgggagaaggagccgactcactcccccggctgccgacttccctgacttctgggcagaaacagcacagctgctgtggtgggctagggctttaacgtccgaagccccctttcttttaaccctaaagaaagtgtgtggtccccgggactgaagaccgaaagatgcctaaggaatgcagtgctttccacgccctctcagcagctctgtgctgcttctatcaccgcaagtctttcattggagtcaaggtaggtttggtttggaaataaagtacatctgtcaatcttttgggggaccctgaaagcatgagtttcctaaagggcaatagataaaagtttgcagcttgctgattgtgaaaacagaggtgctttctttgactgatgggtcttcaagagcccctagtggtgtacctcccctggaagcagaacccagtggcacagaacagggctccttgtctgttttgggctgaagctgtttttcaggacactttcagttctctgtaggctgaaattttatactaaagtagctcaataggacagagctatttttcttctttctctctttgtctctcttccttcatttctaacgaacacaaggtagctgagcccttttctctgtttatcctgctggtccattacttatcaataatgtacataatgtacagaagccacacaatatttcctttcaaattgcagccaggtttcaaaacatctcagggttcagaactgttgttgtctttactgctcacattttaacatttgttataagacaccggtgccaagagctttgtataatatgtcaatacactattttgatgaaaatattcagagaacctcctttggctaattcaagatgaggcctgtgttctatttgcctgcctgtgacgcactaggaattaagattaatataggctttcgtggatcttggggtttgtctgccttggaaaaagcctgtcggccccagcctgactgcggacctcgtttattcctgggaaattggactctgaaagctctcaaggaatccttcccaccctgaagcagagctccctctcctgtgggactggctcattcattacctttgaaaaggctgcagcagggttatgatgttctgcttctttcttctcaatacgcttttaaaaaaatcaggaaaactacctgttagtgggagaaaacctttttgtttaaaaatatacagagtgggaaaagggtgagtttccattgattttgctccctggtaggagtgttcatttttgtccctttgtcaagaaatttgacagaggatgagtaattaatcattggttagaagcattcccttcctgacttgagcccctttctgtcctggagcccagtgaagtgatgcgagatccatgtggtttctggcctaaatatggatcgttcaagtgtggggcagatgaagtcatgccattaacagtattttaaagcttccaagatagactaggaggtcccaaagggtatggtgcacttcggggattggcagtgggtttcactctaatagaagtccttccacaagccaacttctgctaattcagtgaagtgcaactcagcattgggtgtatgagggagtcagcctataaatatctgggtctgagggatgagtttctgtttgggtacctgttggtctgcagttacggccccaaggctacataatatatagaaaaggccacttaatatatggggtagtcgggtccagctgtccttcagcttgtgcactctctatctctccaccgtggccactcttggtggttgactgtggtagaaacacccttctttccgcctggacttctactctattcccagtttgtcgaagtcttcatagcacagagagaaggcctgagctgctcactcactggaaactgtagccctcggtcccaacttagggtttaccaactgcaccctcaagatgagtctccctgttttgttttgcttagctagttacttgggaaagaaatctgcttgtacttaatcccccatcctgccagtggtgccccagttgataatgccgagtcgctttattgactcccactttaattaggggttccagatcttgctgctcataattagtttccgttgcaattagagtttcaaaattaaattgggattgattgcctgatagcaaagaggaaataaagctccaattcttgaccatgtatactgcttctcttggcatgaatttctcataccaaaaataacactgcggtagccatggtaactttccatttggtctaatccatatcatctctggagaaagtacgatggtattaatagtgtttgctgtatgggaacaaaactaaaaatatagagggtccctccttacataggagaatgattatacaggtgtttttagagagtaagatcttatttgcagcggtcttacagaatttaggatgtatttagaggcctcatacggacttgtgtataaagaccttggaaaggaattaaatgggaggccgaaaatggagagaaggatcagggatgtgctggccctcatagagttggggccaaatacaagatgttccagccatgttgagggtcatgactttaatatcccgaaggggttcacagtagacagccgttacataaaagactactggatcttttttctgggggaaaaaagacgaaagtgttttatttaagcccagtggaaagaaacttgtaatggagatattccagatcataacattaacagacatattcaagttctaaagtccatgcgtgttgaatgtagaatgggtgttgaatgtaaagtccatgcataagccctctgttaggtggggagggatttgtgggaggtgtggggcaataaatgagatttgaggcatggttcctgccttcaaagacttaccacaaggatattattaggtcataatatcacttcattacatttgcaaaagactttcaaatgtatgagttctttcacatcttgtctcattggagtctcaaaacaagctctctatgctatgaagacttcaacaactttgtctcactggagtctgaaaataagctctgtgaggtgagcagggcaataatttaccctttccgcagaggacacaccaaggctcagagaaacagcccgcccagaatcatttcgtggggaactaggaatagaaagcagattttctgggctgaagcctagtgctctttcttttttttttttgagacgtagttgcccaggctggagtgcaatggcgtgatctcggctcactacaacctccgccttctcctgtctcagcctcctgagtagctgggattacaggcacccaccaccacacctggctaatttttggtatttttagtagagacagggtttcaccatgttggccgtgctgatcttgaactcatgacctcaggtgatctgcccacctcggcctcccaaagtgctgggattacaggtgtgagccaccatgcctggctgctagcgttctttctactgtactatattaagacaattgacgcctaaaataagatgatattgtgtatgttaatactttattttgcagttcagttgggagagaacagtgtgagccttagtttttaggaaagcttcagggaggatgtgggactgtttttgtttttgatgttgttgtttgtttgtttttaagaacaggtaaccccttttaaatttttctcctttttttaataactggggatttggatggacaaagaaaagaatggcatagggacggcatttcagcctgggggagcagcagacccagtagctcagagatagaaaagccactggcatttgcaggagtgcagaaggccaggcctgctcagagcagaaggttcactgggaaggttagtgtgtgacatggtcagagaagtcacagaggatctaggaataatcccagcagccaggcctcctgtaccaggggttaataagtatttgaggcacatttccccattggctttcatcccattgcatccttagttcagctcagcagtcaccggttgtggtacctcggatgtgtcggtgctggggacccagtgggagttgttggtccagtggggatctctgctgtaataccatgcctggtgggcattctgcagacatttaactctggttgaaggaaacgatcggttatcactgatttggtgttgctctctttagagggtgctgtggctccctggaggcacatgcctggcatagatggggcaggagtggcgaggatcagggatggcctcctgcagggaggcagagcctttgctgagtctggtgaattagtcgaagttatccagagaaggaggagaattggccttcttcgtggagagaggagcacgcacaaagtgtagagacgtggagtaccccggtgtgggcaggcagggaggcatcagcctggaaggggagcacagggagtggccgctggcaggcccgcccccaggtccctggtgagctagaggaggaacttggtaaaaagcacaatgggtcacatttctggggctggcactggaaacaaacccctacctcttctggccccttgtgtctctgactgttagtaacttatttatttaggtatttttgtggacaggggacaaaggagctgaaacttgtcactttgtcaatgtttgcgcctgaggaaggtcaggggtgcctgtgtcagaggaacctaagagacgggaattaccttgcaagggcggaaaagccacctttctgaaagagcgcagatagagaggttggggtgtggtgcctgtggatagatggaatcagtaagtctcagctaaccaggccttaagtctagtggccatggtcttgtcaatgagcagccacagaaggcagggatgttagacatgtgctttcctagacttatattcgactgtctttgcagccaggaagtgctatgtagtattgtttcttttttgttttcctttaaagtcatttcccctaccctgaaaaaaatatctggagcctcttggaatccatattacagcctgaggagtcacatctgcccatcctagagtgccaggcccctggaacttggtttcatgtgaaactgtctttctgtggcggtgcgtgtgtgtggtgcagcagaggccctgctcatcttccctgtggctggtcatttggtctgtctgttacggtgacagcttggggactggtgacacatcccagcattgacgatggcctgagttgcctttgtcagtggggcagatgcaccatcagcacgagctgcgcaaggtggaagaagccttgcaggaaatgtctttccaagtaactcagcccctcctcgtggcagctgctagttgctcacttatctctccagccctccaaaaagaaaggacagtgtagctttttgaaagaggcttaaatgcattccattggcatctggttgggtgggatctggtttcaatatcaggggaaagacatgcttgacagagcctgtgtcccaggacccggttccctagcagaccctggagctgggatcctggccaagaacttgtttttgttggagagacctaagtgggaagcagagacgggattgggatcttgggaaaattctgttagtggattcagcacctccaggactgcagagggatgggccatgctaaacactggggaggacgctggaggcttggtgtgctccgaccacaaaggtctccccgcacagcctgcgcgagaggtcagcagtgcacgggggacccaggcctgttgctgggtttaaagatgttgtcagtgatagcttgggggccttttagctgatgggtatcttgggtatccccaggaacagcagaggagactcagcctgtcctggttgggaaggaaaggagagcctcaggaggttggacaccatctctggcctcagctgtatttccagtgtgtgtccacagtgccaggagctactgttgaaatctggctctggccatgagaatcttatggcctatttttctgtctagctcatgaaagtgctatgtttcatgtcttttagttcttgtggagaagaactctccccagtgtctactctagatatgtgtgtgcttttacaaaaatagttatgtagaaaggactgatgagtaaaatctggattctcagtaagatgagatttgaggaactatccatccagcctctgactcagaagccattgattcatcgcccttccccagcctacccctagcatgtgcactgagggcctactaggagggggaagacagaggtgaacattccgcccgaaggagctctgctgtgtctggtgggcggatggagatacaagcagcttacgctgtgctttgtggtgggtgcaaaggcaggaaggatgcacagcctattgtgagatccagggagaggtctttaacccagccctggatcaggggacttcctgaaggagataacactgtaggagccatagggacaaaaggcacaggagagggaaagagcttcctatacgggagcttgaggctgaagctgaggagtggaaggagatgagcccatagaggtggttggggaacagagcatgctgggcctttttttttttaagggcagtggggacccagcaagtggcttggatgcggagtgagtgagagcttgggcgttggactctatgtgtgggatgagtttgaggagcagcagcagcatccccctaactcatgcctgtgtcctccctgggcccctgaagcctcccatctgtcctgcttgtcctagttcagctcaccctaattttcctccctccaccttctcttcaggccttgtccttctaactctcataacgagatcgtgtttcctcttagcttagaaacatgctgtggtctttcccatgttaaaaaccctcctcgtttccatgctcattcctggtccccatcttcctccaccccgaagctggttaacagtctttttaaaattattgatctgggggtgcatgcacaggtttgtacatggatatattgcatagcggtgggatttgagcttccaatgtactcaccacccaaataatgaacattgtaccaatgggtaatttgtcagcccctcactccctatccctccgcccctcttttggagtccccagtgtctattatgtccctctgtatatcatacatgcataaactctcacttgtaagttaacacagtctttactccctccctttccattggccactcagccccttttatgccaccagtgacctgcacattgccaagtgcagcggatgctgtccaattctgatatgattggaactctctgcagcacttgacaatgttgaccatttcttcctgaaatcagctttctcaacctccaggacactgcattctgtttgttctcctgtgtccttcctgtccagtcctactgtcttcttgggtttctctttctagtctgcctctgaaaagcctcccccagccctcttctcatgctgtatcccatctgtttggtgaaagttgggatagaatacccctctatactgaggactcccaagccgtagttctccagataggctctccagtcaacctatgtccatagcacctggaccccatggcccagtaagtgactccatccagaaggcccagcagaccttagttctacatcttcttccacaaacccactatgccctcgtgcatttttattggatgttggtggctcagtcatctttctggaatgcccatgccccttcctcctattcattttccacatgtaattaatgagtaggtcttcatgatattaccttctaaacaccactctcacctgtctctttctttctgtccctaccaccaccctattttcttgtgagatgtaaacattcttgctcactgtttagcccacaggaatgctgtatgaactcatgagatctgagttgtattgggttgagtatcttgtgtctttaagtccagtttctggttctctgtttctctgcatgacatgtaggatgtttgctgtttgcattttttaaaatgcttgttaaatgagatatgtgggtatctagtgctttgagctcctctagaaggaatatacctttaaagtgacctgtgagttgtatattgaaagtggtgcagttgatgtctggccaaaacccatcttgtgatgaatcattttgttttactgcaagcctgctgcgtacttagcactgacatgtgatgcgctttgtcccagagcagagttctaagatggtagttagtcatggtactattttggagagagagaatttgaaagtcatttgttctacaccccacgctggaaggctgtctgaatctttggcttttcctccatgtgtttggcatatcttgtttttccttccaattacatctttgggtgtctttcaactacggtgcattttgttcattcagtactctccttttcctaattcatctcattcattcaaggtgaattaggaaatgagagtatttgaattaagttgattttgatttgctgacattcttattgaagagcaaataggacatctggtttgatgaatagctgtgttccagatcattcataatttgcattaagatgttgaattaacaagattgaattaccagtggtgaggatttctggcttggatcttctagcattttgaactctgatcagccggttttcaaactcttttattagggtctgccttagccagggcagtctttgttcttttcattctttaaagatgttaagaaagcactactattactgagtgtaatcttgctgctgaactcagcgattaatatttcacttgcattgtttcttttaacccaagtgccagccctgtgaaagcaagagagatattattcaaagtcgctcgaggacatggttaaagggagcaaagtagtttagacagggttttcacagtaggttggactggtgtttagcttttatcaaagcccttcatttctctagtccaataatgattaagtgcacccattgaccttcggccttcctctgaagtgtggcacatccgacttctctctaggaggaatgagaatacaggcctgcctcttggggtgatttggatgtctggtcctctgtgggctgctccaggaagtcatcatctaaatttgatctagacggaaggtacccgccagggctttcagcgtggcaagatgttaacaaatggcctgttggaaatctcatcgtgtttcggtttatctattaacgaaaaggtgagacccccttggagctgagctttgagtgaggctgtaggtaaatgatgtttatcaaggggtaagaaacatgatgggcaaactcactggggtcaagaagggatggagagagacgttacagtgcaatgagtacattgagcagtttcaccagtgagtgggtgatcttagtgaagaaaagaagccacatttgttggcgttgtatgtgctacattctgtcaagcttagaattctacccgaagttttcagaacaaaatcagtgagaaataattttcagtcccttggtgttctatcaaaataaaactgagcttcaaaagcaacagcttcatgatctggcaggatgggaatgtgtgcaagagaccttgcccagagaatgactgtggatcaaaggtaacaggggtttaacatcaaagaaggcatgggcacctatcacaatgattctaatgtaattagtttgtcatgtaggattaagttactgctgcctgcttacagagtgctctgctctaagacttcagtctgcacaaattaaaattaaattagtctttttagtttgcacacatggataacagaaatttaatgggaatttctcagaactttgataagcaaggggttctacagatatcctcttcatatttactatacatgatttctgagcctcttttgataagagattgattaggtttgataatgaataaaaggaaatctcttagatttgggatctctaggggttttgatggtattttcttgtctgcactagggtctgattgccccttgtatcctcactcatctgtgaaaaggaaaatcatatacagtaggaaaatgaaacatcttaatttaacagcaaattgcaaatcagtttttaatggcactaaaacgaccatttggtctacagtgtgataaatgatagagatctaactacaaaatggaaaaatggcatcaaaacccatctgcagaatctttgccgaaagggagattctttctaggatttggaagagataaatttatttcatcaaggtgcttaaacgttaacatcaaactaattgaagtgtttcagaatgctaaaacttattgaaatttttatggaatctctgctgccaatttctttgtcagaagggaccagaaaccctcactgaccccagataagatagatgtttattgctgcacattctcttcaaatgctttgtctcctcaaaaaggctgtgactgctgcagggcatggagtcctccttccatcacagctgcggctgcctcagatctagccagagaggcagagtagcacggcaggcatgcagtaagtccttgggtttcatttaaggcacggtgttccagtgactatcaaactcttgattgaaaatggagcccctgactatttctgcagaactttagccaaaagggtgaagtgtgcatggattaggaagctctctgcaaaggctgcttcactgagctttaatgagagaatttgaaggagctggctcatagcaaggggcccagtgaggccagaggtcctcatctgccaagggtccaacacctaaaaggcagagaagtctcagggacacactcagggaccctccctgctggcctgtagagtgcctcttgagtgaataagagtaagacaccctttcctcaggacactttattgtcatatgttgggcagctgttgtaatcaatatatagatccatgacagctgtgtacaagtggcacctccttagctatggttctggcaacgtcctggaccgctggccaggccaccatgtgcccactgggctgggtcaggcaaagatgcccaattgcccacgttcacatttggttttgtttacccaacagggatataaaatatgaatttttttctctttgaacttttttatttgtaaagttaattatttaagtaaatgctttggctttaatcacagttattagcataagaaactatttttctagcctagcatcccagtgggaaaagtaggattggtgaattcaaacctttcttcatttatctttggattataataaaataaactatttttaagtaagccacaaaaccagcaagtgtcagtaaaaggtgaaacagaaccaatctactaattatttcattgcaaggctttaggatcgccacaagtgccattcctgttctttctgttctactttagatgaaaacacccaagggctcgtactagaagtaactggtcttcaaacttgtggagaactggatttttattttcagcttcgggcagggtttagagtgatgaaagtaattggggtttattcattctttgggttcatgatcaatttatgcaggttttcaattgtaaaaataccaattgggtctttaaaagtcctttatatacttcagaatttggttgtaaacttggcttgaaattcaacgcaaggcaggggttcaaaagggctgagtttctgaattctccaaagaacttcatttcgggttggatttacttgtaagacgatgccagatgtagcagccttcttcagaggaagggttcagactgctttgtgtagtgcttttgaaagtgtgctttttggggattcagtttctttacatgtttacaacattattgggggcagtgatgatgcaggtctcaggtcatcacagggattcccagagttcagtggatttgagatgtggatctgtctttttggacccccagcttgggccacctggtacagttcacagcccaacccccgtggggtttcccaccctgagctcattggaagacactggccttgcttagaaattagaccaatggccgggtgtggtggtgcagacctgtagtcctggctacctgggaggctgaggcgggaggatcacttgagctatgaatgcgccactgcactccagcctgggagacagagcaagaccctgtctcaaaaaaaaaaatgaaaaagaaattagaccaatgttaacatcgaagatccagaactccagtcagacttataattttatttgtaatcaaaatttctggataggatttctagaaaatcccaacctgtggagttgtttgatacaatttgataagaggcctggactgttgtggacttctccctcaagctaataaactgttccaaaactgaagaaaggaggcttttgtttgagaaccctgatagcattccgggtgttggagcctgacactcccaactaggatagaatagcccagcagcttgctagcttgctccttctccagcctcctctcccttctcctccccacctcctctttttatgcacacattccctccttcttctttttctttattcaaccaagttaattgccaggcttgatcatggaataaatgaatgactagaaaatcatctcagtttttaaaattcaacaaaaaatttctcaacaactaagtgtccaagaagacagaatctacatacaaggacctcttagtcttgtgcaaacacaaaactgtcttgcactcgcatgctgggctgtgtcacctgtgtatttgtggatatgtgagccacctggcgctaatacatatacttgttaatagtgagatatatgcatacaaagtgcttgccaccaagcgacagtatgcctgcttactcaccctgcatctatagaaccattgagtgctactcaaaatcccaggaactgttgactttgcactgaaataaacgaataaacaaacctgtgcctaagtagagatcagttttccaacttctagcttttttattccattagaactaaattatcgagggccagatatctctaaaacctctgatggattttgtaattttttttctttacttctttagtgaagtagttccattttgttgctaaaagccgtctttgaaagagggttcaaattccacattgtgtcaagcgagcatccatgtgccaggtatagtgccagatgctttacctgcatcaggtcctatagtcctgtaaggtgggagttattatccccactccttatgcatagagaaacaagctcagaagtgtagagatggcccaaggtcacttgttcttgaccagcctccaagctctctcctctcctccacacccaatgtgacaaggaacctgctagacagagggcaagcaagtgagcatggttccagccagtcactgtctactgggcactcgctgtgtgccaggcactgggccaggctctgggagccaaaggtaaataaggcatggtctctgcttggccttcaaggtccccacctaccttgtctgactttcccctggctgttccccagttcccatcctggactcctgccaggccgtgtacctctacagatgtgtcactgtctgctggaccacaagacaaaggcatggaggcaggacatgagggatgttttgttcagggagccatggaaggttcctgcaattggaccctgcgtcagaacatgttagcaagttagcttgtggccaggtggaaaaaggcattacttgacttatgaaggaggctttgggctttatctggaggtcactgtgagcccttggaagcataaccaatatttcctcaggccttggcagccaacagccccaaataatgtcctgaaaactttaatgcctcaactctgctgactcttggaacccacttcataatggcaggacccttgcccatctcccctgccagtcatgcctctgacagttatttctgggggcccacagggacgcttcctgtttgcatccacagccctctcatgatctgggcctcctagcaaattcagagccaaatcccagtgtgtctgcaagttcagtatatgtcaggggccatgggtcagctccctggggcaacaggaaatggtgcttaaagctcaggattctggaggaacagggcaggactggggtctgcgcccccagggaccaggcccgaaccctggcatgaatgaaaactaaatattagaagctcgttgattctgtgtatatgtgtgtgtggtgggagaggagttgaaagagactgtggctgtcatgtcggccttagctggagcacccttggactaaaatctctgaacctaggggcaatatgacaaggttggtggtattgtaggtggcaggttgtgggactagaaatgggaggtagggaaactgttaggaggctattgcagaagttctaggagaaaagaacagtaatctaaacagtggggattcgaatggggataggtaaaagaatcaggaatgtcttaaccaatggaagccgattctgagggttctagttcaggtaatgaggacagaagagatgccagtgactggggaaaagggcgaagatcaggctttgcagaggggatgagttcaatttatccatattgacatctgagctttaatgcggattccagtaaatatccctaccaggcaccgaccctaagggctggagatggagatctgggcgttgtcagcacatttcaaaagactctgacctgtgcctccagccctggccccatccagcccattgctctcactgcagccagatctctctaaaagtatctttttatatacctgttgccttcctgggcaaagattttccgtgactctgactttctggagtgtgatggtctaaaccctcagccaccaatgttgggctgccctcagccagtccctgcgtttctgggtcaggactgctttggtcacaagtgacagggattccactcatactagcctaggtcacaagaggagtttgccggctgatataatcagctggggcttagggatgtgcatgctagaggtcactttccatctcttgctcctcttctctttgcttgctggtttgattctctcagcactttgttccacctggcaggaaacacgggggtgaggcaacttccatgcttcaagcctcatgatgttttcactgaagtgggatagagtatcttcttcgctcagttccatctagaaaaatcccaggaagaactctgattggaccaacttggtacaggcacccttcctgggccagctggccacggtcaggaaggtggggtcagaacgcatgcttggggtgaagatgtggctttcctggggagtggcggggttgctggatgtatataaaatacataacataccattgttgtgccttcgcatgctttagccctctcctcctagccagaaccttccagccaaggccagctctttttggcttcaaaagacaaaaggaaatgtcccttagctcaaatgtcccaaatactcttcctatccctgtccttaagttttatcctcacggtccaaccctgattctccagacatctgtcctcctcccatctccatgaagctgtttccaggacactcctggccacagtgacttttctcatttttccacagggaaaaccaaaggacaaagaggtggggtaacttgccccggctgccaagctgggagggacagggagcagatggcaggacaagcagtatgtttctagagcttggaatgtgttaaactgttctttgtgtgtcatcttccaaggagactgtgccttccttgagggcagggaccagtgcatccatcccccactggcagccagatgctggcaactgtttggtcatgacaatggatggccatggcctctgcagcctctttccaccctcagttcctaggcctggggatagagtctttcctgccgatttgcacaatttaaaatcctgtgggaactaggaagcctttcttacaggcagggatagagtaaaataattattaattataatgcagatgccacctttttcaaattctgctgtctcctacatgcgaatgagtgtccccagcctcctctgggggtttctgacagatcgcccaagtgcacccctccccgtcccgtcttcagaactcgaatctcctgtgcctccagggtccattgttgtgcctgatttgaaatgcaggctctgatgctcacgcaggagacccctagctccattcctcccatgccagaatggcttttcttccttggagagctgctgaaatgtgggtttctgcattaatcgaggttcccagcacgtctgcagacctggctctgtgcctccagaatgtgttttccaatcatctcctgggccctggctattccagcctgtcaagactggacttgctggggccacgtggggctgcagagatgtgctttccagattcagagtgatatttatgatttcttggagccagtcccagcaagctaggaccagtcccctccgtgtaaccgagcagaggtgctgggccaggcgggcagtgagtgaggattgaagaaacttgtggcaggcagcctccaggcacttggcaggctccaggctgctttccttaactgcttgcctcccaaacacctgcctccctcagcctcctgcatcagaccttgaacatgaagtctgcttattttatagaaacagattagtagcatcctgatatgagtctattatgacaattaacagtgctgactacatgccagggatgttcttagtgctttccagatgttgacccatttaatccttattaacacctcatgacatattatcatgcccattttgtagatgaggagcctgaggctctacagagttaatgtcacctgcccgaggccacacagcaggtgcgtggcacagtggcctgtggattgaggtggctcttaaacaccttgctgtaacactttttgatatcagggctattaaaatgctggggataggaaagatgtagctagactcagattttcatgaaaagcatcaattatagtaacttattaattttctaactatcctgcaatttggttggacaagagggggcctcatccaccccctacatttgccctgtttgtcactttacctacatctcatctcagaccccaatgctaatgactgggacaaacatgaacatttcgaagtggggccatgtgagtgggtaaccatgtacagtagttactaactctccttcccttcttttctttctttcctgctgaagttatacttattatttatgtacatagtaccttttcttactctccctgtgcctctaaaaggactactcaaatttcctgaagcacaagatatgagccctgcctgcatgtttgtctcattgtggtctcatcatggttgtaggtagatttggtccctagaatgaagctggcaagacctgtgggcacaatgttcttgatccaaagcccagcagcatcccttcctctggaggctgagcccacagctgctgtgtggggtgagctcaggatggctggagcctctgctgaggcagcgaaaaccaactttgtctctctgactcctcctctgctgccacctccttcccctcaagacaaaacactagaaaaacaaggaatcagatgccttctaggaatgaggttcaaactcaagggcaaatgttagagaatttgatcttggagagaaagttgtattactagataatgtgatcattattaacgtttattgcatttatgtgagcgaatgattattcacaagttgtcttgctctctctgcctggcagttgaagaaaacatatagtccagagggccagagtcctccattcacactcaatgtcaactttctaagagagcacagccgtgttactcattctgggtgccacaatgcctgctgtcccttgctgacagagggattgaggatgatttgagtccagcctgtctttaaagcacattgagttcagaagatgtctacaaatgtgagagagttggaaatgagctaggagaaaaggctatgggaactggggtggatttgaacaatgtccttgtgtcttctttattttcccaagattggaagcagttagaatgcctaggacctgacaccttattctctgtcttctcatgcatcattctgggctatgcaaataataacaatgcatgcgaatattatgtgagcgaatacagtactaatctcttctgcccttgccttagaaaggtagtctaaggaagggcaggaggattcttagggcattcgtagaataaattagaacttagatcaattagaggacacagatagccacacagaggggatgaaacctttgctgaaggcagaggctctgttgtgttaccttaaattgctagaatttgcttcatagccaagttgcaaaaactagcctatgccatgaatagaatgcttgcattccagggaaaaaatccaaattcttcccacgtggcagcagaaaagcgaaaggatacactgtcaccagtaattcaggttgtatgtgggaagcctacagaattccgccaaatgttgcagacatgcatgaccagtgctatgaagcaggaatctcatttctggtccccaagaagcacagatatcaatcacaatgttctcagaaatacagatggatacattttgccacaatttgttatatggtcacctctcactaacctgtggggtttacagtccatcaaagtacttatctaaagtggcaaaatcacagttggggagatcaagatctcataaaatacaggcagctgggaaaaataattgcattaatttatgtgacgaaggcagtagtgaaagttctagaaggtttccactcccaaaataaccactgtgtcatcatgaggtggccatatggggtgatccttttgaattgctttcttcagttgtctgggagacattgtccacatcatctgctaaggcagaggctcccagcagcaaacctggctctctgcagtgtattcgagccagccctcactggctggaaatggaaaaccttttgcaattgcttgttcactctgggtctccctctctccctcctttcctctcattttcctccctctctctttccctccttcccttttaaaatacaagtctaggcagttgtgtaaccttcaaacttttcataaaatatgcaagagcttaaaggcatagtttttgaagtctggtctttcatcccaaattatttgagagcgtcaatcttaatatcttcatttctctctctctaggtactttcctgtaataccctacctcctatagtaccctgtaggattcactctctggagtctacagggagaaagagcaataatttaggattttcctgttcttctcttaggaattaggacagaagtaacaagatagctgattttatattttttgtaaccagtttaaaagcattatctcaaaacctggaataaaagattgatgcatataaagtgctaaaaagaataataacccttgctgttatgagcagggctgagaaaggagccggggagagggagaggtggctgagtgttaggacatcagggaggaaggaaaatgcaaagataactgtggaaatagcttcttggatataagcaaataaattttcaacaaagaactgtgcaagacctgctgtatattttcagatctccacattttcagaggtcagaccaagaagtgggcccagggtgcagcacaagggatttaggctaagcctgcagactgcctgtcagggtgactcaatgggggtcaggtcacaatatgggttaggatttagttcagctgccagtgacgggaacacccacaaatcacaggcttccataaggtagatcacctagaagacctggaggctggcggtccagggctggtgtgttggccccacagtcatcagggacccagcctcaatcagaccttccacccagccaattccttggtgtggctccccactcaccgtccagaatggtgttgagtctccagccatcacatctcagctccttggtcagaactgagtcctgtggccacatctccctggaagagacagagattgaggaatgtggtcttttggctgaatggcagcatgcccagcgaaaacagggcttcagatgacttgagggcgaaagggagaatctccataactaagcaaagtcagcatcttttctcatcctagggtatttgtttactgaatacccagtgcctgatgttttcaggcattgctcaagggcagtggggaaaaagtagatggatttctgttttcatgaaacttacagtctagtgggaggcaagtcagacaataaacgaacaataaagcgtggccgagttgacaaactgcattccacactcaagctgtcttcagatgaagccgtacaatattaatgatgggagcggacggtgtcaaacatcaccgtctaaagcctgcaggcaccctggacagccagcgtccgcatctctttgatgcaaattccatccttcagacactcccaagtgagtgtctgcccagtgagaaggagggagaagtaaacaaatagtaagccagagccccatctaaaaatcagcccctgagttactcttcagctagcgctccttatgggccaatgtgcaaagaagcactagaggatgagaatctagccctaaaattccagggctttgttgttgttgttgttgttgttgttgtttggtggaaaaggatttggagctatttctttgctgacgtgcaaagtagtgtaataggccgggcatggtggctcacgcctgtaatcccagcactttgagaggccaaggtgggtggatcgcttgagcccaggagtttgagaccagcctgggcaacatggcaaaaccctatctctaaaaaaaaaattacaaaaattagccaggcatggtggcacgtgcctgttgtagtcctagctaccagggaggctgagatgggaggatcgcttgagcccaggaggttgcttgagcccaggaggccaaggctacagtgagctgagattgcaccactgtgctctagcacagtgagaccctgtctcaaaaaaaataaaataaataaacatttttaaaaagtagtgtgataagtaataattttgtggctcccatgggggtttgaaggacaagctgggaaacttgggagaaccacagggacacagcctttttctgttcatgggactttcagcaagcggttcctggtcagcatgcctggtcttgctgggaactgggcaggtttccaggttcagttcacatgttgtaagcaggcatggttctaaattaaacctggagccaccgctgtccacccagcactcactgccatggccactgtgcaacgccgcagaccactgattctcaaacatctgaggtgaaggaccagggttgtctttttaaatttgtttcactttcctatctgtcataaaaatgaaatattagaaatgtgaaataaagacagacttctgttattagattcaagagacataaaattgctctgtccatttgccctaaaagtttctaaagactgactcaattcctgaacatgagtttaccaacagcaaagaagttagggccatcgctaccagcccaaggactgtgctttgggcctcactgcccagaggcccaggatctaaggccagaagggaacagctgccctccccacgctatgtcaggacagtcctgaaggagaatgaggaagctctccgctgggaagagagcaggctgggctgctgtgtcttgctgtctgtacatctctctggcccttcctgcccagctgcttgagtagactggtaaaaggaacctcttggtggactctcctaccatagtccccatgtgcaggtgaaaattttattacatggttgcggccggagaaacgaaaggtcacagctctttgtaatcattatccaggctcccctacctgaatgcaggctgtagcataactggttggattagtgaagcaggcggtcacctccagctggcatggcctggtgtggcctgggcagggtgagctcatggttgactctgtgttgcagttctccaaggagaggcacatcatggacaggacccccgagaaactgaagaaggagctggaggaggagctgctcctgagcagcgaggacctgcgcagccatgcctggtaccacggccgcatcccccgacaggtacctggtcttgtcccttccagagcatacacggctgctctcaggcaatgtacagattgatgacccgcagggtcccactccgaggccacatgggcggaagcacctgtgtaaccaaaaacaaatactctaaaaatgacttcatttagacccttctctaagaagaccttgggaagagctgaggtcaagaacccaaagcacacatccacatgttcaggaagtgaagggacagccagcgctcctggggtctgcaagcacagcgttgtgggaggcagcagccacagagtcagtaaccggaagaactaggagggcgggctgtggcccaggtaattgaactcttggccagctgccagcagcctcagaccatttgcagcccctccttctcaaggcagtggcttagcttcgggaggagagagggcaggtggcccagatcaacaaggctgcctctgccccattgagctggcagttattcacactctccatcacttccctactggatcctgtgacccagaggtgggaaaaaaggggaattaaacccatgaccacagactcatggcccagaatatactttgtgatcgtcatttgggtgattgccataaataatgttttttcatttaatactgtaaaaattgaaaaatagagtaagtctgcagaattgaggcatagaatttcccttgggtttttattgtaaacctgatctggccaatcattaaccaaggacaacatgacaggaagtgtgtggacaggggctggggggaagggcatcatgtcgtaagttttttttcttttttttgagacagagtcttactctatcacccaggctggagtgcaatagcacaatctcagctcactgcaacctctacctcctgggttcaagcgattctcctgcctcagcctctctggtagctgggattacaggtgtccaccaccatgccctgctaacttttatatttttagtagagacggggtttcaccatgttggccaggctggtctcgaactcctgccctcaagtgatccacccacctcagcctcccaaagtgctgggattacaggcatgagtcactgtgcccaggcttttttttttttttttttttttttaatgtagtagatttcttggcacaatcaaataaataattattattctgactttgtttttttaagtttaaaattgattgtagaaaacatagatagcaaaaagaaggaaattaaactcttatccataattctcctcataattctcctggggataaccacgatgaatacttttgtgtacatacatcctcccgggctttttgaaatcaagtatgagattgtactacatatacttttttggtagcccattctactcacttactatgtcctgggaattttcacccactgtagaatattcttctgcaccagcctacattgtatgtctgtccacggtatgcatgcactacaatttactggacacatagggtgtttctaatactctgaccaatatcctttaagattgctgtgttcatacctacaattattttcacaggctcaattctaagaagtggcatttctatgtgaaaacatttttaaggcaaagatgcaattttaaagtaaccatggtagcctactattttgacctaacagaagtatactgttgatcaaatgttggaatgttccagaaaaattgtcagaattataaaaccgatactatcaccaccgtccgtctccttatcatggtcattacattcgtttactacttgcatgagtattaattttcagtgataaatcgttccaaactggataactgaacactataaccataaccgtaataacgagttattgctaacattttagccccttaaatctttgtagccattctataggtaatattatcatttgtgtttttcagatgatataagtgagccacaaggagattatgtaatttgtccagagtcatacagctgagccaggatgcaaacccaggtggtcaggctacaggaacagccaggctgcaccacattataaattctccagttgctgtaagcagcagcatcatgcttgttaactatttttgagcatccactgtgttccagtgcttacatatgttatgtatacaaatacataaccctgatagtaactgtaagatgagggaccccagcctgactttgttctaggccttctagccagtaattggtgtgtccagaatctataccccagtcctgcatgtggactcctcctccccactggccaggcctggagaggggcatcttaggagagggcccctaggatgacttctagacaccaacaaatacccttctttctcttcactccacttgttggggagggaaaatcaggcctgccaggcacacattttctcatttcttatttcctgtttcattacatcattcaggtctgtataaacgtcatgttcttgtgacacctccccaaccaccctattttactggacagccctcatcccctccccggcacttcctgcctcctttcctggtttacttcttccctgaccttacagctgacataccatagccactggttatttatcctcactaaaacagaagctccccaccaaaaacaggagctccataaggtgggctcttgtgtgccactgtcaccactgcatcccctgagcctgcagtggtgcttggcacgagtaggtggtcagtgaatagttcttgaatgaatgattggctcttctatgaatttgatctttgaaaaactaaagagctgacccaagaagagacatagtagcattgtcttctgttggcccagagaagtgggtagccataagcttttagaaggaatgtgaatttgcctttcctactcctcactcacctttttgtcccaaaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcaggtaggtcagggcctcctctgcaggactatgaggggcgccggggtgcccaaggttagttaggcaggtgaagaattcatcatggaacaaagaaataaaagatgttaataggaatgccgactgttcgcagaatagctgtcacgaggcagtgaacaattagctcccagctgagcagtgtcagcaatgaatggtacaggagctgaggaagaatttcggggggtgctgatggggataccttgtgaagggggtagacttaggctggtctgatggctgggggaaatttggatagatgctgcaaagggctgggggtgttccaggtgggaggcatagcatgggcataagtgtggggacagaaaatggtatgaagagcttgaagtgaatgtgctggtagggctggaacaaagggtctgtgcaagggacccgtagcagtgggcttagggagatagccccagccagatcatgggggccttaatgccaggtgcagggctttaagggagctgtacagactcagcatagcgaacacggtgtcctaagaatagaaatggacagtgatgtaccgggggtgaggagagagacaggaacaggaaacccagttagtgagtcatggagggccccggctgcaggagtggagtggagggagagtcaagagatgtaggagcctggcctcccaggactcttcttcacgtggtagagtcagaggagggcacattggagaccacaggagtgaccaggagggaggggactttggaggataaaacacactttttcatctgagctggaagactatgggcttgttgagtgccacagtccagcagcagttttggggtccaggaggggagttagagctgaaaacttaaattagggcttggtccacctggaaagggtggttcacttggtgagaacagatgagatttctaagataggagatgcagagaacatggggtctgtagtctgaatctcagggaatgggggaagagaaagattcagggcacttggtggaaaatcaaggcttcaaaacctcactgatcctaagcacccagctgtcaaatgtcagcgacgttggcctgcatttgtatagggcccgtctttcacagagctcagagtctttgtgcatattatctaaaagcactgggaaaggaaaggagggaaaaggcaggcatcggggacatagatccagtccagcccctcagtcacacagcagccctgacccggctcccagcttctaatcttatgcacgtaaaccaacatattttattctactcactggtttttttttttggcgggggggtccatgaggaaatgtcataaactgtcatttctatactgcaaaacttagggaggaaaatacaggactctgtgtggaatgtaaatgacagctgtgtgctgcctggaggctccggcacatgctagtcagcatctggctggggacccagtagccaggcacaaatgccggctccacattgggcaacttttcaaccatgggcaagcgacttgaccttcctgggcctcaccttcttcatctagaaagatggagcttgtgaggtgtacatgatttaatatatgcaaagtgctcagaacagtgcaggcacagaggaggtgctagggaagtgctcatgataattattatctggaggagagtagaatgtcagactcagacccagcacagtggctcacagctgtaatcccagcactttgggaggctaaggtgggcagattgcctgagcttcagagttcaagaccagcttgggcaacatggcacaaccctgtctctacaaaaaatatgaaaattaatataaggagctcaaacaactctataggaaaaactctaataatctgatttttaaaatgggcaaaagatttgctcttttgagaaatgagtatttctcaaaagaagacatacaaatgggctgggcatggtggctcacgcctgtaatcccaacaatttgggaggccgaggcaggtggattacctgagttcaggagttcaagaccaacctggccaacatggcaaaaccccatctctactaaaaatgcaaaaattaaccaggtgtggtggtgcacgcctgtagtcccagctactagggaggctaaggcaggagaattgcttgaacccaggaggcagtgagccgagatcatgccactgcagtggcaaacaggcatatgaaaaggtgttcaacatgattggtcatcagagaaatgcaaatcaaaactataatggatatcaccttaccccagttaaaaaggcctatatccaaaagacaggtaataacaaatgctggtgaggattgtggggaaaagggaaccctcctacactgttgaggggaatgtaaattagtacaaccactatggagaacagtttcgaggttcctcagaaaactaaaaattgagctactatatgatccagcaatcccactgctgggtatatacccagaagagtggaaatcagtatatcaaagagatacctgcaccaatgtttgttgcagcactgtttacaatagctaagatttggaagcagcctaagtgtccatcaacagctgaatagataagggaaatgtgtatatacacagtggagtactattcagccataaaaacaatgagatcctgttatttgcaaccacgtggatggaattggagatcattatgttaagtgaaataagccagacacagaaagacaaatgttctcacttatttgtgggatcaaaaagtcaaaacaactgaattcttggacacagagagtagaaggatggttagcagagcctgggaagggtagtagtgggtggggagtaggggatgggagggaggtggggatggttaatgggtacaaaaaatttagaaagaatgaataagacttatttgataacacaatagggtgactgtagtcaaaacaattatatattttaaaataaagagtgtaattggactgtttgtaactcaaaggataaatgctagagggcatggataccccattctccatgatacacttatttcacattgcatgcctgtatcaaaacatctcatgtaccccataaatatatacacctactatgtatgcacaaaattttttaaatataaaaattagctgggcatggtggtgtgtgcctgtggtcccagctactcgagaggctgaggtgggaggattgcttgagcctgggaggttgaagctgcagtgagccatgaccatgccacttcactccagcctgggcaacagagcgagagcctgtctcaaaacaaacaaaaaaactcagggcaattgcaaggagggaggcaagacctgatatttagaaatcctccttttcatagtaataggattggacttgagatgccttacagtgttagaaggggtaccttttcttctgtttcctttgggaaggataggctgctgaatggtcgaagcagggaattaatgtcatgcacagagtgggagtgtattcggcaggataacagaaccactgctgcagggaaggcctcctagttggccctgaatgatcctggtttaaaaactttttaagataagaaatgaaaaaaagactaagtctcttaagtcaacaagtcaggcctaatagagccacttttctgtttgccctttggaatgcagatcctcctagaacttgtcaccactttgtacacgcagcacgcccagaaatgtttaagtgggaggaggggaaaagatggctcatggcctgctgccctgccccagtgtccttcagtggctcccttatgcagctctggccaggtgccacctgccctgacgtcgggcctgctagttggctggctggtggcctgccctgggcgaaggtgtgtgctcacaggcaggttgcattccacaccctgccgttctggcccctggagtccagccgcagtggtcactgcttaaatatcacttctcgggagatatttccttttgtaatttgccctcggtcttgtcttatcttcgaaaggttgctggaatttctctgttccttggagtttgggggttttttgatttgttttttctttggtgcttgtaaaggtaggaaagaacttcgtgatttctgtaacataacaatgttttatgcttatgggaaggccaattaaagttcataacaacttggctggtgcagtgcctctgtctctagctagggagattctggtgcttggtgctggagaaattcccagtctgaattggaaagggacagaaggaataacagcgagtgtgttgaaagttaccttccaccttttccttgtgtggttacacagtgtgcctcccaactgctgcttggtgaccgtgccggtgccttttcccagctcagcaggaggaggctgtgtgggggtcccccgagagcagccaggaggttggggatggcagcctccccaggcagtcctgcaggttatttgggggatgctgagatttgcaccaaaatggaagtttccccacagcttccttcctaactgcaacactatggagcatgtggaaaatgcatgttagttaggcaagccattccctctgggcctgtaagtaattttaggctctgttaaaagtacacattccagttcatcagattttcccgggagtatcgtaaaacttttaccctactctgttcaacaggatggaacagcccagaggaggcatcctaggactcagctgctgcattggtcatggggacagggggatggagtacacaacacagtcatatattaatcgtcccatcagtaatttgtttctccagcggtcattcctttacttttagggtatgctgtagcactctcgttctgagcagttttctttttttttgtttttgtttaagttcccatggcattgcctaaaagttttattttacacgttagtaacacatttccatcctatgtgtcttttacttcagaaacaaagaaaagagtggtagccagcccgcctgcctggatcacatgcaggacagaagagccttgtccctcaaagcccaccagtcagagagctacctgccgattggtatgtttcggggaattttcagggagaacgtcagtgttaccctggtttccttcaggctgttaccctgccccatctagttgtctcattcgaaaacgacacaaggcctcaggcctgcagcctggaggggaatgggtttgcagaattatatccggcggcgaagcactgagctagacaccgtatgccagcttttaggcctcgtagcaagccttcagggtaggcatgattattgccatttcacagctgaggaaactgaggcacagataggttaagtaacttgtccagaatcacccagcatttgaacccaggttttctgattcaagcccatttaaaaactggtagtcttcatgacaaatgagcctactcccttttcccgggtgggcgggtggatcctggggcttttggcagaacagctgtccaggccaactccccttcctctccattctgcttccaaggctggaagagtgataaggtatggggtatggggagacctactaagcagttacattagtaagacagggggttgttttcattattttcataactgactttccctgggaccacaaagggattttcctaatgcccctgcgtaaactacctccatgtaggttaccccagtgtctcttttcccttccctgtctccagctctcctttggaagctggctgggatccaccctttgagagtggcattttaggtggctaacgacttctgtttcttagggcaagattacattattcatgccctcctcgctcatatattttatcattctgactgtcccagccttctatgaccatacaacatttgtagcccaggtgtcagcagtccccgggatttctatttgcacccaggagtgtgggatggggcaagcccagcccagccctcacgatgctgtagactccctgagattgggcgtgggacagtcacactgaattttcttttggaaatgaaaatgaaaattgaagcccaagggcatgaatggagggctggggagctgccactctggttttgtttgttttatattctccacacagatgagctttctctgaccttttcttatcccccacaggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggtaagcgctgggggtcctggtgctcctctggcttttcaaggtttggtaagagctaggggtcccggtgctcctctggcttttgtaggtttggaaggaggggatccatctggcctcactctgcctcacccattaaatgctttgcccataggaaagtctgaagataacaccagcatgggaatttatttaaggggtgggaaccacaagctgggacaacctttgcccaagcaggaagcttataaaattcatctcagacagagggatggcaggctgctgccgggggtgggggccgccctcttctcccacccacccctgctggcatcagcagctgcaacagaatcctcctcacacctggtgcttatttataaactacccccttgcctcagctccatcagaattggtaaagccaaagctacaggagagtagattgtagatgaaaatgtagtttctggagtagcagaccttggttatttttattacattatacttatgcattacatatttattttattactaaaatgatctttagtataaacatctttaaagctaccttgatttttaaaataatccttcctcaatttagaaaaattctaaaatggcggagcatgttggctcaagcctgtaatcccagcacttggggaggcctaggcggtggatcacctgaggtcaggagttcaagaccagcctgaggcatggagaaaccccgtctctactaaaaatacaaaattagctgggcttgatggtacacgcctgtaatcccagctactctggaagctgaggcaggagaattgcttgaacctgggaggcggaggttgtggtgagctgagattgcaccatcacactccagcgtggacaacaagagcacaactctgtctcaaaaaaaaaaaaaaaattctaaaatacagattaaaagataaaaccacacaaatccagtttcctggagatcaccattgtcagcatttggtttacgcaaaaacattattattttctctgtaaatggatacatgtaaataattgcatgtgtaatatctgtttgccacaggtctgtacacactattccaaaccctgaacctttcattgacaaacatgactgtctttccatgtgattaaatatttacattgtcacctttttttttttttctgagacagggtctcactctgtcacccaggctggaatgcagaggtgcgttcacagctcatggcagcctttgcctcccaggctcaagtgatcctcccacctcagcctcctgagtagctgggaccacaggcgcatgccaccacacctggctaactctttgtattttttgtagagatagggttttgccatgttgctcaggctggtcttgaactcctgagctcaagtgatctgcctgccttggcctctcaaagtgctgggatcacaggtgtgagtcaccgcacccggcccatcaccatttttttgtaggaaacgtttattttagatgtaagtgacttttgttcataggtggtcccaaagcaacctcatccttaagagagattaagtcactttttcagatccgtcgggattcgttttaggaccttcagtggctagcaaaatccacagaagcttgcattccttatataaaatggaatagtatttgcatataacctatgcaatcctcctgtagattttaaatcatctctagattacttacaacacctaatacaacgtatatgctttgtaaatagctattatactgcattatttagggaataatggcaaggaaaaaagtctacatgtttcataccaatgcagctttttttttttttttcctgaatatttttgatccttggttggttgaatctactgttgcagaagccacggataaggagggctgactgtattctagacaccagatgttgtctcaggcgatggtgggctcggtccatcttttcaatataaagaggctggttcctgggcatttgaagcccttttttatttgtagctcagtgaagtcaattagcttcagacgtcagggcttatttaggaactgggttttccttcctatgtgttgaatcatggcaagaagtccagtctcagaacactcctgcagggagtgccaaagttgatggagggctccccaaaacaggcttgaggaactttaggcagctgctgaccatcctggagtaaacaagacccttgctgacaacagaacttgagggatgactcagaaaccagagtaactcattgcccaggcctgggaggtggggctgagggtggacttctgctgagcaggccttgagaagagagccagggctgcactggaagaacaagggcctgctgtacttttggccagatggcctcgggcagtgctcacaggtagtcacgcaatttgcgaagttatccggacctcactttaaagcgagcttaacctgtttgggaggtaggaggattgaggatttctgttctagtcagtcaggcacattgggccctgaatctgagagcagaaccatgtcagtgggccaggagggagactctggcctggtatgaacctgcgtgggttctccatagaggaagctcctcgtagaaacaggcctgggtttacagagcagcccgattcccaggggaatgaatccttcctgtggccctgggcagggcttaatgatcctctaggtggaggagagatgcctgcctgcccgcccttggcaggaggcctgggacctgcccactacctttggtagccatgaaactagaccccaaggatgttcccaactgaagaatgcagtctccctggcttgctgtggtgcattttgtcctcctagtggggcctcactctcatgtctgcctgcaggcacccctggacaaggggctggatggggtccccaggcagcgagcaggagctagcctggactctgcccacccagccccagggcagggctatgttgaaacttccttcttccctgtctctggagtctaccaccatttccatgttatcttcctggaaccactgacttccaagcgggcacaatcagcatctctaagagggaaatacaacaagacctgttgtttcctatcccaagtgcagtggcagcccagacagggccacccagaagctgagagcaggctctggctagcatctgggccccgcgtgcttgttcccagccatgtgggcagatgcccagataggccatcaggacagtgggtggtcctaagagccctccaggctccctgtcctgctgtgtccatgcccccaccccccaagggcctagttaggagccactgagcccctcccaccgtgcgcaaggtctttgcctatagctagaagtgaggaccagtagtgaagcacttggcccgactgagcctgaatcctgcctctgccacatcagctgaacagcctccccttctgtgcctgtctgtaaggaatacagctacccaggtggtcagcgaggactaaatgagataataatatattaaaagcccagggcaccttgcctagcccacagtgagcactaagtgtttatccgtgttatatattcagctttgactgagcgcctactgtgccagggcagcttgtggtctctgctcttggagcacctgctatcaggtgggggtgggctggggagggacagtgatgcaggaacttgggccacaacccaggtgggaaacgccctgcaggggaaggcacaggagctgtggggcctctgggcagggccttgaacagggagttgggtgtggagatggggcagagatgtccaagatgagtttggaaggctgcatctttggcccgatgaacaccaaaagcatcttgcagacggcaggcaacgcacatgcacagacacttagttgtcaaaacccatggagagaggggttggtttacagcagattcattctgtgtgggtggaagaagatggggttaggggtggggtgtgggagggcttcatacgtcttttctaagtctctacttctgggctcataccagtttcttgccttcaaggcactttacagttgagttgggtgcagatctgatcctctgtgccaaggggaacagaaccagtgagtggagccaggcaatctcatggcattttagaaaggcccttgcggctgggaggagggctgggccgggaccccatcagggctctcctgggtccgtgcagcagcctccaaggcagtggaagaaggagcagagggtggagtccagagatgcagcagagcagaccagctaagatttggagggcagaaggaagcctcatcgggggtgcttctgccaccctgccctgtggagtcggctcacagtaaatgctctagacatgtttgtccttcctttgtgtcagtgagctgcataaccttgggcatttgtcagggaacctaatgcaggccctgcggtgtgagcttgggatcccctcagccctcaggcaagcaggcgtggctccagggaagtgacccaggcatggcatatatgtgccgacgaaatgcagactggagagcaggggccgccgcccatctgccaggttttccagagcaaacctgaatcaatcacaggccttttaatctcgccacccagagcgtgggggacacccctcagaagtacagggtttgggacctctgacagagggcagctgtctaaatatgcgaggaagcgtgcatggcgtgcgtctgggctgccttgccaaggtcaagttgtaaatctctttcccaagatctggccagaattcttcccctttccacatggctgatgattcaaaacttgtattttcaggtagcttttaggggttctaaagttatctgaatcctttgcaaagtccttgagaaaggtgaacttagcagttatgttagaaaaggggaaactgaggcccagagagcacaggtaggagcacagtaggaattctgcatcctgtcgtggcgtctaccactagagagctcatccacagggtcatcccctcagggttgacagtagttcagccacagaagttacagggtagggttagtaataccacctaaacatccagatgtgttttgatagcctggggtaattaaggttgaggacaagtgtaccagatcaaggagaggaaccgtcccatgcctgccgtgtgttcaggtggctagacttgttgttgcatctgttagttccactcttagtacatcattgtgctgtgaggtgtcattagccgccgtttaatttttcttttgtttttagagacagtgtcttgctctcaccccggcttaagtacagtgacatgatcatagctgactgcaacctcaaactcctgtactcaagtgatcctcctgtcttagtgtcccaagaagctaggactgcaggcacacaccaccatgcctggctaatttttaatttttttgtaaagatggggtctcgctatgttgctcagctggtctcaaactcctgtcctcaagcagtccccccaccttggcctcccaaagcactgggattagaggcataagccaccttgcctggcctattggccccattttagagacacactggctcagttgtaacacttctccatgacattgtaataactaatacctgattctaataaactgagattacatactagaattgagatgggttgagagctgtctgggacaaagattttaagaaaagcctctcaggagaaagaagagtgtttgagagctcaggtttccaatcactgtacacatttttaatagtttccagacgtatagagcatttactgagcccaggagaagcgtaattaagggtaatagcagccagctgtggctgttaagtgagaacatgaatggcaaagcccacagcggagaggctcttggatgagattctgctcttccactgcaggggatcggtcagctccgaacacatgcagccttgctgttggcagcaaaacgtcgcagcaggatccggccggtgtcagacaaaagctcagagaactaaactgttctctggctgggcagaaacacttaacaaatctgtagatctgcagagcagtgtcagcatctcccaccagtctttcttttccccctaagttttatactgtactatgtgtatttaaacaccctaaacatcatataagaacagcattgtcagcagctgcttataaagaaatgtaactcataaagtgtccacgccatcgtagttcagtgtgtttcttctcatatgctgaattcatgatcaggcaagcccacttcctgatccagtgtatttcaactttggctcttgacaggttgctaggatacttggagtctctgaagagatgaggaggaacatgggggtgagctcaggcctggaactcattaccttgcctcacggacaccagctgcgcctggacataattgaaaggtgagcagtgccgtcctctgcacttccgaccctcccagctccttccaggcatcagagcagcaggttttagaacaaagagaggcgcagcaccagcctagccctggggtaacagtacttcagggcgcatggcctacagcgactcttcccagaagcctgagcctgagaattcctggagttgcacacaaagacagcacaactcaggaacaaagaatgtgttcccgtccctgctcctggaggagtggatggagagaatagatggcctgaagccagtgactcaattggcctgtgtgagcaggagtcacagatcctgcagcctggggcagagctggggccccagcacctggagtctcctgggtctcctgcccagcaagctgcccctttgtctctttgggggttaagattgcttgaggaattaggaggagtttgtgggaaaggctgggaagagcagagtctagacagtgttttctttgaggggtggacaaatagggtcagaggttaggggatgacggcactggtccggggcctccgaggcatccctcccctcttctcatgaaaagccagggccctgggcatccattgaaatggaatgtttaggaattagaaagacaccaacaatgaggtatgtttttaagaaaagaagctctagactagatatccatattaccacaaagccagcctttttgacacattttttaaaagttgatttgggcaagactatcttgttaagttttctgtctgtccagcccatgtcctagttgccattactgactgcccatggctttccatgaagttccaggtcacagtgctgtccaggaaagctttctgtggtaacagacgcattctgcactggctattacagtagccaccagccacatgtcactctcgggcacctgaaatgtgactgatgtgattgaaggatgactttttataattagaatttgctgttttcacggtaaaaagccacttctcgggggatggatgtcgctgctttagagtttcctcggctgtacagcagataaaatgactcctatgctgctgctgttttggcctcgcagccgtggatacatcccatagaaaatacccagaatgctgaattgcagccatgtgggaggatggaggtgaagaagtgggccatgcggattttgttcgggaatacccattgcttaagcctctggggaattctaggtcccgcttctgaatttccctgctcttcctgatgagacttttctaggttccagcctctctccgggtgtcccctttttccctcctgccctaggggcctgacctcccggctccactagcttcgttctatcagcagaggtgagctgtgccaccacactttgccatttctcccatgagacatttcagcctgaaaggccgcaggttccaggcctcatgaatctgagccctattttcttagtatcattcagtgtgctgggacaggctgagggtgacaggtttggggcttctctcttggctgttttctgactttccacttcatttgtcttttctcctgactgcctcttggctggggtcttgctccttagcttgtttcttgtgacctgtgggatcttctttttagagcctggggagtagttttattaattacaatgtgtttattaaataaaggccaaggttatagaggtcctgatgtgtcacatgatatcaccttcttgcatttgagaatcaaatacaaaaccaccctttatttttaatttaccacctcacccattccaggcatactgctctggaagtgtccttcatgtgacatctgagtgcctcctcttgccaaccacaggagcttttgctgcagatttgccagcctgagttgtttttcccatagtcggtgtatccaggaggtttcaggcaaatattggttgagtgaatggatataaccattcagttaaccatttatacaacactagagggccattaaaacacagggagagaaaacactgaataaagaatcaattgaatgcagcatgggaagtgagtttatagttaaaagcaacatctaaaatgttctgtcaatgttaacattttgcaaatggataagaaaactcttccaaaaatgtatcagataacagctgggcgtggtggctcatgcctgtaatcccagcactttgggaggccaaggcaggtggatcacttgagcccaggaattcgagaccagctgggcaacatggcaaaaccctgtttctacaaaaaaacacgaaaattagctgggcatggtggcatatgcctgtggtcccagctacgtgggaggctgaggcaggaggatcctttgagccagggaggtcaaggctgcagtgagccatgatcacaccactgcactccagcctgggcaacagagcaaaaccctgtctcaaaaaaaaaaaaataataataataataataataataaaaatatattttaggtctatgtttggattcattaattgagaaagacaaatcaggagaaggagataaatggagaaaagaggaaagagatggagacaaagagggaaaatggaccaagatacacagggagagacatgtacagagacaactctagtaacaactgctatttattaggtgcccgccagtgccaggcactttaattattattattatttttgttttgagatagtctctctagttacccaggctggagtgcagtggcgcaatctgctcactacaacctctgcctcctgggttcaagcgattctcattcctcagccactcgagtagctgggactacaggcatgtgccaccatgcctggctcatttttgtatttttagtagagatggggtttagcccatgttgcccaggctggtctcaaactcctgggctcaagcattgtgcctgcctcagcctcccaaagtgctgggattacaggcctgagacctggctcactttaattattttcacacctatacacagtctctccttctcacaacccttgctcccattttacagatgaagaacctgaggagtggagcagttaggtaccagcccaagcttacactgcaagtgagccccatacatgcatatatacgcaaacacacttggaggcagagcccattacctatttaacaaacattagagaaatgagtgatgctaagcactcaatgaatccctgctgccctttgctcagggagagcaagagaccgaccaacacacctgggcacggagagagcacagcgtggagtaacatcgtaagctccgaacgttcaggacagagtggccctggagttcaaatgcatgctgtattttagtaactacagctataaactggggcttcgcctccagcacttgtaccacagcctggaagaaactgaggcaattctggtctaaagcagttaactcctgggtcctgatttacagtgggaaggaaagggggtcacagtctatgctttctgccgcagactgaccccattcatattgatcctgttgtcatgcggagaaaagatcaccctgcttcctgttttgggtctctgaggttgacccatgtagtttaggatgagaaaagggaggtttgttggggaaaatgagatttcgattttattagggtctggccttacaggcacattccagcccatcaactattcaatctttatcctcctccccattcatttcctggcctctggagtggggctggagaacaccattcttacctcctctttcctgcctttgttctgatggccatgttattgtcttggatcaagcatgtcctcacatttttctgtcccttccatccccaaatccagggggctcagtggaggtggccctgggattccccgaggagagattctcaggcgttttgggggacctgctgtctccatggacctctcatggtacagggtactaggagccacatgcacttctgagcacctttgccccaggagctccctctttgtgcccccaggtccagggttgaatgtggccctgtccggggacatcttgctttctgactgaaagtgcaccctctgtggcctactttggccctccacagtcagcctgctaaggggcgttctctctgttgagattggccgtctaaactgtgctgccggcacattttagagcaaaaggagcaaatggcacaaaaacagccctgctcttggctgatttggtttagttttctcctagtcccattggccctgaacctgaccgctgatctcctggctttcagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacaggtaaatttccaattactttatgtgtacttaatgttctgtaaagagatctgcatgccatgtttggcaaatcagactattttagtcaatctcaaaagtaaattgaatcttagtgaaagctgcttcatttaggggacagtgtcctaagtatttggggtctacttttttttttcttttttgagacagaatctcactctgccacctaggctagcagtggcacaatctcagctcactgcaacctccacctcccaggcttaagtgattctcatgcctcagcctcaagtagctgggactataggcaggcaccaccacacccagctaatttttgtatttttagtagggacagggtttcaccaggttggcctggaactcctgacttcacatgatctgcccgcctcagcctcccgaagtgctggaattacaggcatgagccactgtacctggactggggtctatttttttttttttttaaacgaagtctcgctctgttgtccaggctgcagtacaatggtgtgatcttggctcattgcaacctctgtctcctgggttcaagcgattctcctgcctcagcctcctgagtagctgggataacaggcgtgggccaccacacctggctaatttttgtatttttagtagagacggggttttgccatgttggccaggctgatctcgaactcctgacctcaggtgatctgcccacctcggcctcccaaagtgctgggattacaggcatgaagcaccacgcccagcctctggggtctattttttaaggcagtaaatatttgctgacagtccatgctttctctttgatgtacagtagcaagtgtcatcctcatgaacagtagtgattcaaggagaaccaattaggatgagacatctggctaaagtgtgttgtataagaaggagactgcctccatctgggtcaccaggtgtgggcagtctaggataatcactgggaaatgagacatttgcagagcttctatcagaatccttagaatagtttatctcaggtcacctaaaacagactgtcctattaaaaagttcggattcctggtccatctgccatagaactccctaattaccgtttctgaaactgggcatttgaatttatctgctgtgccagggattttttaggatgagtgtcaaacctgaatatctgtatctgaagtcaagcaggcctcatagaggaaagtcaggctgccatctttattgctgaggatcagcactcccacttctgttctcccaagccctggatgcttggaggacttgagtatgagtttacagtccagccagcaaaactttctagtaacaccaaaaccgctggtcactcggcttggctgtttcatagccacaggttagctctgaaatcctgccaggtactcactgaaattccatcattgccactgaaaaacagccacaatcacatgtcccgcaagtcagatcatggcaggaatagaatttacttgcattaaagcaaggtcaccttaaaaataaaaagttgaaaacttagtgccttcatcgggaatttgtggggggtcaattctaattatatttcagaagctttcagaattcttcaggtagactggtattttgtaggattggtatttgaaataagcagcccataagttctgccagattttcatgatatactgatttctactataacgggttatcattttttcattcaggtattttaatgtgcattatgtttatttcctgtcacctaaaactgcctagaattttgacagcagagccaacaggccaggctgtgggtaaagccttccagcccagagcttcccctgagactggtaaaggagatgttttgtgggatcacatggttgccatccatgacatcaaactcagcagttagggacttgtccccaaccacattaccatgctttgtaggcggctccctgccttctaacagtgtcagcctttcccttctggagcacatcagcagtgacaggacacagtcctccagagcatacagtggcctaggaggaagtggcatacccagagaaagcccaaaaggagggtcacattactttgcgtgtcaccatccaacccagcccttacactatagccacatctgccaccttctcttctcagcttctagtatcaagagaatatgtccaggagatgggcctagcccagacccagaggcttctttcagaaaggcaatgcctcagggagtgggtgtagggagcaggggtctacagaaggaagggcagcatggtgggcagcaggaggaaggcggccacagccttttcttcacagcacgtctgctggtgctgagcctactcaccttccttttggatacaggagctcttcaaggccaagtaaatgaatctcagctctaccacataccagctgggaagccttgggcagttacctaatctcttctgttttctcatctgtaaaagccaaaatacctgtcttaaagggcattgtgaagattaaatgaaattcttcaaatatttgacacaaacttggctcttattccccaaatactaatgcccttccttgtttcatgtagaaaacttaacatagccttgccggttttagggtatgagttggggaccatttatcttaggacagtcagagtcagtggtgtatgctgctgctgactaaattgttccaaaagaaaattgaggccctgagttacctgcagaagaaaagaaatgagtagcaggcatggtgtctcatgtttgttgtcccagctactcagaaggctgaggtgggaagatcactgagcctgggaggttgaggctacagtgagctgtgatcgcaccactgcaccccagcctgggcaacagagtgagaccccatctcaaagaagaaaagtcataaaactctttaagagacgagttaaactatagctatccatacagtggactattatgcagaaatttaacaaaataaggctgttctatatgtacttatactgaatgcttttgaggcaaggaatgggtgtggtttatgtagtatataatatgcatgtatttatttttaaaaggggtgtgcgtatagacaggaattttggggaggtcaattccagttttatttcaagagctttcaaaattcttcaggtacactggaattttctaggatcagtatttaaaataagcaacatcagttctgccgtattttcatgataatgctgatttctattataacaagagtgtaatttttcattcaggtgttttactttgcatcatgtttatttcctctcatccaatactgccttgaattttgacagtggactggccagcaggccaggctgtatgtgaaacacacacgcacaagcagttgaagagagttgccatctctgggatgcgctaacagcaatgcagatggggcggatgggggattattttttctttctaccctgctttcagacactttgacatttttaccatgtgtatctatcacctgttccaaaatttaagcaaaagggtaattttattttatttatttttttttttttgagacagggtctcactctgtcaaccaggctggagtgcagtggcatgatcttggctcattgcaacctccgcctcccaggttcaagcaattctcccgcctcaacctcccgagtagctgggattacaggcacacgccaccacgcctggctaatttttgtatttgagtagagacagggtttcaccatactggccagactggtcttgaactcctgacctcaagtgatccacccgcctcagcctcccaaagtgctggcattacaggcgtgagctaccacgcccagccactaaaaggtaattttaaaaagaaccttttccaaaacaccacctttcttccagatcacaaggttagaaaagacgtggactgctctgcggcaccagtacacccaaactgccattctctatgagaaacagctgaagcccttcagcaaactcctgcatgaaggcagaggtgagcacgtgggcagagcaagcatggggctaccccgctggggagtggagtacaagtacacagggcatgttatgaggccctgagttatctgcagcactgtggatggctcatcagggcttttatcagatgacagcgttgcttgtagaaggctgcagttgctgtaacaagacaagggctatgagtcacctcattctgtgcttaactttggaaaacatgtgatatggaaaactctactccttattcttcagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggtaagagatgggttttgtaagctgttctctaacactgtatcgtaattgaaatgaaggaatggaagagcatggctgacttcacttagaaaaagaccaaaaaggaaggattaaagaatggaattccatttcctatatggctagttattacttcctcttaattccagaatgactcaagtgccctgtttctccttgtgtgttctgttgttcaatggtatagaataaacagagagaaggggtcaagaaagaactggggccgggcgtggtggttcaagcctgtaatcccagcactctgggaggctgaggcaggtagatcacttgaagtcaggagttcaagaccagcttggccaacatgatgaaaccctgtctctaatagaaatacaaaaattagctgggcgtgatggtgtgtgcctgtgatcccagctactcaggaggctgaggcaggagaatcacttgaacccgggaggcggaggttgcagtgagccgagatcgcaccactgcactccagcctgggcgctgggcaacagaacaagaattggccaacttgcctaccacttattaatagtacctctaataggtgagattagaaaaggtgatgtgccaagatgaggaggtggagttttatccagacctcatttatctgcattcctgttccttcccagtcacactgggaagtgagctcccctgctcttagcatcagacacatcctggaaagtgtggggcagtgttgcgtaaacggatttttcttacaagtgctatggtgacagaaagcagcctcctcagtcagcacggccggcatttatcacacatgtggcatgcgcgcggcaccgtgctaactggatgtcctgaggaatttaagcaggtacgataaatgcagtgtatactgtgggagcacttaggggaagggactgatttggtcagagatgttaggaaagaggaagcacctggtgacagcttcccagaaaacactgcattgattgttaaaggacaaaagcagttaccagcaagcagggctgggaattccactcagatggcacaacccaagcaaaggcgctgagagaccttggggaaaactgggatccacaagtacttgggtttagatttgtgcaaagtatgacctaaggaatggccaactaggctacagagggaggtgcagctgggaagcccttccacataagaccgtggctgaagaagagccagtgaagggtttaatcatgggagggtgtcacatggtcagatttctgttttaaagtaaattactctggtgtctgtgtggaggaaggctggaaggctgaaggtttgctggcagaaagaccattcaggaaggagggctttgccaaggcagtcatcaaggatgactattttccattactatataattttttaaattcttcaagggctcacagtttgattcacaaagttaagaactatgtgggggcaggagactccatttatttaattctaaaagggagctgcctcagaaccagatgtgggacttagtcgtttgcaccatctgctgtgggtataagcaccgcatacctgtttcattttcttcctcaaaaagttctccaggattggctgtatgttactcaaacaataaaagcacacaagtcaacaagtatcagagtgcctacttagacaaagccaatgaatacattaccatggatgttgcataagccaatacatcagggtgggttttgagaaaagtgtgccataagctgctctacagctttaaatcactttaaaggtcactgatggaatttttcagtcgatcctaatatagatttcacagcaagtacccattgctgtaagtgacagtgaacccaggaaaggcagagatctgctcaccagcatagaccagaccacgtgaatgggaaggggctcaaagcatgtatgaataggagtcaccatctgggggccgggcgcagtggctcatgcctgtattcccagcactttcggaggctgaggtaggcagatcacctgaggtcaggacttagaggccagcctggacaacatggcaaaaccccgtctctgttaaaaatacaaaaattagccggggaattttgagagggaatacttgagaggctgaggcaggagtatcaagcgattctccttgattcttaatttcattgagccgagattgtgccactgcactccagcctggtctcaaaaaaaaaaaaagtcaccatctggcctttggttggttatccaccaaggatattctggcatcatcaggaagaaaatattcctgttgtcctttctacaaccaagatcctgtgatctagatggcaggtatatttaatggcagaacaaactatcccagcaataataaaggatgagaaccacatgactctttggctagaggcttctctctctttaaaagagttgcctgaacatctttggccttaagcagaccacatcctctcttagatggaatagagttaagaaataggcccacacatatggctgacagttgattttcaacaaaggtgccaaaataattcactggataaagtataatcctgcaaatggtatctgctattggatatccatatgcaaaaaagtgaatctcgatccttacctcataccatacacaataatccaaaatggatcatagacccaaaatgtaagagctaaagtataaccttctgtaagaaaacataggagaaattctttgtgcccttaagctaagtaaagacttcttggccaggcacggtggctcacgcctgtaatcccagcattttgggaggctgaggcaggcggatcacctgaggtcgggagttcaagaccagcctgaccaacgtggagaaaccccgtctctactaaaaatacaaaattagccgggcgtggtggcgcatgcctgtaatctcagctactcgggaggctgaggcaggagaattgcttgaacccaggaggcagaggttgcaccattgcacttcagcctgggcaacaaaagcaaaactccatctcaaaaaaaaaaaaaaaaaaaaagaaagaaagaaattcttaggacacaaaaagcatgaaccacagcagaaaacattgagtacacatatatctgataaaggacttacatctaggctatacaaagaactcttacaactcagtgagaagataaaatttaaatagacaaaaatttgaatagacactacatcagagaaggcatacaaatgacaactacatgaaaagatgttcaaagcattcatcattagggaaatgtaaatttaaaccaaccacaatgagataccaccacactatctagaatggctacaactaaaaagaatgataggccaggcacggtggctaatgtctgtaatcccagcactttgggaggtcgaggcgggtggatcacctgaggtcaaaagttcgagaccagcctggccaacatggcaaaaccccgtctctactgaaaatacaaaaaattagccaggcgtggtagcacacacctgtagtcccagctacttgggaggctgaggcaggagaattgcttgaacccgagaggtagaggttgtggtgagccaggatcgtgccactgcactccagcctgggcaacacagcgagactccttctcaaaaaaataaaaataaaaaatgataaaactaagggttggcagcatgtggaaaaactggagtcttcatatgttactgctgtgaatataaaatgatacagccattttggaatagagtttaatagtttctttaaaagtaaacatatactgattgtatgacccaataattcctttcctagagaaatgaaaacacatgtccacacaagatttgtacacaagtgttcacaaccacttactcatagcagccagaagcaatccaaatgtcatcaattggtgaatggataaacaaaaacaatggcatgtccataaaactgaatattgatcagtaagaatgattagcatgcaacatatggaataatctcaaaaacatcatgctaagtgaaagaagtcacacattaaaaagttcatagtggatgattccatttatcccatatttctagaaaaggcaaaacagtagcaacagaaagcagatcagtggttgactgaggtctgcagtaggaacaggaattgactgcaaagaggtactaaggtgatggaagtgttctaagactggtggtaatggtttatgtaaaaacttaccatcataaatcaaactccacagccaaaaacaggtgaatcatatgacatgtaaactatacatcagtaaagttggtaaaaacaagtaacgaactcctaggtacaatgaaccctccttcccacagcactacttcccacagtggtttgtacaaaccaatttcactctattgttttttaatgagtttacctgttatttcttctctgaaggtgcttaggttctgcagggtggggctctgctctcccttatatagaacagatcctatatttttctttggggacattttttaaagttctgagagagagaagatgttcattttgatgctactttaagcaagctttcagtctatttttttttttttttttttttttgagatggagtctcgcttgtcacccaggctgcagtgcagtggcgcagtctcgctcactgcaagctccacctcccgggttcacgccattctcctgcctcagcctcccgagtagctgggactacaggcgctcgccaccacgcctggctaattttttgtatttttttagtagagacgggatttcactgtgttagccaggatggtctcgatctcctgatcttgtgatccacccacctcggcctcccaaagtgctgggattacaggcgtgagccaccgcgcctggtgctttcagtctatttttaacacatcttaggcagaactgaagtaactttttgtttattttgtttcattaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaac

SEQ ID NO: 565 - DNA, 32461 bp, Homo sapiens
cacacctgatggtgtgactcggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcggtgggtatcatctccttacagataggcgcagagaggccaagtgacttgcccaaggtcttttgttaggacggctttttccgattggcaggcactttcgttgtgtgttcctcaaacatctttattttagaagtgagaaaacttgtgcctttttttgcagtttctcttttcctgtctgtctcctcaagtgagattttatgtgggaatttttaaagattggcgtcgccttgtagaagatgcggcttgtaattgaggccttgtaccatttactggatggaagcgcttgtttggtcacctgtccagcatgacttaggtcacttcagctaatcaaccaatcatttcttttcttttttctttttttttgagatggagtctcgctctgtcaccaaggctggagtgcaatggcacgatcttggctcactgcaacctctgcctcctgggttcaagcgattctccttcctcagcctcctgaatagctgggactacaggcgtgcgccaccacgcccggttaatttttgtatttttagtagagacagggtttcgccatgttgggcaggctggtctcgaactcctgacctcagatgatccacctgcctcggccttccagagtgctgggattacaggcgtgagccaccgcgcccggccccaatcaaccaatcatatctgagggcttgctgttaggctctgtgggtaacaacaacaacaacaaaaatcaaagtgcagtccttgaaaaaatagttgaacaattgaaaaaataaaaggttagcaggaagtgtaattgggtactagattgtgtaggggtgggggtggggcagctatatcgtttgttaagagttcacagagggaaggcatgctgaggaaggtttgaactgggggaaccctgtggatgactggaataggaaatacagggaaaggtggccgggcgcggtggttcacgcctgtaatcccagcactttgggaggccgaggcgggcagatcacttgaggtcaggagttcgagactagcctgaccaatatggtgaaacctcatctctactaatagataaaaaaaaattagccaggcgtggtgacgcgcacctgtagtcccagctactcaggaggctgaggcaggagaatcccttgaacccgggaggcggaggttgcagtgatctgagatagtgccactgcactccagcctgggcgacagagcgagactctgccgcccctaacgccccgcccccgccaaaaaaaaaaagaaagaaacagaaacagaaaaaagaaaatacagggaaaggaggttggtgggactaggtggtgggggagatccaaaccgtctgggccagaggctagaaactagtagtcattcattcactgccagagtttctgtgcaaaggttaggaagcagatgtttgggggttctttcacgttctgcagatctatatttccatcattttgtgtctcaatgacttggtagtagttttctgtcctacgacccacgatatcaagtcaacagtgtgttatcaacagaaacacataggaaagaacttcctgtggcagcaggtgactgagagacgccataaccttgcatttctttaactgatggatgagctactgcaatctttcaccttataatggcaaaaatccaggactaaccttttgatagatgatttcttctactcaatctccacagttctaatatgtttagacgttctgatttcacacaggacaatcttaaaagtcacttcactaccattctaaggaggtctctcctgtttttactgatatcatttatccctgtacttctcttgtgtaatatttattacagtttgaggattcatgaacccttgtttgtttccttgttattgcctgcctttactacactgaaagccccataacattagggaacatgtcttttttttttttttaaaccagtttacacccagcatgtattaggatacctggtaaatagtaggctttatagtaatttttgaatgcactaatgggctcatactcctttatatcctttaatcacactgccattattttatcttgggatacatgaagtagaaaaatgttttttaacctccttaattagagttacttttatatactatttatatgcatcgtatgcttcactagatttttgcctgctaaagtttatattatatacttgtttctaaactgtcatccagtactgttagcagatactgagtttctccttacttaatttggccccttattcttaattcctttcatgcctgactcccctgaatgttatacctcttttccagtaaatgtcttattttaggttctcttcactttttcccactgtgctctctcaaatgattattaagatggatctgaactaggctaccttctaaaacagaggacctatgttaagtaatgacatttcgtgcctatatactcagaattacattatttaccaacagctttttattttgggccaagatatgtccttgattgtgacctacttctttcaggctttatttaatggttggagaccccttcattgttttttaaaccaaacttttccacaaaagaattacacatataattacacatatagaacactacacaaaacataaatgtacaagttgactttttttttttttttttttttgagacggagtcttgctgtgtcacccaggctggagtacattggtgcgatcttggctcacagcaacctccacctcccgggctcaagcgattctcctgcctcagcctccccagcatctgggattacaggcacctgccaccacgcctggctaagttttgtagttttagtagagatggagtttcaccatgttggccagactggtctcgaactcctgacctcatgatccacccatcttgacctcccaaagtgctggggctacaggcgtgagccaccgtacccagcccaagttgacatattttagaaggtgaatactcccatttatctaccactgagattaaaaaaaaaagttacaataccccagaagcctccatccatctttctccataccctgctggtttggatatatcatttctatttagagcagataggttattagacctgtttcaaacttgagatttaaatttttaaactcagaattatacagttgatttttatttttacagaccatttcagagatgtcttccagaagtaccaaagatttaattaaaagtaagtggggatcgaagcctagtaactccaaatccgaaactacattagaaaaattaaagggagaaattgcacacttaaagacatcagtggatgaaatcacaagtgggaaaggaaagctgactgataaagagagacacagacttttggaggtaaatggtcttctgatcctttaaattgtaagctctccaagaaagcgatgcatgaagatttcctgatgctaccttcttactcttgccgtgttccctgtcttgtccagttgattagttttggaaagctgacattgggtttagaatcttaaattcctactttgactttgccaagtcttagatgtactttagtcattactaacttctcaccttttaaatgtaattgagtatgtgttttgaggttaccaggtactaagtttgttctggaaataaagacattgcgattaatagttttgcacctttaacatggtctgtttcacctttagtatgctctgtttctcagttatttaaaacaaagtaataacctaattcatcattcttcctatagcttcttggtaatttagcttaactacatgaatattcttgataacttttgttatgctgtatttaagattgtgaaacattctggctaactattttcgctatttttaaattgatagcataacttagaagcattcgattttccatactttttttttttttttgagactgggtctcaactctgttgcccaggctggagtacagtggcttgatcataactcactgcagcctcaaactctgggcctcaggcaatcctcctgcctgggcctcccaaagtgctggaattccaggtgtgaaccgctatgcctggccattccatgcttttttggagtactaaattactcgttgatgtactttaaggatactgtgctgggcttatatctcttttttactgtgggagaggagaaaatatttacccaatagttatataatctggttttcctgttaatttactaaatgtaaaaaatcagatctgtccatttcagagtattaaatagtgttcagatttccttatttaaaacatattttatcatgcatattggctgctatccaagtaattctggttttcaggcttttgaaggaaaaattattagacatgttggcatttacactctgttcaactatatttcggattccctaatttataatttgttatggcatagacagtaaggaagttaggaacttattagaactagagggacttaaaaatgtaatcataaatataatcacaaatttggatttaattattttgcaaaagtgcttttattgtttgtatttagaaaataaatggttaaggccgggcacggtggctcatgcctataatcccagcactttgggaggctgagacaggtggatcacctgaggtcaggagttcaagaccagcctggccaatatggcgaaacaaaaattagccggatgtgttggtgtgcacctgtaatcccaactactcgggaagctgaggcaggagaatcgcatgaacccaggagacaggttgcagtgagccaagatcgcaccactgcactccagcctgggtgacagagcaagacttctgtctcaaaaaaaaaataaataaataaaataaaataaatggttaaacagtataccatttgatttatttaaattctctaaacaggcacataatgaaactgatttattttttgtaacaacatacattgaggtaaatgctttttcaagcacttagagaacagtcatcaccagtccacagatatgaaggttattttgcaatctggtaaaggaatcttattgcttccctgagagatagctttccatttcattccactttttgagaagcactggatattttgttcctttataatcaattaaacttcctataacttctacccatttgttctaattgtgcctattaaagttacacagaacaagtcttatttttcctatgcaaactgacaatttattagatatgtaaggaaattttgcttcctcttaacttttctgcagaccaagctcatattcttcagcttttctggcttcttatcatcttgaatagtttttagtttattcatatccctcctgaattatgcacttagaattgaacacagtatcctaaatatgttctggaaaacacagattgaaatagtagtgttacatctacttagctggatactgtactccattaaagcctaaaattgtatggctctgttatctgtctcatactactgatttgagttaagcttgtggccaactataatctcctcattattttcaaatgaataaccatgcccctaaacttaaattttccccattttatatttgaacaactgctgcttttttcttcctaaattcaagttttaacttcatgctgttttgatcctgttagcctataattttaataattatttctattatctttttattttactttttcctttatgccagcagcagtttaaaaaacattacttatgtatatcttgtgaatctttgaagatgttaagcattcctttagagatcaccttctagattcaatactgaatcatttatcgaaagtaagcaggttaatgaatgcatccctctcctgctgaaatattctgtaacttttaagttccactgattcaaattcattaaggagcatgtatatcttgtgtgaccgacttttagctcttagtttttacaagatccagtgttatggaagaatgattaccaaatactcatgggaaagctagcccttctttagctttttctcaccacccttgatagaggtggtttctcctttctttgtgtctgtgctcattttttaatctgtcttaactacagcacttacaacgttgcattaatacattggcttacttctctgtgagctatctgaacataaaactttggcttcctaatcttttttggccttggtatttagcgtaatgctgacttgataataaatgcttcataaatgcttgttgaagtatatattgtttagctagatgtttgacctggctttgttctaagattcttcttagtttatgtctagaaaattcgagtccttgaggctgagaaggagaagaatgcttatcaactcacagagaaggacaaagaaatacagcgactgagagaccaactgaaggccagatatagtactaccacattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacaggtgctaatcatttctttaaacccagattttttttttctttctgatacagtttgtaattcttaggaggaatgagtttgttaagacatgcttcccaaatgatgagacaaatgattagtatagtatactatcaggtcacttcactttttttaatagcccagtcccttctctataagcaaaaatagttaatatggtaccctccactccttgtaccattgatttgcctggaggaatattcagaagacagcatctactgtgtatttacaattaccaagattttttttgagctcttatttctatagtttgtatcatgaaaacagtaggcttcatttttttggttatttttcatatttgaaacatacaattataatatcaagtatacttttcctaactgcacttgcattttctccccgttttgtttgagaggcactagcgtcatagaaagaacaaggatacagaaatagacatgtgagttcagatcttggttttgtacttgccagctctgtgactctgaacaaatttgttaacctttatagccttagagacaatactagacttctccagacccctgttctaaatcttagtttcttttttttttttttaaacatataagctaaacctgagtttccacatcagtaaaatcaggataggaatagtgagaattaaatgtaaatatgtatgtaaattgcctcgcatagtgcctagtatatagtaggtgttcggtaaatggttacttattgatcagacctttgattcttttggagatttggagattcgaataatactaacattaatatcatctataggctgggcatggtggctcacgcctataatcccaccactttgggaggccaaggcaggcagatcacctggggtcaggagtttgagaccagcctggccaacacagtgaaaccccatctctactaaaaatacaaaaattagccgagtgtgacggcacgcatctgtaatcccagctattcgggaggctgaggcactagaatcgcttgaacccgaaaggtggaggttgcagtgagccaagattgcgccactgtactccggcctgggtgacagagtgagcctctgtctcaaaaaaaaaaaaatcatctatagtagaaaatctgtagctttcaaatatatctcagtgctgttaaggatctttctctgtactttatttcccatttaggggagatagtgatcagacctatacatttatgtgtattttcatagatgggcgtttgagtgtttctgcagatgagttcaaaaagttgaagtttttctagagaatttccacagagctgaaactcataaaacgttacagtcagattcaaagtagctgactaaaatttttctttgaagttcaagagttagtttctccacttttggaatgtgaaatacaaacttggtagaaattataatttttaaaatttttatttattttttattttttgagacagagtctcattttgccacccaggctggagtgcaatggcgcaatctcagctcactgcaacctccacctgggttcaagtaattctcctgcctcagcctcccaagtatttgggattacaggcacctgccacgacgccctgctgatttttgtattattaatagagacggggtttcaacatgttggccaggctggtcttgaactccttacctcaggtgatccgcctgcctcagcctcccaaagtgctgggattacaggcataagccaccgtatctggcctgaaattataatttttaaaaatgtattcttataataattttgtgggctactcgtattgatttctttattaactagtatgtctgactcctataacaacttccaaatgtcagtgtcttatgcaacaaatgtttatttttctctcatgctggtctagtccagattggagtagaggaagctttgctccacagagtcatttgactccaggttccttccttctagtggctccaccttcctttagggtagggtcccccaccaagtcctctgtatgtagctgtgagatggagcttgtggagaactgcctaggaggggtctggggccaggcctggtattgacatatctcacctctgctcacattccactggaacatggctccactaaccacagggaaggctggaatcagtctacagtgtgcccagggtaaaaggaaagggatttagagaactatctttgtcatagtttccacctcgaggactgaattgagagagagaaagggctacatattaaagtgaatgaatagagcatctttggagaaaaataatttttttgagcttctttgccagtattcacaagtctcttatagctattaaaagactgaaatacagctttttctatgtttgttggccagcctggctacctagccacccacttctcttttatttctctgagaaaatgaagaggagagaaataatttttgagttccatataatctatatgaactaatactaattaataattaatactttttttttttagatagaatcttgctctgttgcccaggctggagtaatttttgtattattagtagagatggggtttcaccatgttagccaggctggtcttgaactcctgacctcaggtgatctgcctgcctcggcctcccaaagtgctgggattacaggcataagcctgatcttggctcactgcaacctcctcctcccgggttctgcctcagccccccgactagctgggactacaggtgcgctaccatgcctggctaatttttgtatttttagtaaagatggggtttcaccatattggccaggctggtctcaaactcctgaccttgtgatcctacccgccttgccctcccaaagtgttgggattataggcgcgagccactgcacccggcctaattaatactattattaatacaaaacatgattctagaaaaaaaattttaccttttgtttgacaatttaatgtcttctaggtgtcatttaaatagcctagttgttttgtgtttgtctttttggtaaaaatcactgggctattcatatgcactgagggctattctggcaatcctggggtctagaggactgcagaagtcagattagatagaaaatctcaggatttccagtctgtttgggaaacttcaggggatcttaattttcacaatggttatctctggtaactctcacctggcttgatggtttaccaccatctactagatctggattttttgttttctttttttgagacagagtctcactctattgctcaggctggagtgcagtggcgcaatctcggctcactgcagcctccacctcccgggttcaagtgattctcctgcctcagcctcccgtgtagctgggattataggcacaggccaccaggctcagctaatttttctttttgtatttttagtagagatgggttttcgccatgttggccaggctggtctcaaactcctgacctcaaatgatccaccctccttaacctcccagagtgctgggattataggcgtgagccaccgtgcccagcctagatctggatttcgggatgcccccgtgagttatactgtattattatggtgaatgtaatgaggcaacttctattgtggaatgtctgatgttaactaatgttggattatttacagactgtggctccaaactgcttcaactcatcaataaataatattcatgaaatggaaatacagctgaaagatgtaagttcatttccttttaagttatgggtaaagagggctaattcatttattcttaagttttacagaaattggcaacattagtgctgtgacagaaaaactgaatggtttgagagcttcatttaagtctctttctatacattcgagaatcatttcttctaagcatagtcccttttttttttttttttcctgaggcaaagtctcggtctgttgcccaggctggagtgcagtggcatcttggttcactgcaacctctgtctcctgggttcaagcagttctacctcagcctcctgagtagctgggattacaggcacgagccaccacactccgctaagtttttgtatttttagtagagatggggtttcaccatgttggccaggctggtctcaaactcctgacctcaagtgatctgcccacctcagcctttcaaagtgctgggattacagctgtgagctaccatgcccggcatcatggtctctgtagggtagacagccctagaaattatcactgccaccaaatacctcaataacatcccttttctatctaaatctaatttccctaatttgcccaatcattttattgtttcttgttttttcagtatttttctctttttgagatggagtcttgctctgttgcccaagctggaatggactggtgagatctcagctcactgcagcctccacctcccaggttcaagtgactcttctgcctcagcctcccaagtacctgggattacaggcacccaccaccacgcccggctaatttttatttttagtagagatggggtttcaccatgttggccaggctggtcttgaactcccgacctcaggtgatctgcctgcctcggcctcccagagtgctgggattacgggcgtgtgccactgtgcctggcctccattttattcttataatgtaatttaatttgtagtatcttctcttttggtttatccatgcaagatgctctctttggtttgaatacttctcttgaaactaaggtttgctttcgtaggttgaaaaggaaacgttctttgtacactcagtacttcctttctctagaatttggtatgaggttattttagttatacagtaaagctgtattattgcaaactgataaatggattggtgggttttattgggaatggaataaattgaggacacaggactgctacttacagtgtatttttttcaagttttagagatatgaagtataaagtttctgacttaagtattaggtcagtatgttggtattttggttccaaaaatattactggcatgtctatcctgatataagcatgttcttaagatttctgttttacttcatctatcaagtatcctttgaagtctttttgatcttcaaaagaagaatttaaatctcctggatgtctagccaggtgccaagtactcttatcagaatacgtaatttacctagaggtaactggaatgaaaaggaaaagttctatgtcttattacactgaagtttgttattctatgtatatccatacctatgcattagatgcacatatttagaaatatcttacacagctcctgcattccactttatttactccacctgcaccacaatggctttccagctactccttgaataaaccaccttttctctttctgttccctctgcctgggacactcttccccagatatcttcatgatttcctccctacctcatgcaggtttttatttaaatgccactttcttggggttgggggaggacagaatgggggctgcctgaccactttgtctaaaattatagctcccagacaattcctattcttttctcctgcttttccctcctcatcacattctacagctaaatttacaatctatttaacttctcttgtttaatgttcaacctttccatcagaatagaagtcatatgaaggaaggatttttgcatgttttgtacattgctatatcctcagtgtctagaacatttgaaagaatgactggatggaatcttgggaagtttcttgaattttactggtgtctcttctagaaaagtacctgaaaatagatgccattatcttaagcttacatgtgctttttaggcatctcagtgctaactgcttcagatatcacctgagggtatttttagataatgatgattcttttttatgaaattaactttgaaatactacatatgtaagcccaagctttttgttctatcttctcagcttatttaagggtcacattgtgcttgtctcctctgtcttagaaaggcgtttatacaaatggggtaaaatttaacccaactcttctacaaatggtggtctagactgagcaagattcacagactctaatatactaggtctggggtagtgcctgagttttctgcatttccagtaaactcctagctgctgctgctgctggcccttggaccacgctttgagaaccattaacattattattattattattattattattattattttgagatggagtctcactctgtcactcaggttggagtgcagtggcgcgatcttggctcattgcaacctccgtctcctggtttcaagtgattctcatgcctcagcctcctgagtaacagggattacaggtgcgtgccaccatgcccagctgatttttgtacttttagtagagacagggtttcgccatgttggccaggctggtctccaactcctgacctcagatgacccacctgcctcagcctcccaaagtgctgggattacaggtgtgagtcattacacccagccagaacttatatttgaggagcaagaagtggtttagctctggttttccctttggaatttcagcaaatctttgagaccagggggaaaattgtagttggaggacttagggaacatggaaagagacatctcacttcttgcagcaccgacactggcacattatttggcttttgagagctcagcagttctagttccatcaccctctcaaagttcgcagaaacttcctgtagaagcttacccacgtattttcagaattagtatttgttatatttaaataagccctaaaagctacgtacagcttctttaggcccagttgtatcattgttcagttaccatttcgctctggccgacagttgaaataattacgtagagttaatgtcgtaagcattgtcaaatgtcagtacttttagtatttatttaagcattatgttagtataaactagacaaaccaaatagccaaaagacagttttaataggcgtttcttgctcttaaattcaaatatccgaattttaagcatagaacttagggaagataaataataattgttttaaaattattttgtctgcaaacattcaaattaacagaaaagttacaagaatgagtatgataacatataataacatataacgcccatatcccctttactaaaattcaaccgttgttaacatgttaccccattttgcactctgtttttcctctttcaaccctcacccacacacatatacatgtagtatttttttctgaaccatttgagaatgaattgtacatatccacagccgtttaaacccatatacttcaatgtgtgtttgttctcccatccaagtactaaacagactcaacgctgcttagcttccaagatcagccaagatcaggcgcgttcagggtggtatggccgtagacttcaatgtgtatttcttaagaacgaggatactcttgcccacaactatagcacagatagcaactttaataaatttaacatggatacaatacttctataatctaccattcctactgcagttttgtcaattgacccacattttttattcctccagtataggctaacattttaatctacgttggttggaatttttgtctacagaatatttagtggattcttgtcaaacctgggcgaagacctttatagcattccacaggactttttttttttttttttttgagacagagtctcactctgtcgccgaggctgtagtgcagtggcacggtctcagctcactgcaacctctgcctccctggttcaagcgattcttctgcctcagcctccagagtagctgggattacaggcacctgccattgcgcctggctaatttttttttatttttagtagagacggggtttcaccatgttggccaggctggtcttgaactcctgacctcgtgatctgcctgcctcagcctcccaaagtgctgggattacaggcgtgagccaccatgcccggactccacaggacatgttattttgcccacttttgttctacatttttattggtaacttggaggaaattgttaaatgcatgcctaacaaacgtatagatgacacaaagctggaaggcatatctaatgcaatgatgtttgactctaaaaactcaaaactaatacaatcaatatttatgatagctatcaactccgtgtattgatactgatagaaagccgatgcacacagtgagaagaggtggcataaggaaatgtttattgagggaacatcgccatcatgtggccttttagaatactaccccttgaatcttcaactaacatgtatttttgtttctcatacttaagtgatgtatggttcctttttttttaattaattaatttatttttttgagatggagtttcgctccgttgcccaggctggagtgcagtggcacaatctcaactcactgcaacctccacctcctgggctcaagtgattctcttgcctcagcgtccggagtagctgggaccactggcgcccgccaccatacctggctaatgttttgtatttttagtagagacggggtttcaccatattggccaggctggtctcgaactcctgaccttgtgatatgcccgcctcggcctcccaaagtgctgggattacaggcgtgagccactgcacccagctggttcctttaaaagaaaagaaaaataaaataaataaaataaaattgggctggcgcagtggctcacgtctgtaattccagcattttgggaggacaagaagggcagatcacctgagatcaggagttcgagaccagctgggccaacatggtgataccccgtctctaataaaaatacaaaaaagctgggcgtggtggtacacgcctgtaatcccagctactcgggaggctgaggcaggagaattgctggaacccgggaggcagagtttccagtgagctgaaatcatgccactgtattccagccggggccacagagcgagactccgtttcaaaaaaaaaaaaaattggccgggctcagtggctcatgcctgcaatcccagcactttgggaggccaaggcgggcagatcacctgaggtcaggagttgagaccaacatggtgaaaccccatctctactaaaaatacaaaattagctgggtgtggtggcgcatgcctgtaatcccagctactcgggaggctgaggcaagagaatcgcttgaacccgggaggtggaggttgcagtgagccaagatggcaccattgcactccagcctgggcaacaagagtgaaactccgtctcaaaaaaaaaaaaaaaaaaaaaaatttcatgaccatttaattttgacttaaattatttgtattaaaatactacttaaatgtggacaaatgtaaaatttagtataaaattaggtatctttagtatctaacacactataatttataggtatttggatatacatgtgcattgtgagtcatacagtgcttcctctcttatcaagtaaatttaaatctgatcctgggtttctcatgagtcctttcttttgaaagatgcataggttctgagtaagaacctcactggggatggcagtggagctgaataagagagtgactactgcagcctgttttaagataggccaagaatcctagcaatcttctcaactgtactaagttcactgattatttttcccaacttttatgattatttttcccaatttttattacgaaaaatgtcaaacatacacaaaagttaaaagaaaatacattgaacaatcatatatctaccacgaagtttcaataagacagactctttaaatcaaaaatcaaattactacagtgaaaacagccatccacagagctttacactattgacgatatataatacaaaatggatatacaatatctccacttgacaaatggactcttaagccatgtaaagaggactactgttccctaatggatgcagagagaaaagtgtctggtaaagtggctgaggctcctgggctaagtctttgattttagagactgtttctgtcttcctaattcatttgctaattctatagcaaacagacactgaaaatcctttaagtgccatacccaggagctttgctcaagagtttgtagggtgctagtagaaagagcctaacaaagcttagagaaactctctagacttaataagagtttccatacatgtagatctttctggatatgggactcaatcaatgtctttaaaggatggaaattcttaccggaaagcagttgccctgatagacacccaaaacctttaagctccttatgtcctcttcattgtggaactagaggtctggaaagagtggctgctataaaaggaaacactatattgtattgtcagattgaaattaaatagaagaattttatctatgcataatagatcattttaagagctactgtgttgttctccaaatagtaatcagaaatctgtattccactcttgaaaaaatgagctttgctgatactgttataggttcttcgaagttcagattactatgagctctggatttatagcaagtcctctggtgtgaaatgaactggttacaatccctgccatacaaagcttctgtcttcacatggcctcattctctatgtatatctgtgtgtctgctcctttttataaggatactagtcattggatttagggctcaccctactccagtatggcctcattttaactaattgcatctgcaaagcctccccctccccttttttttttttgagacggggtctcactctattgtctaggttggagtgcagtggcgcaatcttggctcactgcaacctccgcctcccgcattcaagtgatctgctacctcagcctcccaagtagctgggactgcaggtacgtgccaccatgcccggctaaaaaatagagacagggttttgccatgttggccaggctggtcttgaactcctggcctcaagtaatccgcccgcctcggcctcccaaagtgctgggattacaggtgtgagccactgcccagcccacagaccccatttctgaataaggtcatattctgaggtttcaagtggacatgaattttgggggacattattcaactcactgtaagtatgaaacccctatacaaacaggtgagtgacggcagcttggagtttttaattgggttataaaagatcatataaaggatgaaagttggtagtaaagagagaaggtagctgttaagtttgatcctctaaagaagacactgagatgatgttaggagtgcagacggtttattggggagcaagatctgtgcaaggaaaaaggaagtagttatgccagggagaccatcagaccatgatgaaaacctaacaaggtctctgtcaccccatggggggctccagagcagagagtgctgaaaagcagagtcctcgttgggcagcaatagttaggcacttgttcagttgttggctggggccaatccagctcagctcaaaagctgacagggacttgaaggaattaacagatggaggctgtcagctaatcagctaatcactcaccatgcagctgggcagagatcctcttttttttgtttgtttttttgagagacgcagtttcactggagtttccaggctggagtgcaggggcatgatctcagctcactgccacctccacctcccgggttcaagtgattctcctgcctcagcctcctgagtagttaggattacaggcacgcgccaccatgcctggctaatttttgtatttttattagagacagggtttcaccatgttggccaggctggtcttgaactcctgacctcaggtgatccaccaccctcggcctctcaaagtgctgggattacaggcgagagccaccgcacccagccagctgggcagggctcttgaagggggattctgagcagttcatctccatgtctgtcataaaacgtgttttagtttacagagaatgacatatacgcacacacaaagcaagttgtgtactgaaaaaagcaaacaaatgaacttaatcccacataaactacgatggtgtcatgttgttatgtattctgaaggcatgtaacatagaatggttgcccagaattagtctatgagccatagagtttttgttggaaaagactacatcacttggactctcttgcccattttaagattttgtttttttattttactgttgattttctttcatcttcccattaaggctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggtactgactggtataaaaatgttctctagggataggcctgacattttccaaaaggaatgattcatcaaatttagatttttatagatatgtgttagaaagtaaaataagagcaagtcttatagccctgaagtaagaaataccatttttgcaagttttatttcctaacgttttcagatcaaaagaaagtaccaacacaggctaatgggtgatctttggcagttctgaaatcacattcagttctctctacccatgaatgtccttcccctttttcaaagtccttctccagcttttacttcccccagagttggccttgtcacaattctcttttcactttgcttcccttcagcacttattcatatcaaccccaggagaaagaatgccttttttagatgatccttaaatcatttgaacttcaggtatagaattgagatgaaatttctcattcacgatgctgtctttttgccaagcactttgcagtttcccttacatagatcttagtggagttttagagcaaccctaagaggcggggcaggaaaggtcagtattctcattttacagatgaagaaataggtttagcaattctagatgacaagctaagaaaagaaaaatgagaaactccatgcaatgctctccttaaaagactgacagtttggaggggaccaaagccttgaattttatagagaagtctaaagaaaggggaacaagactcataagattggagaatcatatttgaatacttaaaacaaagctaatgctaaaaagaaactataaatgtctctggaggcacttcaaagctgtcagccctaatggcactaagttgcttctataaaatatgtgcttatgtaaaagcaggattttagttatgggctaagtctaatttcttttctttggtaatacagttctctctctctctctctctctttctctgtgtgtctgttttatcaaagcaatataagcacttgttagaataatgtaatagttaagaaggaccttgccctgtctttcccatcccaatccccgtttcttcctcccatcaggcaactgctcttaatatttctatttttaattttgatagttatctccacatataaataatgagcttgtgttcctatttgttgattgaacttcttgagactttccctcccaacagaatagatgttactgtttttagttcttctatttgtgagttttataacttcaaatagtatacctgaacttgttttttatttcatcaaatatcaaccatagtccctatctcttgacttttcatgttgtaaactaaggaaatagtgtgattcatttagatgtttgatgtttctcttttcaggaatattatttattttataaagtgagttgtgccgtaatgttgtttgtcataggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtaaacttaaccagatccataattcagagtgttcaccgaacactttctaagtgtcagggactatttgaccactagagaactggctagggacaaaacaaattcctgcccctcatgggagttatattccagaacagaaacagaccataaacaataaataaggaaactaaagaaaatgcaacagggtgacatgacaaagggaaattggggaccagtggaggcctctctgaggagatggcatttggacaaagacctgatgatgaggaggacccagtgaggtgggtgacttttcctctcaatggaggaaattgtacacacaaaggctctgagtgaggaggaggtcagtatatgtgagaagccaaaagaagaagtgaagtaatgagaggaatcgaggctgattcctagactggcatcttaatggtgatgatatgtgctcaagtgaattcacatggcatcttccatgttcttgttatgctcatagccttatgctatggtatcataataatgttggagttactacgttaggattattggaattgaacagtactttgatggaactctttaatttagattttgctttgcagcctggcatcatggaaggaacattatttggaatccatgcctagtctctagtccaggatatatggccttaggcaaatcacctaacttctctgactactcactggttattcccttgtcaaattaataataacctctgcttgccatatagggctttggtgagcgtcagttgagagaaggtaaaagtgctttgtaaactaagcgaggtaaatgctagttattgctactattttaataataatttttaacagtcctacaaaagttgagggtgctggtgatgggacagtaacaagtccatctataacatttgccatcttagtcttttttttctttttttttttctgagacagggtcttgctctgtcgcccaggctggaatgcaatggcgtaatctcagctcactgtaacctccacctcctgtcttcaagtgattcttgtgcctcagcctcctgagtagctgggattacaggtgcccaccaccacggctggccaatttttatatttttagtagagatggggtttcaccatgttggccaggctggtctcaaactcctgacctcatgtgatccacctgccttggcctcccaaagtgctgggattacaggtgcaagccactgtgtccagcctgccatcttagtctttaccactcacacttcttctgtctacaggtatgagcagtgatactagggagagattaagtctgctgattaaattttgcttcagctctggctaagggcccagcactgccacccatgttatcctactcagaagtgtcagaacctccaggaaagggggcatggctgctgcagagttcagtgctgtttatcagcattcagtctgtgtgcctcagggaactctcggcaagggcggtggtatactgcttagctgctggcatagatagccatcagatggccagctggaatgattcacccctgactagcaggtgttgtcctggttagagatgtgagacttgtgatgtgagctttccgtgcatcccaggtcaagccggaaaaggttggatgtgacagcattggttctctttatgtcctacaggtccagtttctttacacatctctgctaaagcagcaagaagaacaaacaagggtagctctgttggaacaacaggtactcattcgggttgcttctaaattcaattctgcctgttagaaaatgcagtttttcctcatgtttatgctgttctatggagaactgtttgaaagttgtgaaaagtgtctttaaaagacttcaataaaagtctttcttcttcaataaaaaagatatttcaagagactctgctagccacttattcctgttgctgaccttaggctaaacagattcttgaggtgtgatggcagttttcttgacaggtagatgttggccttggcaaattttgctcttccccagtggctgtagctcctagcctaacaatgtctcctaagtagggctaccttataacttcaagcagaacttggagagacaccatttagtctcagaatgtattataaatggtgtaaagcagagatttttagtatattccaaaccagggaatagctatctctttcccttctccttcttcccccttaaaaaaggtggatagggaggagtaattctaatcaacaacttcttaagctgctcttcattcacctatacctcagcgttggctttgctccttggataaaccaaatcctcagccataagctgcctcgtttattaacatttcatggtgcttaggtgaattcttgctacgatggtacaataaatattttcttcatgtgctaataaaaaaatgtgagcatccagtcaagagaactagacagtctgtatcagctgtaatggtcttgttctgggccttttccagatgcaggcatgtactttagactttgaaaatgaaaaactcgaccgtcaacatgtgcagcatcaattgcatgtaattcttaaggagctccgaaaagcaagaaatcaaataacacagttggaatccttggtgagtctggaatgattaaactaaaatttgtcttcgtcttccatttatataccaaatcagttccgaacttaggaggatacagcttaacacacagctagctgtatctcaaatcagtaggtagagcctctgcctcatttgaagcaactgccctttgagcatcaattcagaggacatgaaagagggacatgatcacatctggaaacattcccccaactaccccagctgctgtgatgctggaggcactaaatagtgcctgagctggggtcaaaagggtagaatagagggtagtcacagaatcctgaactgaaattgtgtttatctattaaaaaagaaagaaaggctgggcacgatggcttatacctttaatcccagcgctttgggaggccaaggcaggcggatcatgaggtcaggagttggagaccagcctgaccaacatggtgaaaccctgtctctactaaaaatacaaaaaattagccgggcgtggtggcgggtgcctgtaacctcagctacttgggaggccgaggcaggagaatcacttgaacccgggatgcagaggttgcagtgggctgagactgagccactgcactccagcctgggcagcagagcaagactctgtctcaaaaaaaaaaaaaaaagaaaaagaaaaaaatgctgtttttagggataatggactattactgttaatatgctttttagatgtattatgaggtttgtgtgagtcactctgaaaacataatcttttaaaacatgaaccttttaaataatattgtttctatgatgaaatggtttttcacttacttattctcaccttactaataagcttttggaccaaacttgttgggggtctgcatttgaatatatgtctgtcccactagtacatattttaaattttattctactactatagaatacttggagacagtgaaatgttacaaatatgattcctcagttttcaaaggaggaaaaaaaaacaatgataaaagtaaaaatcacttgtaacttctgtatgaataaaagaaagaaaatatatttttggctctgttcttaagtatataattgattttacccatttataatatttgaaatgaaaatttataattcatttttgttattgaccattcaaagcttagggagcagagggtatgcaaaagaatttgtaattttgtgggggcggttccaagatggctgaataggaacagctccagtctacagctcccagcgtgagcgacacagaagacggatgatttctgcatttccaactgaggtactgggttcatctcagtggggactgtcagacagtggatgcagcgcaccgagcgtgaaccgaagcagggtgaggcatcgcctcacccaggaagcgcaaggggtcagggaattcccttttctagccaaggaaaggggtgactgacggcacctggaaaatcaggtcattcccaccctaatactgcgctattccgacggtcttagcaaacagcacaccaggagattatatcccacgcctggcttggagggtcctacacctacggagccttgctcattgctaccacagcagtctgagatcaaactgcaaggtagcagtgaggctgggggaggggtgcccgccattgctgaggctcgagtaagtaaacaaagcggccgggaagctcgaactgggtggagcccaccgcagctcaaggaggcctgcctgcctctgtagactccaactctgggggcagggcatagccaaacaaaaggcagcagaaacctctgcagacttaaatgtccctgtctgacagattggaagacagtagtggttctcccagcacgcagcttgagatctgagaacggacagactgcctctacaagtgggtccctgacccccgtgtagcctaactgggaggcaccccccagtaggggcagactgacacctcacacagccgggtacccctctgagacaaaacttccagaggagcaatcaggcagcaacatttgctgttcaccaatattcgctgttctgcagcctccgctgctgatacccaggcaaacagggtctggagtggacctctggcaaactccaaaagacctgcatctgagggtcctgactgttagaaggaaaactaacaaacagaaaggacatccacaccaaaaccccatctgtatgtcaccatcatcaaagaccaaaggtagataaaaccacaaagatggggaaaaaacagcagaaaaactgaaaattctaaaaatcagagtgcctctcctcctccaaaggaacgcagctcctcaccagcaatggaacaaagctggatggagaatgaagagttgagagaagaaggcttcagatgatcaaacttctctgagctaaaggaggaagttcgaacccgtggcaaagaagttgaaaaccttgaaaaaagattagatgaatggctaactagaataaccaatgcagagaagtccttaaaggaccagatggagctgaaaatcacagcacgagaacaacatgacgaatgcacaagcctcagtagccgatttgatcaactggaagaatgagtatcaatgatggaagatcaaatgaatgaaatgaagtgagaagagaagttttgagaaaaaaggataaaaagaaacgaacaaagcctccaagaaatatgggactgtgtgaaaagaccaaatctatgtctgactggtgtacctgaaagtgacgaggagaatgcaaccaaattggaaaacactctgcaggatattatccaggagaacttccccagtctagcaaggcaggccaacattcaaattcaggaaatacagagaatgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcagcagaaactgtacaagccagaagagagtggggggtcaatattcaacattcttaaagaaaagaattttcaacccagaatttcatatccagccagagtaagcttcataagtgaaggaaaaataaaatcctttacagacaagcaaatgctgagagattttgtcaccaccaggcctgccctacaagagctcctaaaggaagcactaaacgtggaaaggaacaaccagtaccagccactgcaaaaacatgccaaattgtaaagaccatcgaggctaggaaaaaactgcatcaagtaaagagcaaaataaccagctaacatcataatgacagggtcaaattcacacataacaatattaaccttaaatgtaaatgggctaaatgctacaattaaaagacacagactggcaatttggataaagagtcaagacccatcagtgtgctgtattcaggaaacccatctcacatgcagtgacacacataggctcaaaacaaagggattgaggaagatctaccaagcaaatagaaaacaaaaaaaggcaggggttgcaatcctaatctctgataaaacagactttaaaccaacaaagatcaaaacagacaaagaaggacattacataatggtaaagggatcaattcaacaacaagagctaactatcctaaatatatatgcacccaatacaggagcacccagattcataaagcaagtccttagagacctaaaaagagacttagactcccacacgataataatgggagactttaacaccccactgtcaacatgagacagatccacgagacagaaagttaacaaggatatccaggaattgaactcagctctgcaccaagcggacctaatagacatctacagaactctccacctcaaatcaacagaatatacattcttctcagcaccacaccgcacttattccaaaattgaccacatagttggaagtaaaacactcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacaaaatgaaggcagaaataaagatgttctttgaaaccaatgagaacaaagatgcaacataccagaatctctgggacacatttaaagcagtgtgtagagggaaatttatagcactaaatgcccacaagagaaagcaggaaagatctaaaactgacaccctaacgtcacaattaaaagaactagagaagcaagagcaaacccattcaaaagctagcagaaggcaagaaataactaagatcagagcagaactgaaggagatagagacacaaaaaaactttcaaaaaatcaatgaatccaggagctggttttttgaaaagatcaacaaaattgatagaccgctagcaagactaataaagaagaaaagagagaagaatcaaatagacacaataaaaaatgataaaggggatatcacaccgatcccacagaaatacaaactaccatcagagaatactataaacacctctacgcaaataaactagaaaatctagaagaaatggataaattcctcgacacatacaccctcccaagactaaaccaggaagaagttgaatctctgaatagatcaataacaggctctgaaattgaggcaataattaatagcttaccaaccaaaaagagtccaggaccagacagattcacagccgaattctaccagaggtacaaggaggagctgataccattccttctgaaactattccaaacaatagaaaaaaagggagtcctccctaactcattttatgaggccagcatcatcctgataccaaagactggcagagacacaacaaaaaaagagaattttagaccaatatccctgatgaacatcgatgcaaaaatcctcaataaaatactggcaaaccaaatccagcaacacatcaaaaagcttatccatcatgatcaagtgggcatcatccctgggatgcaaggctggttcaacatacgcaaatcaataaacgtaatccagcatataaacagaaccaacgacaaaaaccacatgattatctcaatagatgcagaaaaggcctttgacaaaattcaacagcccttcatgctaaaaactctcaataaattaggtattgatgggacatatctcaaaataataagagctatttatgacaaacccacagccaatatcatactgaatgggcaaaaactggaagcattccctttgaaaactggcacaagacagggatgtcctctctcaccactcctattcaacatagtgttggaagttctggccagggcaatcaggcaggagaaggaaataaagggtattcaattaagaaaagaggaagtcaaattgtccctgtttgcagatgacatgattgtatatctagaaaaccccatcatctcagcccaaaatctccttaagctgataagcaacttcagcaaagtctcaggatacaaaatcaatgtgcaaaaatcacaagcattcttatacaccaataacagacagagagccaaatcatgagtgaactctcattcacaattgcttcaaagagaataaaatacctagaaatccaacttacaagggatgtgaaggacctcttcaaggacaactacaaaccactgctcaacaaaataaaagaggatacaaacaaatggaagaacattccatgctcatggataggaagaatcactattgtgaaaatggccatactgcccaaggtaatttatagattcaacgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactacctgatctttgacaaacctgacaacaacaagaaatggggaaaggattccctatttaataaatggtgctgggaaaactggctagccatatgtagaaagctgaaactggatcccttccttacaccttatacaaaaattaattcaagatggattaaagatttacatgttagacctaaaaccataaaaaccctagaagaaaacctaggcaataccattcaggacataggtatgggcaaggacttcatgtctaaaacaccaaaagcaatggcaacaaaagccaaaattgacaaatgggatctaattaaactaaagagcttctgcacagcaaaagaaactaccatcagagtgaacaggcatcctacagaatgggagaaaatttttgcaatctactcaacctacaaagggctaatatccagaatctacaaagaacttaaacaaatttaaaagaaaaaaacaaccccatcaaaaagtgggtgaaggatatgaatagacacttctcaaaagaagacatttatgcagccaaaagacacatgaaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcaggatctagaactagaaataccatttgacccagccatcccattactgggtatatacccaaaggagtataaatcatgctgctataaagacacatgcacacgtatgtttattgtggcactattcacaatagcaaagacttggaaccaacccaaatgtccaacaacgatagactggattaagaaaatgtggcacatatacaccatggaatactatgcagccataaaaatgatgagttcatgtcctttgtagggacacggatgaagctggaaaccatcattctcagcaaactatcacaaggacaaaaaatcaaacaccgcatgttctcactcataggtgggatttgaacaatgagaacacttggacacaggaagggggacatcacaccccaggacctgttgtggggtggggggagtggggagggatagcattaggagatatacccaatgtaaatgatgagttaatgggtgcagcacaccaacatggcacatgtatacatatgtaacaaacctgcacattgtgcacatgtaccctaaaacttaaagtataattaaaaaaaaaaaagaatttgtaattttcctgtactttgttcctgctatccaccctcttcactgtgctgtaaaatactcatttttaactactccaagttcttagaaaaaaaacacaaaaaaggaaagtctcaaaggtatgatagaatatcttagtcatttctgtgtataagctgtttgagctgctaaaattgcttgctgcctttaatttccatgtagtactttattgctgacgttgcctctgttttacaaaactagcaaatttaatcagccttgcatataggcctacctaatattcgactctgtgtcctaataaaacatattcatatatacacccaactcccatatctgggtaatttggataattacagtagttatctggataaattcacaactacctcatatattaccctcataatactgatgagctgaaattcaaaagaaaatctgtctacagtgctgaagcagctataatacttatggaacagttaaaattgctgaacaggctgggtgcagtggttcatgcctgtaatcccaacacttcgggaggctgaggtgggcagatcacttgagcttaggagtttgagaccagcctgggcaacatagaattaattttttgtagaattttctatttctacaaaaaatagaaatattatctggacgtggtgacatgtgcctgtagtcccagctacttaggaggctgaggtgagaggattgcttaagcctgggaggtcgaggctgcagtgagccatgtttgtgccactacactctggcctgggtgacagagtgagactgcctcaaaaaaagaaaaaaaaaaagctgaacattggccctatttacaaattctattatttgaaacttatttttcagaaacagcttcatgagtttgccatcacagagccattagtcactttccaaggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagactactaacattttgcactgtcaaaatacttggtgaggaaaagatagctcaggttattgctaatgggttaatgcaccagcaagcaaaatattttatgttttgggggttttgaaaaatcaaagataattaaccaaggatcttaactgtgttcgcattttttatccaagcacttagaaaacctacaatcctaattttgatgtccattgttaagaggtggtgatagatactattttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgttttaa

SEQ ID NO: 566 - DNA, 73334 bp, Homo sapiens
attgtttgaatttgaaaacggtaacatcgcagtgctgctcgcgggtctggctagtcaggcgaagtttgcaggtgaggaggtgacccgcgggaatgtgtggggaaggaggtgggtgactgcgcatgtatggggcctaaggtggggaaacggctttggcaatgtggacatgttccgacagggctcataccccagtggaggttactgtcaggaactgggttgcggagcgatgcgaacacggggtacgcagcgaggaatgagtcatactaattcggttacggtttaaatctcgcctccactgctaattagctgagtgacgcaagacaattcatttaatctctctctgtaccttagttttcttatcagttaaaaggctgcaatgaagtgtctatttctttcggcttttgtgaagattaaatggtaatgtgtaaagttattagtgctggcacacagtaggtactaaatgtttgcagttattaatattattattgttgttgcttctgttgttgttgaggaacaggcctgttttgccacacctagttttctgaagctctgaggtgagcagtttgctcggctggtaggtaacacggcctttttgcggggggagccctgtggtagcctctgtgcacttatttccagactactcctactggtccttggggcttgcccttctagggttttgcagtgccaggctgaagagtttgtggcacagtgactgctgtcattccccagtttagaaggctttctccatctcgattcgctcgctggttcagtgatgcatgtctggcacagttctcttatatttcttgctaaactactagtttacagaagttcacgccttatgggttaggtagtgtaacagtgtatttatcttacatgtccaagactccagattttaaattgtaaaaataacataaaatactcatcgattagttgtgaagactttttttgaggctttgtgttgtagaccacattcagaaacctcattcagcaacagattctgctatttttcaccaaagtctccaattgtggattcttattggagagagggtaaatatgcagttttccagtcagagcagccttttgaaatgaaaaatgaggtcttggagcctgctgtcacgaaagataatattacagactaggaccgacttttttttttttttttggaatagtattttctttataaccattattttaagtcattaggtagtctttatccctgcataagtcgctgaatttgttataggggatacagagtggtataaggcaaggttcttgccatcaagaagtttccagtttagttgggaaggccacgtataagtagaagtcatctaaaatcgcaagaagttacagtaagtctgaacacttttagaaatgctaggaagtagtttgttcattgaaaaatgagcatatgaacaaatactttattataactgcttttagtacataggaatattctttttaattcagcaatttaaaagatttatcaacacttttctttaaaccaaaaattattatttgaagccacaggtgttttttagttttctgggcatttccatgaactctgtgttatgaaatgtcaggccggtactttaacgttttgcagatgctcccccctctgcacccccttacccatgatctagatcagtgctttccttagtctttttgcaatttaggggaaaaaagtcaactatgttcttgtgatacgtttaggaatttcagcctgatcaaggaaaaagattgacaacaagatggcaggaataaacaaggattttgacaggattgtaggcaaaggaaatccgtctcagtttgggaccttttctagaccagggtgaggggccaccatctagaggggaaagagggcaaggggaatggggagtcggggaggaaagaatcatagaggggcttacatgcctaaatgatgttgcacagtggagagtctccggatcatagaaactctcaagggcagcagtggcttgggggtcttgataatcccgggttttatgtgtctggcaaatgttgggtgcagtttcatggggcattcaaacctggcaggctctaaatggctaaaaatatgcttattttgggccattttgaaagtaaatggatgcttcagaatttgactttggcgccccagcaggcttttcccttttttttttttttttttgacgcagtcttgctctgtgttcaggctggagcgcagtggcgcagtctcggctcactgcagcctctgcctcctgggttcaagcgattctcctacctcagcctccttagtagctgggactacaggcgcatgccaccacacccggctaatttttgtatttttagtagagtcggggtttcaccatgttggccaggagggtctcgatctcctgacctcgtgatccacccacctcggcctcccaaagtgctgggattacaggtgtgagccactgcgcccggccgtaggctttttaatttttattttaaacattcatggtccttgatccagtgggcttttgagctaagatccctaccagctgtgaagaagtttacactgtagagctattatgcaagggccatctttggttcattttatataatacctgtgggtgatggtcgttactactttcttgagctaggaaccttagtttgggagtcactgatctgtatattttttaatcttgtcaaaaaacagcacagagtcctcctcctctctctggtattgtacatctagtagattctcagtaaatattagaatgttagtattttttagttaaggttatccttaagtttaccttttagtttagtgatttgatgtttaattcaatggtaatagtttactgatgcattattcctatttaacttaaaacctgtgatgtgtcaggtactgttttgaatgtgtttacatatattattttactttttacttgaatttgaaattgaaaacaatttttcagataactgagttttgttttgttttttttttttgacggaatctcactctgtcacccaggcttgagtgcagtggcgcgatcgcgattcactgcaacctctgcctcccgggttcaagcaattttctgcttcagcctcccgagtagctgggattacaggtgcctggcaccacgcctggctaattttttttgtatttttagtagagacggggtttcaccatcttggccaggctggtcttgaactcctggcctcgtgatcgacccgccttggcctcccaaagtgctgggattacaggcgtgagccaccgcaccagacccagataactgagttttaacttttaaatgctaaaacaaagtctgtaagtaacattctacaggagtcactaagtagatgacacaaggttataatttaccctgtgatctccttactatttgagttttgagaggatttcacggagagagtaaatattttataccatctttacagattacctgtactcacgaaacctctttgaatggatattatatgaaaatagtaggctgtgttcagtattattagaatcagagtctgtaaatataatttgatctttagtctttcctgtagggcattgtgttataaatgaagcaatgtaatgcgtttcttttctaaaatctagttatttggagggaagtagtgggctagacttttgaaagtgtgggtggcttacatgctgacttattaaggttgttaaagaagttgctgttattcttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggtaagtacaagaaaagtattgtgttgattatcatgcctccttctaatgcaagggttggcaaacaatggcctgtttttgtattacctgtttttgtacttagatacaagctaagaattgtttttatatttttaaatagtggaagaaaaatcaaaataggaataatgtcacataacataaaaattatatgaatttcaaacatcactgtccataaagttttattgcatcacaatcgtgcttattggtttatttatttactacatccgttgtggcactataatggcagagttgagtagttgtgaggagactatagggtctctagaacctaaaatattagctgtctagctctttacagagaaaatttattgactcctggattggcatgatgtttttgagatttgtcgtgtgtcatacatcagtagtttttccctttttattgctaaatagttgtctgttgtgcagatatgccacatttccatttgtcgtttgatggacatttaggtagtttacagtttgaggtcattataaataatgctgctttgaacattcatgtgcaagcctttttgtgaacttgtgttttcatttttctttggtaaatacctaggaatacaaactgtataagtttaactttataagtaactactaaactgtttttcaaagtggctatcccagcagtggcaatgtatgtaggttccagtgcttctacctctttgctaacacttgataatggaactttttatttctagtggatgtgtaatggtatcctgttgtggttttagtttgccctttctaatgagcactctttcaagtattcttggccatttttctactttctttgtaaagtgtctcttcagatctttttcccatttaaattaggttgtttcattagtgttttgtgagaaatctttatgtatacaaatcctttatcagattaatagtgtcttgatgatcagacattttaaaatttaaagacattcaatttaacattttcttttcttctttggtgaatttttttgtgtgtgtgttctctttaagaaactttcgccttccccaaagtttttgtcttactttttctagaaattttagttttcatttgagtagttatatctgtggtccattttgaacagtttttgtgtgcagttgatatagggacccaggttaacttttttctttttctttttagcttccatacatttttttttttttaactacataagtagttatttcagcattatctattgaaaagactttcctttccctgttgttttggtgctttacaaacggctgtgtatatgtggatctatttctggattttattctcttcctttgacctatttgtccttattccaacacaatactctctatttctgtagctttataatgattcttgaaattaggtagtgtgaattctccagttttgcttttctaggaaaattttggcttttctaggtcctttgcatattcataaattttagaatcagcttgccagtttctacaagacagcatcttgggattttgactgggattgcattaaatctgtggatcagtttggagagaattgacatcttgacaatattgagtcttaatccatgaacacagtattcttcattttatttaggtctttaatgtcttagcagtattttatacttgtcaatgtagaggcctttcgtgtcttttgtcaaatatatttataaacattttatgttatttgatgctattgtaaatatttttagttgctttatttaggcataatgaaacactgcatatattttagatacgcagtttgataagttttgacatgtgcatacacttatgtaactgtcactacagtcaagatagtgagtataaccattaccctcaaaagtttccttgaggctccttgtaagtgctccctcccatcacacctccaagtaacctctgattagcattttgttagtatacattaattttttgtagatttgttggattttgtatgcgtatgttcatgttgtttctaaataaagaaaattttatttcttccttcccaatttggatgacttttgtcttttcatttcctttttttctttccattttttttttccttttctttcccctcctctcccctccacttctttctttcccttcttcccttcccttttacctttctttttcctttccttttctcttccctttttctttcccttacccctccttttttcttcccccatcccctttcccccttcacacccaattacaccagctagaacctttaatacaatgttactagaagtggggaagcagaaatcctcttcttattactcattttgctgctcatcttagattgagtctttcctgttaagtttgttgttagcgatagattttttgtaagtgccctttatcaggatgaggaagtttgcattcattacactttgctgagaatttttattacagatggacgttggattttgtcaaatgctgttttcccatctgtagagataaaagtttctcttcatttattcttttaatatggttaattgcctggattgatttttgaatgctaaacagactttatattcctagaataaaccattcttggtcagatgtattatcctgttttatatattggctagtattttgtgtgggaaattttgcgtatatcttaatgtggtattttgttttctaattttttcctgaggatatctttgtcaattgtgttattcggcttatgtcaaactcaaaattagttaaggtattttctcttcctatattttcttaaagagtttatgtacaatttgtattttttttttttttgagacggagttctgctcttgttgcccaggctggagtgcaatggcgccatcttggctcaccgcaatctctgcctcccaggttcaagcgattctcctgccttagcctcccaagtagctgggattacaggcatgcaccaccatgcctggctaattttgtatttttagttgagatggggtttctccatgttggtcaggctggtctcgaactcccgacctcaggtgatccacccgcctcggcctcccaaagtgttgggattacaggcatgagccaccgctcctggcctgatcattttcttaaatgtttgatagaatttactgttaaactactagggcctgaatttttttttttgtggcattattttgtttgaaaatggattcagtttgcttcatagaaattgggttattcagattttctagttatgtctgttttgattaagttgcatttatcaagttgtttcctttttacttttttaaaaaaacattaaaacatttctttaaaattacattttctatgcacatttcttcctcagaaaaagtaacaaggagaatggtacatagtaaaaaaattctgaatacctcatggaattgagcatttgaataatagaatattctagttacttttgatttattctagagttatattttccaatgacttagggcctcattaattatattaggcttttgtggaataaagcctttttataaacttcacgtataaatacaggagatggaggaaattggatcttttttggtgtattttgtttttatttaaatagatttattgagtttttctaacattattaaaagcaggatagtgactgcttagaaattctttatcatctcagattattatgtaaaaagtagccatgttaaggaaaaatggtctctgaaaagccgtatctttcaaaaacacaatgtttttctcctttattttttaaggcaaacagtttcgaatctaaagattatctccaggtttgtcttcgaataagaccatttacacagtcagaaaaagaacttgagtctgaggtttgtgttgaatttaatagaattttaatattttactttcatttaaaatggcaaaatactagtttttatttattgggggtatgttttctagggctgtgtgcatattctggattcacagactgttgtgctgaaagagcctcaatgcatccttggtcggttaagtgaaaaaagctcagggcagatggcacagaaattcagtttttccaaggtaaaactgaagtgtttttgttttttgttttaaagataaagagacttggcttaggctaaattgctatataattgtatataatgaactatacattttatgcttatgcaacttagattttaaggataagactcaaatctcaggtctggaaatatataattggatgtaaagagatcactgtagtgttattaaagttattattactatatttttattaaagttattattaatatatttttaagaaatattcttttcaaaacttaggtgaatacttgattccctggtacagatttctatcttgaaaactttctggtagtaaaactatcaaatgtatttgtgggagtggggatgtggcacctattttaagaatgaatcttttaaatttttaaacagtagtgttgggatggaacacactattaatattaacttgaattttctaaaaagagtttttaaaaaatgtttgcttaggtttttggcccagcaactacacagaaggaattctttcagggttgcattatgcaaccagtaaaagacctcttgaaaggacagagtcgtctgatttttacttacgggctaaccaattcaggaaaaacatatacatttcaaggtaaatattgttttattttggttggaaaggataaggaagcaataataatcactcagtgtttttataatacatacatgtagttatgttgctattacctagtatgcgtttgctctatttttaatagtactagcatattattacgtattgctgtttttttttttttttggcgggggagggacagagtctcactctgttgcccaggctggagtgcagtggtgtgatctcagctcactacaacctctgcctcctgggttcagatgactctcctgcctgagctgctcagcttcccaagtagctgggactacaggcgtgcgccaccatgccaagctagtttttatatttttgtagaaatgggggttcaccattttggccaggctagtctcgaactcctgacctcaggtgatatgcccaccttggccttccaaagtgcttggattacaggcaagagccaccatgcctggccttgctattggcttttaattcaaatttatttaattcatttgtaaaaatactttacccattgatagagatttagatgatgattaaaatccagaaaaagtattgatgtgatacagagaattaagcataaatgaccagaagaaattttatatttcattttacttttatagtttgtgattatgggtggttacaaatcttaatatggttgcattatctgaatgtaaagtttcatgtttacatcagaataatagtcaataaaatgttggtaatactgtgaataacaaagtgatggaaaactgagtaatccttagctatcatttccgtttcagttgttgactcttgcctattggtagtataaaaggagctttaataaacaagtaaagtttcctctttcctagtagactgagagagtataacacaaaaattccttttgcagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggtatggaaatattttagtatgtaaaatatgtataattcctgacttcttataaaccctttagattgtttcaccatatattggaatctggtttgtggtggtagtgttttttgttattatttatgttttcgagaaaaataaagcttaaagtgtgaagacatcttttgtatttatattataccaacagcaagaatgtttaaacaatacaaatgtaaatggttctgaaatcttttttgattgttgtagagccagcattgtgctttttatgtaatgattttttaaaattctgttttttaattgtgaaagtaatatgtacccaaaatttaaaatagggaatgtgagaagtaaaaagtaaaagtttcctttaatttcattcctaaagaaaaaattattaatagattgggaagtattgtttttggaccttttctctctctatataaaatccatatacagagctttctatctgtatatacacaaacatggtcatatatatgatgtgtatatcttcatacctttgtttttatatgtatgatataatttttttttttaaacaaaaaagagatcttactatgcttaccattctatgacttggtatttcatttagcgtatcttaaatctcttcctaccttaaatcatgtgcgttttatctgttatgtctttaacttgtttttttaaattttaaatcagcttttaaaactaagtctccattgatggacatttgtattgtttctgtgttttactattttgaacagtgtttcagtaaagaaacattccattgcaaatatatttggtgctaattttcccaaactcaggccaagattggatatttaataatgtctggtttgataggtgaaaaatggctcacttgagcctactttatatttttttaattgtaaattagttgattagtacatcttagaattttttcctgtgaattgtcacatgttctttgtccatttatctagtattgtatgacttttcttgtttactgatttattaaaatgtatttaaaaaaatgaatacattattaatgtattagtgtatgggttgcaaattttctggcttattgtttgcttctcccctgcccccattgtgtttttcttttttttcttcctttttttagtttttagagacaggatcttgctttgtcatccaggctggagtatagcggtatgatcatagctcactgctgtcttgaactcctgggcacaagtgattctcctgcctcgacctcctctgaatagctggaactacaggggcatgccaccactcctggctgttttgattttttttgtagaaatggggtcttggtatgttgcctaggctggacttgaactcttggcctcaagagatcctcttcccttggccttccaaagtgttgagattacatgtttgagctgccaagcctggcccattgtgtttttcagtattcatctattcagcaaattttattaagtcatctgttttttttccaggcaatattttcagttttgaggacaaatggtactgccctcatggagactgacaataaataaatatgtaatatactgtgaggaggtattgttttatataaggtggtaccatataaacttttaaaaatgaagttatacttgtctgtttattcctcttgtgccttctggattttgtagtatattttcagacattattctattcaaggctgttaaaaactactaattgtttttgtaaatatttttaccctattattattaatgcaaatttttcttttttaaaacatttagaaaccagggttttaaggcagtaaaaagtgtgttaccagtggagttcaaagttgagtctgtgactatggtctctgaaagtagaatagtgttttaacaaaatttatggggattggtggataactccatagccaattcatagaggaaattaaaatcattaataatgaaaaaaatttttcactgggcatggtggttcatgcctgtaatctcagaactttgggagactgaagcaggctgatcacttgaggccaggagttggagactagcctggccaacatggcgaaaccccgtctctattaaaaatacaaaaaattagctgggcatggtgactcacacctgtagtcccagctgcttgggaggctgaggcacaagaattgcttgaacccgggaggtggaggttacagtgagccgagattgcgccactacattccagcctgggtgacagagcaagactctctcaaaaaaaaaaaaaaaaaaattctaacaagttatccagttaaaacatgatactgttttgcctatgaaatgattaaaatgttaaaaaaaaatgagataatgtgctttcatatattgtaaatggttctagaaagcaaattggcaatagtgtgttaagagtgagaacattaaaatattttatatcttttcatccaccaattcacttttaggtgtatactccaaggaaatgggtttatttctatttctaaggaaataataagaatgcagaagaaaatatgtaaagatgtttggcaaaacttggtgaataaattaaatgtttaataataagggaataattaagtcatttcacatgttttatatagccatcaaatgttgtaaacaatttttaattatggggagaaaaagcttacaacataagtgtggggaaaagaatagaagggaaatattttaaaatattaatagtaaccaaccagagtggcaggattatacatgataatattctttttcatagttctctgtatttttccatgaaactatattatttaactaggaaaaattaaagaattcattgaattgagtagatgaaaggttgtgatttggtagtgacttatttggataggtaattaatatcttgattatttaaccttaatgaaaatgtttttttaattttttaaaacaatcttttttttaggttactgtgcataatgatagtgatgatactctttatggtaaggtttcgttgctcacttatctttgatgtatcgattatatgaagtacacttgaaaagcttttaatttttaaatcacttctaatgttttatttttattattaaaaaatttttaggctgggcgcggtggctcatgcctgtaatcccagcactttgggaggctgaggtgggtggatcatgaggtcaagagattgagaccatcctggccaacatgatgaaaccccgtctctactaaaaataaaaaaattacctgggcgtggtggcgcgggcctgtagtcctagctacctgggaggctgaagcaggagaatccttgaactcaggaggtggaggttgcagtgagccgagatcgcgccactgcactccagcctgacaacagagtgaaactgtctcaaaaaaaaaaattttcaccttgtatttatttattttttttctatagacctcttctttggttactaaggatttaatttctataatgacatagtcggtgatacctggaaaatgatacatatttatatgaaatgtcagtcattgtgatgtttcgtttgtattaaatattacagatatcccttttactggttacaattttaatattgaatttgaaagacacttgtttttctttgtcctttacatttaatttctattggttcattaacatattttcaaaaagaaaggaattataagaagttgtctaactttggttaatccacatattatttacatcttcctttgttccaaaaagtttttaacatagatggtcaaaagattaagcatacttggtttttcaagtgtgagaatcgatttgtacttttgtcacgtttttagtcagttgcttactttcgtgattgttttttctttttcttttttttgtaggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaaggtatactaatgaatatttttatcttattgctctgaagttctcttcctgggctttgtgatagctgtaagactaaaacaaatagaaaattgaaaattgtaatgctaattattaacattaagagaagaagataattttgtgctttggaagtatgttttggtatatttattaaacttgaatataaaagggtctattttggtattgtatttgcttgagtatcattaattggatttgtggtgatgggaaaagctgtgtatggttatgttcacgttattctcctgctttgtaacagtgtccaaattttggagctatgaaatgttactattcttccggagtggtttttctaaccttttaaaacaattattcacagtaggaaacacatattaataacatcatgattcagtacctacatgcatgtatatatattcatatgtaatatttacaactcaaaagtttcgttaattatacttttactacaaggaatgcactgtaatattttctatattctttgtcatttctacaaaatgctggccagatgcagtggctcacacctgtaatcccagcactttgggaggctgaggcaggtggatcacttgagctcaggaattcgagacgagcttggtcaacatggcaaaacgccatctctacaaaaaatacaaaaattagcctggcatgatcgtatgcatctgtagtcccagctactcaggaggctgaggcaggaggatcacttgagcctaggaggtcaaggctgtagagagccatgatcacgcctttgcactccaggctgggcaacagagtgaaaccttgtctccaaaataaataaataaataaataaataaataaaaattaaaatactggtcatgattcaataaatctgattttatgattcactaataaattacaatcttcagtgtttaatagctaggtaattttacaggtttaatctgtactgtactttgccactctttttttccctgagtgtctaattctaaggaattgttactgtattcaattttccgtttggcagactctgttgacaaacatttattttgtgtgtttgtgtaatttacattctagaacattgttacaatcttctctggtgtaacctgaaatagctgagttgactccagctaggatgtgttgttagaagaaagatttcattatatgtcactaggaaaagactttcaaagagattacattgtagaacacattctttgtctcaataaattaatatatatcctctttattttttaaagatctacaatggattcaagtatctgattccaaagaagcctatagacttttaaaactaggaataaagcaccagagtgttgccttcacaaaattgaataatgcttccagtagaaggtaaagaataaactctgtaagagtaaactcgaatcaccgatagtattctgtgttaatttaaacacagctaattttacattaaagtgggcagtaggttctctcgtgttaaattcataaggcataaaaaacatttggtatacagaataacactaaacacgtttatcaatactgtttcctgtcctgacagtagatttattaatttataggaaatctctgaggtatttttactctttctttatgtcagtatctaagctcagtatttttggagttggtaataatggtggccttttctctgggtctttctcacttatcccctgaatactatataaatatactcagtgagggtataatctcaaggggttaaggaaggaagttttgatgggattgggggatgagaggcaaaggaaataagtttaagcagtgagataattaaagcaggctttttcttagagaaggagccctgttcccgtagtcagttgggcatgggacaatacaagatccggatctataggtcaaatgtatgctttgctttaggtatgtattcagagtattggctagctgtacataatatcattttaactaatattatcttttcaaacaaaatgtcgctttattataaatgatactattaatagaagttgaactgtcaggatataatttgagggatttagagctaggcaaaaggtgattttaggcatttgggtatgtaagtgacagtagaacactggcttgaaatatttaacagctaattggaaaatgcaatggtggactgtagttatactagggtataaataagattgatttgaatacttgtctctcctatttagaatgcagaaattaaaaatgataagataacatttgatctttgtatttcagtcacagcatattcactgttaaaatattacagattgaagattctgaaatgtctcgtgtaattcgagtcagtgagtaagttgaatattctttaaatttaattatttgtaattgttttgaagaacttttaaagtactttttttttcttaattcagattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtaagtgtttctgaaagtgttattagcatattaaatattacaatatttaaactttcaacttttttgtttttagaaagttcttttttgatttttaaactgcttcttatgtaatgactgtgtatagattgtgattcaagtacttaagagatcttggattaaagacaatgatagaaatgtcagttgatgccagtaactcatcaggtaaagtcagtattttccatggcaaatctataccaatagacactgtaaatgagaagcttctaatgctggtttaggatctaaaaccactttattcttattaatgcattgtgtgtggttctagatgcaatagatttttacattaattagcattttaggctgagtaaatataaatcagccttcaccatttctatttagggtgtttcatgacatctcttatatacttgctctatactagggaacataacccagttaaatgtggttttctttataatttacatagtgggttattgttagtaagtagcagcagttaaaacaaacagccaggcatggtggcttatgcctgtaatcccagcacttttggaggccgaggcaggaggattgcttgagcccaggagttcaagaccagcctcatctctactaaaaataaaaataaaaaaattaaccaggtgtggtggcaggcacctgtaatccctgctaccctggaggcagaggcgagaggatcgcttgagcctaagatgttgaggctacagtgagctctgattgtgccactgtactccagtctgggcaaccgagctagaccctgtctcaaaacagaaacaaaaacaaaaacaaacaagaaaagataaaaagaaaactgagaaggactattacatctgaaactaatcactaccctaaagtttaatttcatgataggtggcttaattatttctttgtaaaatgtctcagcaccctgatttcatgagatgttttttaacttacaatgttttctgaaaattttttctgtaggtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtaaatatttattttattaagcctcttattattagaatattaacagtttttcttgaaataaatattttttacttaatactgtaagcctaggaaataattgaaaattaaaaaggtaaatatttaaccaagtaggaagacatgagaaaggattgaaagttgcccatgctaggattaaaatgacctttagtaataagaattagtaataaacatcagttataaattaatgagtatttttggaatgaattgtctgctctgccattcatcttgttcatttggtacttctgggtgattggaaaaccctctgctaagattaatactgaacacttagcccaggaagatagatttttcctctagtttacatgtgtaagtagcttttttcctatcagaatgttcttttagggatggtgattcctgtttgtatgtttgtttgaatagtttttccttaacacttgagtgttcatttgacttaaatttataaaataatcattttctagtggacagttcttgtcttttctgttttaaaagtcacattgaatattttaacaggtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagagtatgtattaagaactcatacttctatgcttgtcttcttattctgaagttaaggttaaatcttaaggctctctctcttcagtttttttcaacagtacactgaagtttttgtgttcaactttatattttgaaaaatttcaaacctatagaaagactagtacaatgaatactcatttatccttcacctggattctccacttaccattttatgagtatgtgaatacacatcttttggtctgtacaatttgaaaataagatccagacataatgacaccttacatctaaatatttgaacatatttttctaagaacatgggcattttcatcatgatcacaagaccatgaaattttcatacccaaaaaatttaatattgatacactaatataacctcgtatactgtttgtattgagagttccccagtgttccaaatatgttctttatagccactttgtttttgtctacagccagagttaacacattgcttttgattattgtgtttctttaatcatttctaatctagcactgacatttttgaaaagtgggtcctagttttctcatagaatacctgcaatttagatttgtttgattatttcttcatgatttaggtttaatacattagggaagctttttatgtaggttaagttgtaaattttccattgcatcacaccaagagccacatgatgtctgatttttccattcttagagatgctaagttttgctcacttggttaagataacagtatttcagatctgtattgcaaaaccatattatctgtggggtgttacttatagaccatgtgagtatcctttcactaagtgattttatgtattccatcagacctttattttgcagtctcaagtacaagtgttaaaaatatctaccaagtacctatgatcccatatcttcaaaaacactaattgtttgtcgtcttgttattatgataaataaataagatttaacggttgtttttttagcttctgtccaattatagtatttatttatttatttatttatttttgagagagggtcttgccctgttgcccaggctagagtgcaatggcacgatctcggcttactgcaacctctgcctcctgggttcaagcgattctcctgcctcagcctcctgagtagctgggagtataggcatgcgtaaccatacccagttaagttttttttgtatctttagtagagatggggtttcaccatgttggccaggctggtctcgaactcctgaccttgcgattgcccgcctcggcctcccaaagtgctgggattataggcatgagccaccttacctggccacctattcccatctttaattggccataactccgtgagtatagatggagtcctcttaccagtgtcctacaaacactagtagacctgtgttcatgggtgtgctttaatggtgttgacacatcacacatcacagtactcttctggattgcagaagtataagtagaacgatgatgtattaggctaaatactctcattttaataatttaccttcatgtccctgaaagcaattattgaacatatgtttggaaacaagaatgatagcttcagatgtagtacaagtcccactttatctggtcactatgtgattagaccgtgttacttgggcttctgtaatgtattaaatagtacctcctcagtgacgaaaggagcctttaatagtctagtttggctggtgcagtggctcacacctgtaattcgagcactttgggaagctgaggtaggaggattgcttgagctcaggagttcaaaactagcctgggcaacatagtgagaccccatctctacaaaaaagtaaaattagttaggcatgatgatgcacaggtgtagtcccagctacttgggaggctgcagtgggaagattgcttgagcccaggatttctaggcagcagtgagccatcactgcactactgcactctggcctgggtgacagagtgagaccttgtcttaaaaacaaagaaacaaaccaaaaaacccagtttttttttttcatttcaaagttgaaatttttgtataatgttggttagtaaaatttctgaaattactagagaaaaatatttaatgctatagtttatgatggattatatagtataaatgcttatcatataagattgactaaatattttaaggaaattcatcaaaatgtctaatatttgacatttaaaaatcaatatgattaggtgttggcatgctttatttttttcttctagagacaaagtcttgctctgttacctaggctggagtgcaatagtgtagttatggctcactgcagcttcgaaatcctgggctcaagtgatcctcttgcctcagtctcctgagtagctgggaccacagatgcatgccaccacccctaactaatttttaaaaatgttttgtagacatgaggccttgctctattgcccaggctgatcttgaacccttgggctcaggcaatcctcctgccttgcaaagcgctgggattacagatgtgagtcaatgtgcccagccctttcttgacattttaattaaaggattgggacttttaaaaaccattataaaataccttggtattagcatacatatacttaaattcgtttagctgtaatagccagcctaaattttttcagcaaaaactttatcagatgctaacaatgataaaacctaattattgaaaactattaaacttcccgccaggcgcggtggctcatgcctgtaatcccagcactttgggaggccaaggtgggtggatcatgaggttgagagattaagaccatcctggctaacacggtgaaaccctgtctctactaaaaatacaaaaaattagccaggcgtggtttctggcgcctgtagtcccagctactcgggaggttgaggcaggagaatggcgtgaacctggggggcggaggttgcagtgagccgagatcgagccactgcactccagcctgggcgacagagtgagactccgtctcaaaaaaaataaataaataaaataaacaaacttcccaaggtttttccacattcattctgatgtctccttcaatagttattatttattgttttactcagaaagtatgtagtttaaaattattaaaatagtattatgtatttatagtagagtgaaaaagaaaatctaaatataaagatctctcaaatctaccatgaatgttaatggatttttattatatattactgttttgtaacctggtattctttatataaaaataaattgtgaaaagtatgaattattaatataggttatcattgattacggtagtttatggtagtaccataattaaaccaatcctttaacattggttgagttgggttcactttttcattatttaaacacaactaccatcacaaaacaacaacactgtgatcagcattcatacaaccagaacatggggttatattataattattttcagtataaattcttggaggcagagtttcaaagtctggatagctgtagaactattttcaaatataaagttgagacattggaagatctgtagcttagagtttattgtttaatttgttgttgagtaactttaaatagaaacattaaaaagaatatgtagctgtttccttaatgctacaatttatgttatgaatgtataatggtcatgttaagtgttttatttattgctttatttatatattgcacatttttcatgattatgtatgtgtttcaaaggctatagaattgctgttgacatctggatagttataaaagcctaatataagtttatgtaacatctttatttgacagattagtaagtgggtgttcttagcaacttctctggtgtatgcaatccttgggctttagacttttacaggccacttttaaactcaacctttagcatttaccagagatctgatccttatgcttcccacctgtgaaatatggatgataccaagctcacagaaagttgtggattaaatgaagcaaatatggaactccccagagtagttcttgatagataataaatgcactaattaactttacttattttcttagtatagctaaacagtgagacgagttaccaaaggtctatttctaaaatgtggaaaggccaacctgatttttcagttaacaaatctttgcaaacatataattttcagtgagaacattatcactattaaaaaggacacagaattacaattgactaaatgtaaagttttattttttgaacagttggacggtatttctcttgggatatatttattcttttataagaattttatcatttacatgtaatagaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaagtaagttatttatttcatgtccaggtaaaaattgagaattttatttagttttttagtttttttttttacttagtttactttttatattaggtggcttctgaattctgatctctttatacaagcttgaaaatagctgttactggtctggtgcggtggctcacgcctgtaatcccagcattttgggaggcctaggcaggcggatcactgaaggtcaggaggtcgagatcagcctggccaacatggtgaaacctcgtctgtactaaaaatagaaaaattagctgggcgtactggcatgttcctgaagtcccagctgctttcaggaggctgaggcacgagaatctcttgaacctgggaggtgtaggttgcagtgagctgagattgtgtcactgcactccagcctgggcgacagagtgagactcttgtctcagagaagaaaaaaaagaatatagctgtaactaatcccatgcatggttatttaaattttctctcttttttaaatttaaattttaattttttgagatggagtcttgtgctgtcacccaggctggtattgagtggtgcgatcttggctcacggcaacctgcacctcctgggttcaagcaattcttctgccttagcctctcctgccttagcctcctgagtagctgggattacaggcacacaccaccacgcccagctaatttttgtgtttttagtagagacggtgttgctgtgttggccaggctggtttcaaactcctggcctgaagtgatccacccgcctccgcctcccaaattgctgggattacaggcgtgaaccactgtacctggactaaattttcttttaatctagaatatacttaaacttagatgtttaaaacaaaaacacaaagtagttcgttttctgtttcttaatgggattaatttgtattttgaagggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagtatgttaattgaagtatttaaaaatatccagtgaggttttggtaccagggtttagtgtaccacatcaatgatgagaaacaccaagatagtttagaattaaaacaatgctttgtgtgtagctttattataattaggcatgtttttttagaagtgtaaggcaccaagaatttaaatataatgattggttttgaaaaatttatacctctgttatatatatatatatcttattttggtattgcttgaatcattgtgttgtaggcagatagattcttttttgagatttgtcttacttaacatttttaaataaaaagaattttaaaggtgtaagagacctaagacgtcatttacttgctgttctgattaaaacaaaaatgtttatgtataaaaagggttgcccttgccgggcaactaccgtttcttactcttttaaaattttatttgtttatttatttattatagttttagagttagggtcttgccgtgttacccaggctgatcttgaattcctggcttcaagcagtcctcctgcccagcctcccaggtggctgagattacaggtgcacgccactgtgctcagcttattctctacttgtaatataagaaaaattatccttttctgctgcttccactgaagctgaaattgatcagttttttgggggagttggtttttttttgtttttgtttagttttttaatcactcagttcaagtgcctgtgacagtgatgtccagacgtctgctgtcaagcaaaccttatgtatccttgacgtggtttgggattgactgagttgtgaaaatgtaggtttgtttcatgcactatcccaacaaaaccttttaagtctcattatataattgaaagtatacctgaactaggtaatcataattgttctataatgacttgtcacagtttgtaacattgtttttatgcgaaaatatgcctcatggtccatacagcagaaaataaataatggaacacaggtttttcataattggagttgcttctatataatttattttaaagaatttcaagtgatgaattttttgcttttttaaaaactgtctaaattagatggtaccacatgtaaagggtgaaccctactgttaatattaggcatgtggtttttgctatttttaggaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatggtaagtggatacattttacttttatttagatattgtaaacacataaaaagtactcttggtaagtataagagatttatgtagctcatttaccgtagtgaccagaaaattctttcatctaggtaacatattttaatattttaccatttgtatgactttgtagtaatttactactaaaaatattttttgacttccatttattttagaccaatattattagaaaatgagcttctcaacaaaaaaagtcaaaacaagtgttaactttatgagtaaagctgtaaattttgttatatatatatattttttatgacagcgtctcgctctgtcaccaaggctggagtcagtagtggcatcacagctcactgcagccttctactcctgggctcaattactcctcttgcctcagcttcctgaatacttgggaccacaagtgtgcactaccacagcggctgcattttttttttttcttttttgtagagatgggatcttgctatgctgcccagattggtcttgaactcctaggctcaagtgatactgcctgcctcggcctcccaaagtgctgggattacaggcatgagccgtgctgtgcctggccttgttctatattctttataaattcttgcagtatagaagattcactgttgggatagagtgactactgtggagtggtttaaagtaatttgttagtttgatgcttcattctaactaggagggcattttctttttctgtcttcccccccccttttttttttaaagacagggtctcactctgtcacccaggctggagcgcagaggcatgatcatggctcactgcagttttccacctcctgggctcaagtgatccttccaccttagtctcctgagtagcttggactacagacatgtgccaccatgctgagggcattttatatacataaatagaattgtttgtaatatctgcattttaagaattagttgcaataactgctctgcccttttttgtgtgaaacaaatgggtagaaaataacacgtaagtggtgcctttgcattatgaaatgtacttaaaaagcactagctccttttcttctctgatgctatgccagttctttactatttagcatatgccacctatttttatcctgagttttagaagtggctttttctgaaacattaccctgttgtggttgaattagcagatttttttttaatgagtagggtgtgcttctagtgctatcaaaatcctttttattgaatgtaacagtaaagtgtcactagagcagcatatgtttcatagttattcagtgatacatatttttagatgcttagatatttattttcaatgttctttattttttcagaatcagattcattgattcaagagcttgagacatctaataaggtaatgctttaagttttattttgtcttgataaggtatttaattaacaaaggggtatgaatgatgactagatttgtttattttaaaaaataattaaacagtaatatagtctcttggtatgcatgggggattggttttattctgttattttttctgttcttctttggcttgagtcttcttatttcaacttgtatttatcctttcaaaaagctgaatattttaaaatatgatcagatataaataattcaagatcttggtatctaatatccagtatttaaagaacaaaaatgtacttagaagacattacacctactgtttatacaattcctatcttttcttgtattttttctacttatgaaaatagtagacactagttgtaccaattaccttaagctatataaatagaaaataaaaaatttcccataatgttcttcctaaatttaaaacaaaaccaaaccaacttgtttggaagctctttagactgttactttatgtatgtatttatagaacacttaccatttaccagatactccttcaagtgctttttattaactcatttaaatgttagagcaactttatgatgtaacttgcccagggtgacatagtttttttagttttatttatttattgtttttgaaatggagtctcactctgttgcccaggctggagtgcagtggcatggctcactgcagcctacgtttcctgggttcaagtgattctcctgcctcagcctcccaagtagttagggttacaggtggccaccacccccggctgatttttgtatttttcagtggagacgggctttcacgatgttggccaggctggtctcaaactcctgacttcaggtaatctccccaccaggtaatttggcctcccaaagtgctgggattacaggcatgagccactgtgcctggcccagggtgacatattaaaagggatagcagctaggatttgagcccaggcagtctggctccaaattcctcttatatgctatatagcttcttttttctttgtgtgtgtgtgtgtgtgtgtgtgtgtgtgtgtgtgtgtgtgtatgtaatttttttaaaggcaaaaataagatcatgctgtgcatagtgtgttgccactgattagctttatttaactttaaaatttgaaggaattataaaactgtttgcattattaatcatatttgcattctagttatcctaaagtatattcatgaaacattgctttttcttctttccaaagaaaataattacacagaatcaaagaattaaagaattgataaatataattgatcaaaaagaagatactatcaacgaatttcagaacctaaagtctcatatggaaaacacatttaaatgcaatgtaagaatttaaccttgtgttatattaataaattagataagcatatgttttggttgaaaggaaataatttaaaatagcttatgcaactaagactaatttattgagaatgttgaattgcttatgcaacattgaactcaatttactgttttccaaatctgaatttttgagaacttagacgagggtgtttgacttctttgaacatacttttccacaagatacgctggcagtgctttgcatgtaaaaaggaggagaatatgtagcctttggacgtttaagcctcagctagttggaaggggagctttgaggagaaaggaatttaggtgtacttagaaaaccagattataatgtttcagggaactataacatgaaattcagtaaaattaggtttttccttagaagcttgtttttattatatgtattgttgctattgtttatatgcttaatagcaaggatattttttctaaaaagttatacactgtgacatgtaaagacttaaagggttgtctttcatacaaatttagataatttcatattcagttcagcttagaatgatcagcttgtcttttaatccatgtcttttaaaatggcttttggttttctttttttggggtaagctccttcaaattattcttttatttagaaatggtaaaatatatggtaataatgtagtaagctgagtaaacttagagccaaacatcttgctttgttgaaaggtgcttttttatgtcttttctatgaccaaaagaagcaggcgtggtatcttataaaaagtgactgttgagtttcctttgtatcttgatagtcaaactctaatacccaccaacattccctgattcatctgaactttagatgggcatttgataccacaggggtaaatgaggagcattctagaagagcactctgtctaatctcctatagtaggcctttcttttggtatttattagatacatgattcattctctggtttttctgtacctgaactgggagaaatatcctaatatttaatatgttaataataaactatttagtaataattagtatttaataaggtggaggagcaagaaacacttgtggagtgtccaacgtgtgccaggtactatgctagattattggaattatacagattaataaaatctactaccctaacaatcccccaataagaaaaaaacaacataaatatagttataatacaatgtgcagtcgtagtcaatgtgtgaagctgtgagtgggtggggagttaggaatactttgtggagatgaaaatgattaagttgagccttaaagggtgagtaaaatttagccttttgaaggtagaggaaggggacagtggtagtcaggagagacaagaaggtacattggccttccatgtaccagaatcagagtgcacaaagtcatggaaatgagaaatctttcagtgagtgcaggaaaatacaaacaatttgttgtttaggaagaaagtttgaagcaaggagaggtgagaaatgaggctaggagtagtagaataggataagatgaaagaccttgaatactgcattaaagagtttggggagtcagtgggggagtcattttcaccagaggaatagcaaagaggagtttttcatttgagtagatatttttggaaacttggaagataggattgagatggaattagactacaggcagagagaccagatagctacctcttggaagagttcagctaatagttgatgaggacttcgatttacggtagtagtagtagagattaaggaagaggaaattgatttgtgaagtaaggggatgttaaaattttgagacttggggcagtaaattaattgctgggcctcctggctctcgaaacttttatttggttagtcatcacatgctttttgctctcatctcttgatctggattttaagtctgttctttgatttggtaaataaaaacaaaaaggaaagtcagagacaggtcatttctggtgactacaacttcaaagaaaatagttggaaatttcacatgggattatatttattgctgtagtgtgtttgcataccataatatattagcaatatttaaggaagtgatagtaaaaaaatcaatatttgtaaattagttagtccttgcttgtaaataaactttatagattctagatcttgttttatcaactaacttaatacagtgtgctaaatttaaattgttcacttaaatacatacaaatatacaaagtagtttggaacttacctaattgtcctgattaacagttgatctagggtcactgttccacatcttgtcttgagcgcaaactctttccaataatgaaaaaatttagtttgaattctttgctttttctacccaagcataccctgggagcagaaaaccctcctttcaataactataacttctgaaggatagatttttggtgaggattgtatattttgaagcggggaaaaatgacgggatcattctgataggtaccaaggatcggggaaggaacaacttggacttgttatggagctgtgtcagaggtgtgatctgcctgtcccatgattttgtcatttatcagtgacactaagggactaattgtgagaaagcgtggagattgttctttatgacatcctttgtttagagatactagaaaaactttgccttttttcttaaataacccattactttatgactttaaaaggttatttttatctgtatttcctgctaatacaatgtttgctgattaagcggcactctatcatacactttgttttttcaaattgattgctacaagtttctgccttcaccatacatttgattactctatagacttgcgcttaaatgctgagttttacccttcttctaaatccatattataccctttttttggaagttccccccctctctcagctcccccactttctttctttttagaggtagggtctcatcactctgttgcccaggctgaagtgcagtgatgtgaccatggctcactgcagccttgaactgctgggctcaagagatcccattgccttagccttccgagtagctgggactgcaggcatggaccacaacacctggaattttaattttttgtagagacgggttctcactgtgtggcccaggctggtctcaaactcctgggcttgagtaatcctccggcctcagcctcccaaagtgctgggattacaggcaggagcccctgtgcttggttgctactagccttttcaagggaggcagtctgccttaaaaaaaaaaaaagtctaaatgacgtatctagaagctcagtttcaaagctgtctgtaggctgtatatctttgaatatatatcgacttaaagctaagggcaaaactatttttctaggagttgttaatgtttaagacaatactaatctttaagaggctttggctacaaaacaaaataaatagttgagttcatatttttcttttcaaagcacatttctgatgtgacttcagagatttatcttcttaagattctccagttatccccaaatgttacttatttgctagagccatcagttattttaggacgaaacttaagaaataacttagaaaatgtctcaacaaatttgaaaataaaatttttatggtacaccattgaaagtaatttatgtgatttgtacattttttgtagctttctatatgtgaattatttttaacttattttgctttaggacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaaggtactacttcagctgccagcagcaggcgtttaagaaagctaatttctaaaccagtaaatagaacaaggcaaacagaggggcattcacttgtctaaggaaaaatcttgagaaaatctaaacgtcttgaatttttattctggaaagttatacattttctagggatgggcatagttaaagcttttatcttaataaatatgcttttagaaattgtgcttttattatttctttcgcagtctatgtaataatttctgtgcttataatagttaaaactcattactttgattttataaatatagtattttctgcctaaatcccagcacattattttgttttctttgtttgcattctttattcatttggagaaaaggatattttacagtaagactttgagctaaatattattaataataaatgtattcaagctgtatttgtgataccaggagacagtctgatgaaagataatacatgttgaagattattttttaaaaaatctttaatagtaactgggcaagtttgttgtaaatataaagaagggcaaacctttgaattttagaggaggtagactctttagaataaactgaaaatcttgaggaaataaataggaaaatgtaaattgcaaacataagaaacgcttcaaaaagaaactcagcagcttttaagaaaatacagcaggcataatgccttattttaccccttcctctttgaggctggacagtgtaaattatacataataaaaccttgtccactgagcttttaaaattagtctgtattgaagaaaagagatcttggaatcctgtaatgaaattgcacaattacagcttcccaagaacatttagacaattgagtgaaacaaaaaagaacatgcattgcatttgagaaatgaagacttaacaaatacaggttgttttttgtatatacagtatcgaaggcaaaactagataaattctagatgggacagggaggtaagattcccatattatatagtgattcttgggtgggggcatattctcactgggggaaatcagtatcttgagagagctaggggattttaatttatcaaaaggggtcataggccgggcgtggtggctcatgcctgtaatcctagcactttgggaggccgaggtgggtggattccctgaggtcaggagtttgagaccagcctgaccaacgtgatgaaaccccatctctactaaaattacaaaaaattagcctggtgtggtggtgcatgcctgtaatcccagctacttgggaagctgaggcaggagaattacttgaatctgggaggcaaagactgcagtgagccaagattgcgccattgcactccagccagggcaacaagagtgaaactgtgtctaaaaaaatgaaagtggtggtggggggtcatagtattaaaaaaccttgagaacaaacaatcacataagttttttcttctccacattatggtagtacctgagggacctttcataaatgctttggcttttcctttattttgctcataacttcaactgtgattagtatatatggaaatgagtatagaaactcatttgtatatggcatggcagatttcaatttaatgagctttgtaatgatctcaaaagtgctgccttcttcatcgaacagattcattacatgtgcatcccatgggctatcatctcacaactaggatgcacaagagcctgtgagaggcaggctaaaacttaatgggtttgaatttcataactacaagaggtttgacgtttggctcttaaggaacaattacatgcagcagtgctgtcagttaagggctttgtaatgtaacaaactgatatgttaagatcccaaaggtattacagaagtcactgtcaacttctagaaattttcaaaaataataccccagaacactaattctcaaaacgttgcatgtaaaatacatcccagacttaccaaatcactatctttggtatttggtgccaggaatctgcattttaataaggtccctggataattcctcccaataaaactagaaaatcactcttgtgtaaataaatgtttttcagtgttaaagagagaacattaaaattttaaacataaagttaccataaagtaacaaaattaatgtaactggaatatgtcagattcatgaatttacatatatctagaagcagaataaattattattgcaaaaatcacaaagattatttgttttctataccatgatatgtcttagagatagaaaagaagaacatatgtggtatagttaagtttcaaaaatattacatttaggattattattctatttaggtttattgttcgtgatgagtgagatatagggagtctgccatcaaggagcttaaaatctagtagatgagagagacaaacatatttcaataaaatataaagagctgagatgcataggataatattcgggactcattaaaaagaaaaatgtaccatatactttttagagtcaattagataccaatggaaagtagtaagtgtctttttttttttttttttttttgagacagagtcttcctctgtcaccaggctggagtgcagtggcatgatcttggctcactgtaacctccgtctcctgggttcaagccattctcctggctcagcctcccgactagctgggattacaggcgcccaccaccacacccatctaatttttttgtgtttttagtagagacagggtttcaccatgttggccaggatggtctcgatctcctgacctcgtgatccacccgcctctgcctcccaaagtgctgggattacaggcgtgagccaccgtgcccggccagaaagtagtaggtttcttaactagaaggatttcaagccaaacctacattataattgtcttctgctcttatagattagtaacccttgtacttcatattatatctgggatcattaaacaagaagaatttgattcttacatagtgaggatatcacataaaaatacaggttaattaaacagaaatggtcagtgagggagtgaatggcggtcagaagaacatatggaattgattgtattagagcaaagtcgtgtagaaaattcacataaaaattgtaccagaacaatgttgtaaagtctacttgcaaacatcatataaacatcaaaccatgaagtataacaaaacaggaaaaaatttctaaaaacgaagagtcagattctggcctgttttgaagtaaggtttcgaggatctgagacactcatctgacccttaatggaaattgtatgaaatataaaaagatatgtagatataaatttatatatctagaagattgttaattatatttcaagatttaatcatggaatctatgaggaaagtttaaaagaatataatttatactgggcacttacgtggggtgagtttatttgtcagagtgaacttatgaattaaattgtagctaatagtgtatctgttctgggtataatttgatctgtactgattataatggctaaagttcttacatgtatacaacatttatgtagtcatttaacttacattacgtattaactcattttagtctcttagcattattctgtagagtaagttgggcaggtaagggtatctttattctagcaatatacatattaagcctgaaaaaggcaaacttttatgcattttcaattagttgaatccttctgtacagattttcaggttctattaatagttaaatctatccaatgcacagtgtcgtcaacccatttgtcatcttgatcttcacaactttgagataggtggtattattcctatatcacatttgaggaaacagtcgtagtatgaagcagtttattaatggttacagctagtaaggctatattatatgaattcccaaagttttaacatgtcccttctaattttagctatgaaaatttaagatactccatttgcctattgctaatatagtaaaagccacaatataattgtagcttaaaactgttcgttaggatatggaatgtctgcctagggtttctcgtcatctcctcctctctgtcccatattgaaatgacaataaagatttgtggtacaaaatttaaataatactgaaagttagaaatagctggtaatgctactcagaggtaggtagctgccatcattttggtgtacttcctttgctaactttgtattaccttgtgaaataataatttttacataaatgggctcataccacatgttttaaaacctgttttttctttttttctcaacagcttatttcattttttttttttaattagaagtttacttttacatgttttgtatgtttgaatattggcttatatggtgactttttggttttattaaggtttgccagattaataacaattttcttatttttaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaatgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaagtaagctaaatgttattcaaaatattttaaaatacacaaagcattcattttgctatgcagctttaaaaaagttagatagtcatacttaatctggtaaagcgtagcatgtatgatgagtgaagaacttgaactttgtccatataaacctttggaccataggttatgtgaaaagatcagcttataaaaatcatatgaaatattttctgaagaactcattcatagtttggatattccaaatttgtgaaaagatataattttgtaaagattgttaccatttcacatgtatggtcctaagcagttaatgatgcattaccatagaaaagtggtttatgttttttagattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtaggttatttgaaaagttatgtggccagtttatgataaagattgttttccttatatatcaaacttagacattaatcttaggattgaatagaacatttatccactttataatttttcttaaaattacaagaacagttacttcacgagagaaaatttagctgatttaaacaagctgaagaatgtccaacattaagagaaatatgtaccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactccttcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttaccaaataatacttaaatgtgtaaggtctgacaaatattaatacaacaaatgctgtttctaccactataaaagtgactactgaatgttgtgtttatctaaactttaaaaaatataatttaaccatattttttaatctctaaacagtattttcttctcaaacttttatttttcacatcatatttctgagattgattttgtacagtcgtaattaatcattttcacctctgtatagtattctgttgtgtgacttagcgcaatttatttagtctcttgttgatgaccatttagattgtttattattttttgcccatagccataatgcaaatatcttctatatgctcttggtacacatatgcaaaagtttatataccaagtggggaattactgtgttagaggatatgaagtgttatctcatggtagttttaatttgcattcttttgattgctaatgaagtacagcttctattcatatttttatttctatttgtctatcccagtttctgctctgttgaagtcatttgttcattttaattgtgctgtctttttttttttttttttaaagtatgtagtttttatttttacttatttaaaaaaaatttactggtttattataaaggatacaactcaagaacagacaaatagaagggatacacaggacagattaagggggacagagggtggtgcagagcttctgtgccctctctgggtgtaccaccctcctaagacctcagtgtgctcaccaagtgggacactctctgaacctcactgtacaatagttctcatgactcaatctccaaccctcctctcttccacagagtttggtgggtgggactgaaatttccaactctaatcatttttggtcttttggtgagtagccctacccttaagctatttcaaaggagcctccactcaaagctatttcattagcataaattcaggtgtgattaaaagggggctcttttttctaagtttatttattttgttttgggacagggtcttactctgtcacccaatctggagtgcagtggcgtgatcatagctcactgtaactttgaactcctgggctcaagtgatcctcccatctcagcctccctagtagctgagactacaggtgtgccaccatgccctagctccttttaaatttattgtattgttaaagtcttttttattgctacttatagaggtatctcttttcaagtatagatagcagtccccagcctttttggtaccagtgattggttttgtggaagacaatttttccatggaccagggtaggggctggctgctttaaggatgattcaaacacattacagttattgtgcactttatattattattacattgtaatatataatgaagcaattatacaattcaccataatgtagaatcagtgggagccctgagcttgttttcctacaactagacggtcccatctgggggtgatgggagacagtggcagatcagcaggcattagattctcataaggaatgcacaacctaggttcattgcatgcagagttcacaatagggtttgcactcctatgagaatctaatgcctctgttgatctgacagtaggcggagctcaggcggtaatgtgagtgatggggagtggctgtaaatacagatgaagcttcactcccttgtctgccgctcacctcctgctgtgtggcccagttcctaacaagctatggatcagtatttgtctgtggccaggtggttgaggctccctcctcatatagatgactatttaacattactctaatgatgggtattaaaagtattttctatttctcaaatgtgtagttttaaagcaaataataataattatagcaatttaatctaggccagctgctatgctgagttgacatattatcttaatcctcacacaatatcgggtatagacactgtttttaacttccattttgttgataagaaaacagacattgagggatacagtagtctccctttactggcagttttgctttctgtggtttcagttacctgtggccaaccatgagctgaaaatactaaatagaaattccaggaataaacagttcaattgcaggtcattctgagtagtgggtcaaaagcttgtgccatcctgtcctgcctggagttagaattatccctttgcctagcatatccacattgttagtgctacctattaatcacttagtcatctcaattatcagatcacgtgtcatggtatcagggacagtgtttgtgttcaagtaacttttattttacttaataatggtctcaacatgcaaaagtagtgatgctggcaattcagataagccaaaatgttgttgtaaagggcttcctttaaatgaaaaggtaaaagttcttaacttaataaataaagaaaaaaaattgtaatctgaggttgctaagatctatggtaagaacaaatcttccatctgtgaaattgcgaagaagaaaaaagaaatttatgttagttttgctggtgcacctcactgcaaaagttatggccacaattcatgataattgcttagctaagatggaaaaagcattaaatttgtgggtggaggatgcaaacagaagtgtgtttcgattgatggtgtctgggttcaatactgtccactggggatcttgaaatactatccaatgtttcaggtatccactggcgatcttgaaacatatcccctgtggataagggggaacttgtccttgtctaagttcacttgtcttagtcttaataagacttgtctaagttcactcagtagtaagtgctagagccagaatggaaaccgaggcagtccttacatgcatctttgtgcagcacatagcctctattattgttagttatatagttgatgaagatggtgtttattacttgaagcctcatttttttaaacaaaattagcaaatattatgaatatgtgattatcatgtatgtattattggaacataaagcttaaaacaatgtaagaatcctctgaaaccataccactctgagctactataataagggcatcttcaagcctttttttttttttttttttgggcggagtctcactctgttgcccaggctggagtgcagtggcgtgatctcggctcactgcaacctccacctcccgggttcaagcaattcttctgcctcagtctcccgagtagctgggactacaggcacgtgccaccatgcccggctaatgttttttgtatttttagtagagatggggtttcactgtgttagccaggatggtctcgatctcctgacctcgtgatccacttgcctccgcctcccagagtgctggtattacaggcatgagccaccatgcccggccttctctatgctttttatggggcatcttttcatttaatttccttccgtttttgagctctctagcgagtgtgaaaatggagttttggcagtaaagctccacaagggaatagaagagaaggctctgctgccagttagataacttccctctggaaatcctggcaagatgtactgaaaggtttcagagggggttggtatgatggaaactagtataaggatgtacctatattagcttttttgggtgagaaattaatatatatattagtccatagtacctcgatttccctacgtttatggcattagattaccggcaacagcagaaatcaattgaccttcacttgcgtgggtaccttttgattttgtgattgttccattttcttccctgcatgtcattattagcttttaaagtttttcttgtattcctggattatattactcaataaactttggaaatttgaatcagtatttttctctcagaatatctttattgatttttccttggtaattatttccctattatgtatagatgttatgataattcttttttgagagaacttaaaaagtttgagattcttaaataatggaacaagaaattgagtttttcatatgcattcttcattagagtattaaaacattttctaataatttgaagctatagtgtgtttgatttgtagtatattaaaatctgtcatttttcttttaggctgtaaaggatgtgaatctttgaacatagttgccatgaatcttaaataacaaaaagcagttagtatttttaaaatattccatttgttttataaacattattttgtaggtatctgtaatgcgtgatgaggataaattactgaggattaaaattaatgaactggagaaaaagaaaaaccagtgttctcaggaattagatatgaaacagcgaaccattcagcaactcaaggtaaacagttttgtttttaaagatgatttaaatgcattctcttggtatattttagtgtacaaaaaggtacaaatttgtttttaataacatcctgttttgactttttctagaatctagaaataaattatttaaaattaaataggcaaaaaagaaaaaaaaaagataaaattaagtaggccagtagtgactctcttctaatgaatagactatggaaaagaaaaaataataacttcatagtgaagaaacctagcagataccactttaaccaagtgtttaagaataacattaccattagtcatattgatgctgtgtgcttcctggtttgatgtgaccagaaaggcacataccctctttggtattctttccctaaatttataacctcagactcttcacgaaaaaacattagacaaacccaaatggaggatgttatacttactgcttcaccagtatgaagtataaagtgtcagggtcattaaagacaagtaaagactggtgaatgatggtgaagtctggagtgtaattaatagtagtataccaatgttaatttcttgatttttgataaatgtaccatggtagtgtaatatgataacattaagggaagctaaattctttggaactcttgcaaagctaaaattattttgaaataaaatgcaaaaaaacaaaaagagttgaggtcttacagcaaattccttttaaaaatgatatttaaaaggcaaaatccctttattgtatatggttattttttgcttgatatcaaccaaatggatgaggcaacaataaaaaaaatacatttgttatattattttcatgtttgcttttaaatgaagcaaactaatgaatagtcaggtataaatacatgattttaattcttaaggtaatcataataaagcattctataacaataggattcgagatctccatattccataatgattcactcttaagacttacaaagtgatgagatagtggtgacattagatgagattgggggtgaagtttggattacatgataagttacaattagaactgtaggatatctggtccccataatttaatcttgcctcttaaggcttatttttttccaatcttgcagctactttctaggtaaaaggggtggagagctcttttttccttcattttgagtttaagtttaccagtgaggaagcttttaatggtttttcttgttccttctatgttaaatacacagtagaacttcattttcccttgtttctgctttttgtggtttgtaagaaaacatttatctaaaatgttgagtaagtaaaataaccgggtcataacgtagattaaaagtataggctgggcacagtcgctcacgcatgtaatcccagcactttgggaagccgaggcagacggatcacaaggtcaggagatcgagactagcctgaccaacacggtgaaaccccgtctctactaaaaatacaaaaattagccaggcgtggtggcacacgcctataatcccagttactcaggaggctgaggcaggagaatcgcttgaacccaggaggtggaggttgcagtgagccaagattgcgccactgcgctccatcctgggtggcagagggagactccatctcaaaaacaaacaaataaataaataaataaataaagacatataaagtgtttttttttaatttttttaaattttaattttaatttttattttttgagatggagtctcgctttgtcgccaggctggagtacagtggtgcgatcttggctcactgcaatcttggctcactgcaatctctacttcttctttcccctgctctcaccctacccttttctccaagatgaaagacagttggaagcttgagactggtaccagctggtataccagctatataggagactgatttcaaacttaatattgagccctgttttcaagatccactgttaaatattgtgtttttaagttaatttgcaattaatttatattctttcaatttgtaggagcagttaaataatcagaaagtggaagaagctatacaacagtatgagagagcatgcaaaggtcaggaacaagtttgtacttctggaaccagaaaagttctcttattcccctcgcagggcatgcgatgggggtatgacttgcttcattggtgccctgcagctcaaacccctagggggagcatgcagacgggcaggtcttgagtgtgggctctgaccctgtggcagcatctggggttgagtgtttacagctcctgaaggccccagtgggcgtgttctacagggtgttttttcagcctagccgtccacaggcggcttgtgttaatcagctcaattagaccctctgccttattgcaaggacagagggctttctgtatcccgggattcttgctctagtgtactggaaaaatcggatcacacatgggcgtgtagaaggttttattgagtggagttagctctctgcagatgtatggggagccagaaggggatggagcgggaaggtggtcttgccctgggcggccggactctcctctgactgcccgcaaccaaattccgtgtcatctcacagtagatggcctgccagcatctgctggtatctgctggtgtgttcttccagtgtgttcctctagatgttcagctgcttgtgtgtgtgcctgccagggtctcagggtttttgtaggcacaggatgggggcgtggcaggccagggtggtcttgaaaaatgcaacatttgggtgtgaaaacaggagtgcctgtcctcactctgtgggcacaggcccgagggtggagccttcaccagggaccctgcctttctgtacccagcacttccctgcctgcctcccatatcacttccagtactaaaattacaaaacaggtagttgcaataacaactggttaacatttcctttgaaaattctgaagggaagtgagggcaacataagatgcagcttatcaaaagtgaaaagtagtgattctaatgaataatttgttaacttaaagcttattcttagaaaaataaaataagtagtcaaagcaacattgatttcttgtaatggccagtattttgtgaaaaataaagccagtcaaacttttatgtaggtcacaatgaatggcatagatttctggacgaaattgtgtaaagaataaacttcaaataaaatatctttaaaattaaaatgtgtattctgaacggacacttctcaaaagaagacatttatgcagccaaaaaacacatgaaaaaatgctcatcatcactggccatcagagaaatgcaaagcaaaaccacaatgagatatcatctcacaccagttagaatggcaatcattaaaaagtcaggaaacaacaggtgctggagaggatgtggagaaatgggaacacttttacactgttggtgggactgtaaactagttcaaccattgtggaagtcagtgtggcgattcctcagggatctagaactagaaataccatttgacccagccattccattactgggtgtatacccaaaggactataaatcatgctgctataaagacacatgcacatgtatgtttatagcagcactattcacaatagcaaagacttggaaccaatccaaatgtccaacaatgatagactggatgaagaaaatgtggcacatatacaccatggaatactacacagccataaaaaatgatgagttcatgtcctttgtagggacatggatgaagttggaaatcatcattctcagtaaactatcgcaagaacaaaaaaccaaacaccacatgttctcactcgtaggtgggaattgaacaatgagagcacatggacacaggaaggggaacatcacactgtggggactgttatggggtggggggagtggggagggatagcattgggagatatacctaatgctagatgacgagttagtgggtgcagcgcaccagcatgtcacatgtatacatatgtaactaacctgcacattgtgcacatgtaccctaaaacttaaagtataataataataataataaaatttttaaaaagctgcttaataatttagattcaaatcctaggtgctgaattatgaattatgcttttcttactcagattgtattgatttgttgtttgaaatattacaaaattacttttttctttttgagacggagattcgctcttgtcatccaggctggagtgcagtggcacaatctcagctcactgcaacctccgccttcctggttcaagtgattctcctgcctcagcctcctgagtagctgggattacaagcaccagccaccatgcctggctaatttttgtatttttagtagagacggggttttgccatgttggccaggctagtcttgaactcctgacctcaggtgatccacccgccttggcctcccaaagtggtgggattacaggcttgagccaccgtgcctggccacaaaatttcttttatagatgatacatatttctgtttttaaaatgatacagactcctctcctcctcattaccccttaacttctttgttctgtgagtggcagaactaggatttgaacccaggtgtgcttcactcttaagtctcagactctctttactaatccatgttatttgtacttggccaacaaaagaaagggtaacacaaccagattattacttatttagctgacttatacattggtggggttaacttggatgggtaacttggatgtgaaaatatatctctgcacacagtactgttttcttctgcctttcttaggccttgtcaccctaacatctcctatttcataggaaatagttcatagctatcttttaggattcccctttactttggctcctttgtccctcttggtgaatgtggacacatcttagatactctggaaaagtctacccttggaccaggttgccctatagtttttatcatattttaatttttgttttctttgccaaatatggagaagtatggcataggcccaccgtgactattttaatctgacttccaccttttctatgcttctaagtcacttgtaacctacatatgttaaaatctgtcagcattttgcaatccctgctttttatttttcattattttggtgttattgtacactcttcttttcctcagttatatttataaagtagtatttattgtatgtgtattttttctaaatataaaggtaatctatagctcctcccaccttttgaaactctcttgtctcagcttttatgatctattctgtactagttaccacttttctctcagaatgagtctcagccactttggtaacttgcctgattaagatgtcgttatctttttttaaaattattttttcctttagagagaaaatgctcttgtgatttaagttgtgtatgagacatttccctacaaatagacaacaaacaaaactatatctttaactcttaaggctttccctgcctcctaaatttctatttattcacggaatgcctttcacttacctatctttaatattgaattattaaacaatggagatctaatatatgtaacataaaatttaccttttaaaagtgtacagtttagtgggctttagtactttctattcacaaaattgtacaaccatcaccactatctaattactgtgtgtttatagtaacgtaaagtgacaagtgaacatttttgtcacttcaaaaagaaaccctgtacccatcagcaatcataccccattcaccccatccctccagctcctatcagccactaatctactttctgtctgtatgaatttgcctattatggacaattcatgttaagtcagttcatacaatatacggccttttgtgtttgactcttcttagaataatgtttccaagtttcatccatattgtgtatgtatccgtactttattccttgctatggctgaataatattccgcattttatgtatcagttgatagacatttgggttgtttccacttttggcttttatgaacatttatatgcaagtttttgggtaaacttatagttttaattttcttggggatggtaagcaagtgttgaatatgcagcacttgattgcttgttcatttaatagtcatttatttcactatgattgctcataactatccttagataatatctttagatagctatgatgagatatctgtctcagacttctttactttgctttattttccattttatcattttggtgtgtattttggggttctttcctgaaataaaatgtaaattactggagtcaatgactgattaaataattatctttttgcctttactgctctagtttgctagctttcaaataataggtgagtagccattagtgaggttaccattggtgttctggaaattttttaattgataattagatttgtaaattctttttctagtcctcagtttagagtcagaaatgcaaagtgtaagagggagggaattctttgaataaaattataattaattgtgtaatatgaatatatttgaaaatcatgctttttgaaagagatttatatgataatatgaaggtgactttaatcctaggaggaattctgttttactagcacacctgaaagcctgcatcaatggaaaaatactaaaaactgctcatacagttttctcttactgtttagtttgttttacctttgttttatgtgcactttgagggagccatctttgggtatttgtgttactaaaagcagcctgagattgagctatgcatttatagctttatcacctctgacatcagtaatagttggtaagagttctctgaaatgagccctgctactaggtgccatcaccagaggcaacaaactgatcttccctctttatccgtttcctgcagacagggttaatatatagttgcttacaagtaattgctgtagtcattcttcaagggccagaaacaattttaggaaggctgttattactagcttttcaaaagccatttctgaggagctggttttaaataaaaatttaaaatagaaacaaatatttgactctgaatatttttctagaaaaagtaactacttgatgttaaaaaaaatagttcaaattgggattgagcttttttagttttaggaggtaaaggttttagtttgattggagaatattaacactgaaaataagtattttgccaaataatggtttttccccctaaatcctaagatttatgttcatagtaatagttagttgtatcggaatagtttaattgtattagaaattgttaattttacctgaaaaaacttttttccattcatccactcttgcaatcatccaagcatccatctttacaccaaatatatatttagtatgtcatatataccagtactgttgtagacattgaggatattgcgatgaataagacaaagtttctgtctatatggaactaatattctattacagttaataaaaatgtattttaattttagaagaacttaagaaaaattggatatctagaggctattaatttctaaaatgttctcccccgatttttagatctaaatgttaaagagaaaataattgaagacatgcgaatgacactagaagaacaggaacaaactcaggtagaacaggatcaagtgcttgaggctaaattagaggaagttgaaaggctggccacaggtaaaacaagattgcttacatttctctaaatatactttttcatttaaaaaaaaatttcctagatttcttcccttgttaaagtagtacgtattttcagtgattgataatggaaaagtatttggtgttttttgaatgtcctattacttgtcattttccactgtgatgaaaattgtttcactaaaattatatgcagtaaaggagtaaggacactgcatgataacttacgaattatatattgcaagttatggatgataacttgcagtgttccctagatgttaagagtaagttttcaactgagtttcacctttgtcaggcttttagcattatcttgtatgttgatctcaataaatactttgatttcattgctttcagaataccatcagagtttttctagagtatatggaaaaatataacatttactaataaaaatgttatgtgtgattcttgtagaaagggcaagaaatttagaattaagaaattgtctagccattttatatataaccttggcagggtacttgtgcttactcagcctaattttcctcatttgtaaaatgtggctgatgatgataatgccatatgtactattgcacattattctttttttaaaatcatctgacttgaagattcatattgtacattattcttatcaagatcagatgagatgaaaaaatgtaatagtactttgtaaaccctaaaactctattataactgtattttggtggatgaaattgtgatgaggatgaggacagtgagtctgtgtgacttcatacttttctagccactttcatgggcatagaaaacttttttcttgaggactgcatgaagttttctatataataaggttgacaatgaatttattatactatactgtgaatactattcattggattcctgagaagtccctgtagttcctcttcactaagaatttagtaagaactcctaaaagttaaactatagaatagcctcagttccatcttggtctgtgttctttatctgggctctactgatttgtgtctgtagcccatgtcaagtgtatctctacatggtataacttttgcatatgctttaaaacataattttatgtcttcaaatcagaattggaaaaatggaaggaaaaatgcaatgatttggaaaccaaaaacaatcaaaggtcaaataaagaacatgagaacaacacagatgtgcttggaaagctcactaatcttcaagatgagttacaggtatgactttatgtatgtttttatgtatgaatgtatctgtcttcattatatttctaataagaggagaattcagtattttatatttagtaattcacttagatatgggtgaaataatacctggcaaatgttaatatgtaaatataacttttcagtgcacattgaaatgacatggggaagaaattccaagatatagcctattaagtgccagtgaaatatagtgattgggtccttagttttatgtttcacatatttaattcataaaccactgcttctaatgtccttgtgcccatttttctactccttaaacttcttactcatcaaatactgctgtggagaaaatgaccatcaggagaattattttgattactttaaatctcttcaaagtttaattattggaatagaattgtatatctgaacacatataaaactatactatatagaaggtattctattttgtgtgtgtgtgtttttttcttgttcagctttaacatacaacatatgggggaaactttttttttcgtaggatttaccaaatactatttcattttgtacattttattagaagtggcattcataacagaagctgtaggattgaaggaaacataatagttttgggagattgtctgcctctaaattttttaaaattctggctgtgtattaaacatatgctgaaaacaaatacaaaaactactttttttgttacatattatatattctagaatttacccttttcattgtgaaattccaaaagcagttagaacaaaataaatattatgaaaaaagtgtatcaaccgtattgagaatgtttgcattaaaaagtatttgtgtattttgcattgttctaagatgatgtaatcacattagtgtagattataaactttgtaatcctggaatggactgccatactttgtaatatagtgattttagaagttttcttttcgtttttttgagacggaatcttgctctgttgccaggctggagtgcagtgacgtgatctcggctcactgcagcctccaccccctgggttcaagcgattctcctgcctcagcctcccgagtagctgggactacaggtacacgccagctcgcccagctaatttttttgtattagtagagatggggtttcaccatgttggccagggtggtcttgatctcctgacctcgtgatccgcccaccttggcctcccaaactgctggaattacgggcgtgagccaccgcacccagcctagaagttttttaagtggtattattatttttatttcaaatgaagttctacttgggttttttatatatattattaaatgcctctgaacccaaagaatctgtggtaccagtttgaaaattactgatcagcagtattctctgtccagctcttctggatgttcttttaataaatatcctgttgcacaagttattttttatttggcatctcgtaggcccaggaatattttatttttagaaccatccagttagaaatgaccaccacaaacaaagtcttttttattctcttggcatttaggaagatttgagtcagtttaactgtttcagaaatttgaattatttattttttcttaaggtcactgataaaagtatttaaatggacttcatagcaaaattaacttataaatgaaatgcgtttaggaaagcaaaccagttattttattattttttaaataatctgaagctttgatcttgtcattgtttaaagtgaaacattaaagtttttatagaggtgaaaagtaatggattgtatgaaaatgttatagaaacatgtattgactactttgtaggcatgcgataataacttataccatttatatatacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggttagtaacaattgtatctttgatgtatttcacctactttccttggtgtgttaaatgtattgctggaattaacagtttctacatggttttctgtttttggttttttaaaggcaggttgtcatctttataagataacttctgagccaatttatcttgacattcactaatgttcttgttttaacttgtttcagttgatttagcatgttgggagaataccttattgcttcttactgtctagatactgaagtaaaaaatctcttccttttgaccgttacagagtattccctattatattttaaaactttctgcattttgaactgtagattctaatactgtgtacattttatcacataaagtcacctaaatagtttgtaaaagactatatatatagtagaaatgaccttcagttttacatttactagctgtaggtcttgtaatgattgtcttagcctgttctttttttctaattggcacttagtctgacatgccatgttggcaatcagaaaaaagaagctaaacgttatcgttaatccgaggaaagctattgagcaacaaatattttaaaatgaaaaaccagtgtctataaaaatagtaacttcgcagtatcatattgtcatctgttggcatttcctttttttatgactgcatttgactaaaaacagttaaactttcctataaaaactgaaagatttccttccttctttccttccttccttccttgctccctccctccctcctttccttccctcccctcccccctttccttccctcccccctttccttccctcccctcccctccctcccctttcctttttcctttccttcttccttttcttcatcctgtcctccttcttcctttccttcctttctcctttcccttccccgtgcccatccccttccccttccctttccctttcccttttctttcctcttttaaagagacaaggtcttgttctgtcacccaggctggaatgcagtggtgcagtcatggctcactgccgcctcagacttcagggcaaaagcaatctttccagctcagcctcccaagtaactgggactacaggcacatgccaccacacctaggtaaatcttttattttttgtagggacagagacttgctgtgttgcccaggctggtctcaaactcctggtctcaagcagtcctcctgcctcagcttcccccaagtgttgggattatgggtgtgagccactgtgcattgtacccggcctgaaatgttaattttcaataaggtaaggacagtttttccactttttttcttccctagctttaaagctgcttttaacattgaatattgaacagagttggccagtttttattaaaatgaggctgttgtgagctaaactttccagcatgcttgctaaactccagaccatacatgtattctactccagaaatcaagcccttggttgaagtgtgtgtcctttctgaagctagagagtctaccattgaatgctctgtcctcatgtcacatggtgtaaatttgctcccataaaaaagtttactttttcatgaaatcattttatttacagaataaattttttgaaatcattttatttacagaaaagttacagaactagcacatagaattcctgtatacctatcacccaaccttcctgacccagtagtaagaggcaataagtaaaatcaaaacagaaggctgtcacagttgctccaattccaaaccagtggtttctctggtagcaatgccagcaagtaatcccactttgaatttttaatcctagggaaagctagtttactcttttctctcatatgtttctttataatcatacttaggttgtgtatgtgtctgccatacttaagaaacacatttttgatgtaatgttaatttttgatgtaaaattgtaacatataacatggaaaggaaatagaacatagttcagtgagttattgtgaagccagtacccacttaactaatacctatttcaagaagagaacactgttccaccccagaagctccttcttctgcctcttttccagtggtaataactaatctgtccttcagtgttacacttcagttttgtctgtttttgggttttatgtaaattgaaatatatgaatacatttgattgtacctgacttcttttcattcactattttatgtttgtgagaatcatccatgtttccatgcatgtatctggagttagtccactttcatttcagaatatttaagtgtatgaataaaccactgctaattcattttaatgttgaagatatttggattgttttctggttttggctgttatgaataaattttcctataaacatttttatacatttgttttggtgcacatttgcatatatctctgttgtgtgtgtgtgtgtgtgtatatatatatatatatatatatatatatacacacatgacaattgctagatgatagggtatatatatgtgaaattctagtagaatgctgcactgattttcgaagcagttgtacccatttataccccaactagtgttgcagtagctgtatagtcccaccaaggtatggtattgtcagtcagtttttaaaatggttttaatgtgcttttccctaattactgatgaagttgaagattgtttcatttgtttattggctgtgcctatacaagttcccttacctgtttctctgttggattatctagcttcttatttgtaggaattctttatacttttcgggatagaagccctttttgtaatgtgttgcaagtaccttctttctatctctagtttgctttttctttcttactgcctttttatgagtaggagttctcataaattattattgtagatatggtagatattacaattattgtagataattttattagtattattgtagataattgtcccaatatttttctttatgaagcccaaggacttgaagatggtgtgttatattatttcctgaaagctttgaagttttttatctttcatatttagatactagaattgatttttgtgttggtgtgagatagtggtcaaagctcttgatgtttgttttaatgtgaattaccaattgatgtggaaatatttattgaaaagactgtttctttctcactgctgtgccacttttgtcgtaaatcatttgcccacgggttaattttgtatgtgttgtaagattagggttggggttctttttttttttcatttggttattctgttgttccagccccatttattgggaagattgtccttccttttatttaatttttttgccacttttttaagtcagttgaccatgcatttgtagatcgtctcttctgtcccattgatttctctgtctttacatgctgtcttgattattgtgctaacttgaaattatagataattgctgtcattttgttcttcattttcaaaataattttgagtattctagatgatttgcatctccatataatttttagagtcaccttttccatttccacacacattcacacatacctgaattttgataaaaactgcttttactctctagatctatttggaggagacatcttaacaatattgagtattttgatccttcaacacagaccaatctctctatttatttaggtgttctttaatctctttcagcagtattttatggttttatacattttctttatcagtatttcatgatttttgaacctattgtaaatggtcttgttttctgttttcatttttctgttgtttgttgctattactgtaattttacccactaattttccaaacgttggcagaaatgttgatactagtttgaaagctatagctgtaattgtgtattgaaagaagttaccagtaagctgatttttggaatgagatgggatatggataaaaataacatggacatttaatttataaaatgatatgtgttgttttatagttaaatattttatctagactacttaatttgtcttgtaatcttgtttgcagctatatttatggtgttacatataataatttctaaacattcttagattcataatatatcaaggttgattttaatattttctttatttcctgattaggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagtcagtagtcttttttgctatgcctttttaattgaacatagtaattacttaattgactaactcttaaagaataaaaaagtgtaagtctcaatagaccaaaaaggaatcagagtatttaaaatgtggaaatttttcatgatttagagtcttgaaatttatcattaagattgatttgtcaatcaatgactgagatgtagcattttctccaatattttggttatatctctcagtaattagaaaatattagtatttctaattactttggtagagtaattagaaaatcaacaatttatggtttagtccccagtctgcgtttaaaatatggaaatgtgattcaacatgaactcttggtgattttgaatacttgggcccatccttaactttattttataaagatacaaattattttgaaagtaagcctaatggtagagagacattatgagtcattcagctgttacttttatattaccttgagactggaaatcctgaaagaggagagaattgccttttacagatagctgcttcccagtaaatagaatctgggtacatctgaagctagtctttctggaataatctgtacttaaaaatcttctgctttaaagccttcagacaataggaaaaatatgtatgtgtgtgtcacatcaaaagactattattgtaagagagattacttgctttaaaaagaggtagtattgtgttgtttaataatatatcctagaaagtcagaaaaactaggtatcaactgctgtcgctgtggttttgggacctttgagaagaattacttaacatttctgatctttatctaaaacaggtaatagtgttttcctaacagagttgtgaaattaatgaagattgtaaaacaagtagcacagttcttactccagtggaaatcaatatatgctagttactttcccttttatgaattcagtagagtctttcttatttggcagtaatggggaggtgacataagaggtttacttgacttttgattttgatggctgtgatgaggaggtctgtgttacagtttattaagtttaaaaatgtaatctatttctttataaatcgcctaagtagagtttagaaatagaactttatgactgagaaaataggaggaagaatgtgctgcaagaaaagatttagttttccttatggtcttttgtactgtaatgctatagttgcattcctgagaagcctccagtttttcaaaattgtgttatcaaaagcaactgttgggatactgagcaattctaactcagtacagaccttgaccatgccatttaacgtgtgtcgttctctatttcctcatctggaaagtaggaataatgatttttgccagacctacctgcagagttgcgatgaaagtaaagcaagagaatgtgggcagaacacttggaagttgcaagcagtctttcaaatttctccttagatcagagtcaataaactggaaagtgacccagcctttcctgagtatctgaggttgaaagagaaataggagggctaggtggtaattaaaggtgtctttacttagtaatttccattgtttagtttcatacaaatcttgattttatattctttatgtgaagttttcttcaatatattttcaggttacaatgccctgttgctttaatatttccttactttaggaaacacaaatcatggatatcaagcccaaacgtattagttcagcagatcctgacaaacttcaaactgaacctctatcgacaagttttgaaatttccagaaataaaatagaggtgggtatttggcagcacagtccacttatttattctctttatccactattactaaataacacgtacaagtaagttgctgaagataccttactgcacaattagctgtgtgtgctctgggctgtgtgaaagaaactagaggcttttgaggagaggtgaaattcttttgggagattatatgcccaaatgatgttaatctcatcttaaaagcagtagatttgttaatagaaacaaacttgatggtcagaaataggaaatcctactaatgagaaaatagggataatttgctctcataaaaggttgctttaataaacattgtgttaaatagtattttttggaattgtatccatttagtagctttgtcaccagtcttcaataacaactcgtgagtttccttaatttgtattgggcttagggttctgtgaataactttggataatatagagattcttaggttggatatgaaatagataaaaattctatgttacttaaaatttttgaagataaaattactttttaaatttctttttaaaacacatttattgggagcattcagagttgggaacctttttaagcactgaggatacgaacatcaataagacatgattgtcatcctcaaggagtgaagaatctagtaaggtagatacataagtgaatgacttgtttgattttacttcatgggctaagtgttatagtagaaatataaagtgagtactccaaggaacactgaggaagatgaaatgaattttgcctgagtgtttgtggaaatggattaaagaaggtgataccatattgtatcttatgaatggaagcttattaagcagacaatgagaaggaaaagtcttaaaaaaaaaaaaaagaaatggggtttcactatgtttctctggcagctgaacttgaactcccaggctcaagcagtcctcctgcctcagcctcctgagtagctgggactacaggcatgtgccaccatggccaactgagaaggacattttaatctgggaaaataacatgagccattcattttctcttggtttttccttgacagttcttagtagtttcaaataattagcactaaccttggggactaatacaaatcataaatttcacagaaaagtttgaagtttatccataaacaaggcttaattcttgattgcatggacaaacacatataatggaacatttctttctccataaatttatgtatgttgtcctaaaacctcctggttccaattttctaattccagcagttattttatattccacaatttggggaatcatattgttaggctattttgtatgttcttgccttcatgtaatcgatatacttaactgggctgaaagtccaaaatgattaattcagttaactggtagttgattctgggaattccactggacttaatttgtggtctctccctgtggattggacctctcatggcatggtagctggtctgagatggggcattttgagggtgagtgtcctgaaagtgttctaagaggacaggacagaagttgtaatgcttcttatgattgagccttagaggaccataatgttatttctaccacatcctattggctataaggcccaaattcaaatagaggggaatgagagactccatctctcaatgggaagagtagcaaagtatttgcagcctacttctttaatataaccaggctgtttgtcaaagatctcagcctcctcccttggagatttctgatttactgggtttgtggtagagtccaggagtcttttaaacaaattctgtaagtaattcttatgatcatacaagtttgggaaatagcgatgttacccctaattttaacataccatgtgtgagcctgaagaaagtagatgattgctcaatctttctgttcttgctgtgatctagcacgctttttgtctttcccaatgcattgtcttggataggcatttgagagaattaattctttgtggtttataaatgtatactctacaaataatatttttccttttacattctgttgtaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggtaaatacttaagtgatgagtaaatttaatgaacaaatcttattataaagctgttatagtatagagttaaactgctatattgccctcctgttcataggcactgctgttagagaccaaaatcacaatttatgctatattttataccctttaaggatatcactgtgggccaggcgtggtgactcatgcctgtaatcccagcactttgggaggctggggctggcggatcacttgaggtcacgaattcaagaccaacctggtcaacatggtaaaacccgtctctactaaaaatacaaaaattagccaggagtggtggtgcacacctctaatctcagctactcaggaggctgaggcaggagaacaacttgaacccaggaagtggaggttgcaatgagatgagatggcaccactgcactccagcctgggtgatagagcgagactgtctcagaaaaataaagaatattactgtggtttaatggtcttcagataaaaagctatgtatattaaaagatatagcgtccttgcttcagttaaactataatacatcaaatgatggtggattttactggagagccatttcagtataccagtcctgttcatacttagtcactttccctgtattggaagagaaaagagggttatgtagaaatcagagaaactgaaatagctaacttgcttgtgtataatctttgtcatttaactaaaatcttgtctgtatggtcctagcaagttttaaaagagaaattcttttttcatcagccagtgttaaaatttgggcctctatgtagtggtaggctaaaagctattaacctcttcttactgcagtttcttgattgaagggttgccaaacctaccatgtcctagatgtggagatttggcaagtcagatgaggtttctgatcctgttttctcctttttggaacaatggattaatgtgttgaaaatgcttcgcttttgctctgcaagtggcagttacatttattaatataactattattactatttattaatagttactattaatatttattaatagtattatttatttatatatttttatttatttatttatttattattatactttaagttttagggtacatgtgcacaatgtgcagtttagttacatatgtatatatgtgccatgctggtgtgctgcacccatcaacttgtcatttagcattaggtatatctcctaatgccatccctcccccctccccccaccccacaacagtccccagagtgtgatgttccccttcctgtgtccatgtgttcccattgttcaattcccacctatgagtgagaacatgcggtgtttggttttttgtccttgtgatagtttactgagaatgatgatttccaatttcatccatgtccctacaaaggacatgaactcatcattttttatggctgcatggtattccatggtgtatatgtgccacattttcttaatccagtctatcattgttggacatttggattggttccaagtctttgctattgtgaatagtgccacaataaacatatgtgtgcatgtgtctttatagcagcatgatttacagtcctttgggtatatacccagtaatgggatagctgagtcaaatggtatttctagttctagatccctgggaatcgccacactgacttccacgatggttgaactagtttacagtcccaccaacagtgtaaaagtgttcctatttctccacatcctctccagcacctgttgttccctgactttttaatgatggccattctaactggtgtgagatggtatctcactgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggtcacctattcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcccaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttctcaggtttgtcaaagatcagatagttgtagatatgcggcgttatttcacaagcattcttatacaccaataacagacaaacagccaaatcatgagtgaactcccattcgcaattgcttcaaagagaataaaatacctaggaatccaacttacaagggacttgaaggacctcttcaagaagaactacaaaccactgctcaatgaaataaaagtggatacaaacaaatggaagaacattccatgctcatgtgtaggaagaatcaatatcgtgaaaatggccatactgcccaagctaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttaactatactacaaggctacagtaaccaaaacagcatggtactggtaccaaaacagagatatagatcaatggaacagaacacagccctcagaaataacgtctgttaagtattttatttctccttcacttatgaagcttagtttggctggatatgaaattttgggttgaaaattcttttctttaagaatgttgaatattggcccccactctcttctggcttgtagagtttctgccgagagatccgctgttagtctgatgggcttccctttgtgggtaacccgacctttctctttggctccccttaacattttttccttcattttgactttgctgaatctgacaattatgtgtcttggagttgctcttctcgaggagtatctttgtggcgttctctgtatttcctgaatctgaatgttggcctgccttgctagattgaggaagttctcctggataatatcctgcagaatgttttccaacttggttccattctccccgtcactttcaggtacaccaatcagacatagatttggtcttttcacatagtcccatatttctcagaggctttgtttgtttctttttattcttttttctctaaacttcccttctcgcttcatttcattcatttcatctaaaaagcagagcgcctctcctcctccaaaggaatgcagttcctcaccagcaatggaacaaagctggaaggagaatgactttgacaaattgagagaagaaggcttcagacgatcaaactactccgagctacaggaggaaattcaaaccaaaggcaaagaagttgaaaactttgaaaaaaatttagactaatgtataactagaaaaaccaatacagagaagtgcttaaaggatctgatggagctgaaagccaaggctcaagaactacgtgaagaatgcagaagcctcaggagccgatgcagtcaactgggagaaagggtatcagtaatacttatttttaaagtaacttgttttaagcttaaaactaattacaaactctctagcaaaataatttttcttcaactttcttttacttctttgaagagtagtatattttcaagctgatgtaagagcagaaatagtattaactatactcctgaggctctctgtcaggtaataattttgctgagtgaatattattcagcatagtttttctgctacacatgtaacacctttagagattgttttatggagtcttactagttaacttttgttttatatttatttaattttttaaaataacattaaaacactgagtttcatcatctagttggctttttcttgatccattttttttcaacgaagaaggaaacaccgagtgtagttctcaagaaggttaaaatataaatattttattaattttactattggcatatatccctcatgtatatttcagaaaagatttacagattgttgtagatacatcatgtagaaactttaaattttctaactgattttactcaatcttcactgctataataaactaagtacatgggcccccatgaaaatcatttatgcaatcctattttctttttttcttccacatactcttttttttttttttaattactaagttctgtggtatgtgtgcagaatgtgcagttttgttacataggtatacacatgctatggtggtttgctgcacccatcagtctgtcacctacattaggtatttctcctaatgctatccctcccctagccccccaccccccgacaggctatattctaatccagtgaagactccaaagagctccttactgaccactatgtgtggaggtagcctcatggtctcttttcactggcatcctatgattaccatctgtcttttccctgtcatggtgtctgcttcttatgacccttataacttctgctttgtaatttggattctgaggttcagtcatgatcttttctctgcttctcttcttgccccctttttcctgaacttttatctttggtacaactaggatttgcagcagttcaagtcagtgagtatatctgtaaagggctttgtcctatgtgaggttatttggggaaaagaagagtaagatgccatacccatgttgtagagaagaaagataatattttaaaagttttaacattttacctttggttatttgaagtttcgtttttattttatttttgatattgtcaaatgtcaatgagagaacttagacatagatgcttgtattatttgggagttaggcaataggtaggtatattgtatgctgtattttaaagctcagtttcaaataaaagatattccttccatgtttttcatttagcttatgtaatttcattacttgtgatatgtttgaaaaattcacaccttcagtcagggtttctcaactccagcacagttgacattgtgggctgtatacctctttgttttaagggctatctatcctgtgcattgtagggatgtttaacagcattcctgacctctacccactcgtggccaataatatccccttctccctggcaaagacaaccaaaaatatcttcaaacattgccattgtcctctgagttcaaaattgccctcggttaagagtcactgttttaagtgataatgtagctttttacaaattttcttttttgagtctagagaaataaaatattgtcaagaaattaactggtgctaaaattcattatttttaggacttggtgaaatgtgaaaataagaagaatgctacacccagaactaatttgaaatttcctatttcagatgatagaaattcttctgtcaaaaaggaacaaaaggtgtgtcttttaatttgtccaaaattgtagcaattatccagaaatccagttgtgttcaattataactcatttatcttctctttcctatacatctgattcagttgaaatgtaacctttagcatttggccagtagcatctactttatgtgtttacttctgactttaacactctgcctgtcaaactctttttgccattgtctgacccttttatccctgtccttacatacttaaagtttcctacctgagaattcataacctgtctctggcctctttaattcagctgtggccataactatttccttctaacacttctcatcaacaataacaaaaaatgttttgtttattaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaaggtttgcagaaaattaattaaatgacctttttttgttagatgttgggtatattttaatacctaattgatatataaactcaacagctgttcagggaatattatacttcaaataggcattgtcctatactaggtactgtgggaagaaacatgtaaaaggatgatagatctaggtgttcgctatgtagtagaagagaaaggcttgtatttaagtaactgatccagagcaggctacttaatatagtaataggggtataagcaaaggtatgatagtattggagggaaaagagctactctgattagggggctttgggaaggtttttatgggagagatgggatttatcctgtgtattgaaatgtgggcaggagtacactctctagggtgtccaagggtgagaatacagtcatgggttcttagtttctgtttttggttggggcaggaaatccccttcctcatccctgttttctgcttatcactagagacagaaactaaaaaccatggcttcaggccgctaaaagcctaaaacaaaacaaaacaaaacaaaacagaacaaaaacaacaacaaaataaggtgggttggacaagtttgccagtattagtattatggtatatatcctcctagtgtttttttttctgtgcatatgtaaacattatctgtttatgtacaatatgtcaaaaacacattattttcataaatacctattgagtttagctgcagaaacagtatgcttagtgctttttttcttgataatataatgtggacatattgatacctgtgtatatgttaagatatatacacatgtgtgcacatatgcggaaggaatggttttaacacaggtggagtatcagaaaaatgtaggaaatgttcatgcaattacaggcagcaatacacatctggcatgtagaatgtggaaggactatcttaggggtgagatggagtagtgggtttttgtgaggttacctgaatgacagcaataggatgaattagagaccagagtgaggggtatagggaaggaaaggaactagaagcagggggcagttaaattgaatcaaatatgttgtgtgaaaatactttttgtcgaaggcttaccacagacgtttccaaactttgttggttcacagtgcccttaatgtctcagtaattaatttccattttgcctctgcacccaaagaaccactagtagtctcatgcattagaacttaagaccaaacaaccactgaaaattcagcttctgaaaatccagattgcaaagataatgtcataatgaaaagaaatgtaattcagtatcgttttgaaattgaactaccttgggctattgagcatcactattttccctgaagattgaaaatatcctgaggtgcttctgtaagtttgctgcagcatgccttagtacacagtttgggaacttctgacctatcagacccatttgtatatttacatacatttaaaaaaatatgtacatttaaaaaatgtgtttgtataaacagaaaatatctggagggacaaacagcaaactgttaaatatctaaatttggagaggagggacatctttctttagagtcctttaggcttactaccacttttatattaaaaagaaatatattttcaaggagaggtaggtacctataataagtatgtaatcagataagggtaatgattctcttacttcattgacttggttccttaacagcttccctaccaatgcacttgacatacattttttttttccttttttctttttgtttttacttatttctagaaatataagatatccctattttgaactgtaactgtaatacatatttgttgttttgggtcacttggaaatatagagagaaaagaaaaaatggagattaatttttaaaattctgctgctctgataaccactgttaatccatcacttagtatcactggtctcccagcttgcccctcttgtcatctcccatccattcatacatgacagaatgttcttttcaaagtgcagattgaattatgttactcctctgatcctttaatgatttctcattcttctgaatgacctgatttctgactctctccaatctatctcttattattctacggtttgataactagccagcttcaatcctgctaacttctgacagttcctagaatttgccagcttctttcttaccttcatatcattgatttcttttgctttttcctgtgctttcttttatctggaacacaccctggcttttgtcttagctggccccttacccttgagccctcatagctgatggaacgttattagggagacaccttccttcatcaccctgtcactacccctcatccccagcatcacttaatctttattattcaatcctattttttgtcttagcactttttaaactgtaattctttgctttcttattatcttttacactagaatataatctgcacggacaaaatgtctgtctagttcatactgtcagctcttagtatagtggctagcacatagtagtgatgagtttggctctaggccaacatatgtatgatttttaaacatttctattttttttaggctgtaccataggcaattacaaagacttacctgacaagcttcccttcctacaccagacttgatgcatagccaatgcattataatctcttaagggagttatagtcaaggatccagcatcccccaagctagtcatgctcttactcatatttgcatatttagcctgagtgcctccattcagagcctctttattgaggcctttggtggaggccttcttatggaggggaacaggagggggaaccttgaagacgcttttctccactgtaactcggtacttttccacgtatagctccctccaacctccagccctgaggtctataaaactgcgagagccttttgtttggggctgcctgggtggtaaaatgaccaccacttctatgctgatctgtattattctgtggtggactatagaagagggtgggtaggagctggtgctttctcaggtttagtctctcgcatatactgttgaaataagtggttaaaaagctgggttgttactttcattttggcttgttgtcttaactggcttctccgatacctggactctcagctctctcaagcccagctcagcccttaacaagtagtcttctcaatttagtctaatgccttaaatgttttttctatttaaaaaaaaatatttgatatcacatgtgtgtgaatttctatccaggaattttcccacatggaaatatgttttctattaaaaaaaagtactatgtactatgtacatagtaaggaatttaaaaattcctattctacttccctaaaagcaatcagctgttaacagtttggtttctctccatttgtgtgtggacttgaagtaaagggtttacaaagtattttcatgcagcattcattgtgcataactttatgcatgagcattgaactagatcatctaccaccttatttttaatgctgcatgatccactatgtatatatcctgctcttttgcttaacatagcataaacattttccaagtcattaaagatgcctgaggttttttactacattgaacattaatcaaatgatactttatttgctttttttttgctgtcgatcattatttcatgttctcttgacatttactttttttctttgtgatttgtctattcatgccctttcaccatatatatattgcagtgtttttagtttgtgtatgttcattctttattaaggatttcaaaccatctttattaaggatttcaaatcacctttgcaattagaaaattatttcaggaactaattaacaattttattttatagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtggtaagctagtatttctgttttcatcaatgtagaactgttcgtgttctttttaattttttacagtggtttgaatttcaattctttagatctctgaaaacacatgctataaaggtcatgcttttagtctcacatgtgttaagtttatactaattaaatataaatactgtattaaatgtatataagcgtcatgcatttgcatttgaaaatgcatcagaggaatttatttccaataatagaattgtcactatttagtaacttatttgcctccacaatctttttttctttttctttctcttttttaaatcacgggagttgtacaaatctgggcccaagtgttcctggtaaaaatataaaactgacattcagccatttcctcccacctttcccctaagcctttgaggatctattaggaagagactgtagttatcaccctgagtctatgattcattctcctgattcagaacagtatgtgctgtcacagggaaagctcaaattttctgtcatgcttgcatttgcttagtggatgaaagtgaaggtaaaaaaataattaaaagaaattaaaaaaattaaaaagaagtggccaagaaaaatcaggagaaaccttttttgccacaagagctttcagatatgagattgacacttgaatgcaagatgtaaagagttagggtaaattagggcatggtgttgtaagtaccattctgtcagtcatttttgagcatctgtttgattagtacctgatttcttcccttggctgaaaattgttttcttagttactatataatgtgctttctactttctaagttatacatttgttgccacgaaagatcatttcttaaaaattatttgaggcacttgtctccaaatattttagtaattattttaagttatatctgccttgaattcaatatggagtctaggttattttacttctagaatttgatagtgttgaatcttttacaaagtctgttttttaaataaatttttatagaagatggcatatctgtagtctaagtaaaaaaaattctccaatgtatcatttcagttactaagcacatgaacatgtcttactcattataaacaagcttttatttttattttcacttacaagctttgaaaaactatgaaatttttaatttcagattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtctttgtc

SEQ ID NO: 567 - DNA, 119505 bp, Homo sapiens
ccggcggcgcgggcgagggtgggaatctttttcgggctcccgggggcggagggaagggagcgcgcgtgcgcgcgcccggccggccgtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacaggtgcgaagcatccccagctgggccgcgtcggggacccccccgccgggggccgcgcgcctcggggcgtggggccgaggccgcctcggggacacggcccagcggagcccccgatgggggtggggagctgggtgagggctggggctggtgaatgggtgggaattctccggctggagaaactgcattttaaaaacctttaaaaaagcggtgaagcagttctcggcgtggtgcgtgtgtcgcgtcccgcctcctcgccgctcccgccctcggccgcccccgcactccgcgccggtcagcgttccggatggcggagggggcggagagtggcattttctgtttgacggaatcctgctccccaccttagggtaggggtgtcgcgggtgttgacgggttacctccatcccccaaattctggatgatttttaaggggttatcttgctgcagagtgaagtgcttcaggcttcagttttctgttcctgtgaatgcttcagaaaccctttcttaatattttatgttctaaaggggatacggtagaagagcagcagtttcttgttggaagttaatgccatttttttccctatggagaaggatgatgagctgattcccccctccctcctagttctgttagaataggcagttttcctgggggtgggaggaggacagactatgactgtttcttagagagaattgggaagatgaacctcctggtttaattttttttttttttttttttttttaccgtgatggatcgtttggctcaagggctgatagtggtaggggcgtgtgtatggaggcgggggataccggatggtatgagatccagctgctcctggatgaagcaaaatattctgtggattaaaaaaatccttctttaaaaattacttgaaaggatagcaggttaaaaggcacagtttgcaaaatctaaaatcttttgcttttttttttatggttattttgaattatgggttctgcctccattttttttctttcccgtttaaattctcttgggataaagatggaaatggaagcaatatgttaaactgtttcttcacagtctttttttttttccttttttcttgctcccacctccatctctccagggatccttcttttttcttttctttttgagacacaacctcgttctgtagtccaggttggagtgcagtggcgcgatctcggctcactgaaacctcggcctcctaggtttgagcaattctcatgcttcagcttcccgagtagctgggactacaggcgcccgccaccacagccggctaatttttgtatttttagtaaagatggggtttcaccatgttgaccagactggtctcgaactcctgacttcaagtcatccacccacctcggcctcccaaagtgctgggattataggcgtgaggcacctttcttaacattagctatataggaaagcattttcatgtcttagtgtaaattttaaaaaacaggtgttacaattttataggttcataaattttgtaatggccacattgttgatcgcggaagtgagattttgtttgattagacatactgttatcttgtagacaacatttgtatttgagaatgacccgaaccactgtataaacctgttccttcgaaagaggcagttgactatggctactaggaaaggaatgtaggcaagattaatacaaaaaaatacaaatgtccacttgtaatgtactttgctgatacaagtggggtagaaaagattcagaggttcaggcctgggcgataagagtgagactacatatcaaaaaaaaaaaaaaaaaaagattcacttgctcaatttttcgctaaaattgaaagtcttttatggcctagaactgtgtgaggggtggatggtacatacctagtaggagaggctgatcttggaggaaattaataccatgtagttaatttatactctgtagtgcactgctggtaccaaggaggactggaggaagcaatgctgttctgagggatttcacaatctctagtagaggcaaaacctaaaggaatgaagtggtaattccattgccttgtgcagcatattatggggaaagagttgcaggtcagaagagaaactgagggtggaaaagtggattgcaattattaccagtaagaaataaaaaataaacagatttctctctcttttgcaagatgatttcttattgtaatttgaaggtacaagttcctcttaagttataattgctatataaaggtaaaaggataaggattattaaagctgaaaggttaaaggcatcagcagttttctttttaaatattttatacatttccttcagttgaaaagagaaaaacgttactactatcaatctctgttttagcaatgggactcaaaatttagtgtggtgacattttaaaatttaaagcataaatattgattaatattaatttaatagaaatgaacttagattttaaaatagtttatttcttcagtttagcatctgaagtatattttacactttctcttttttgattatcatttattttaggatgccttaggtatataattggtacactctcaggatgatagctcttatatgatttgttgatttgttgggaaagttgataaatagaacgtggtgacagtggatttgtgctgatccagctgtacatttggttgaccagcaggggttttgatgctgcctggaccctgcagtagatgaaagttaattcacaggatcagtgatcaaatggtcaatttagccttttttttttttttttttttctgagacagagtctcactctgtcgcccaggctagagtgtagtggcgcgatctcgatctctgctcactgcaacctccgcctcctgggttcaagcgattcttctgcctcagccttccaagtagctgggactacaggtgtgtaccaccatgcctggctaatttttgtatttttagtagagacgggatttccccattttggccaggctggtctggaactcctggcctcagatgatcgacctgccttggcctccccaaagtgttgggattacaggcgtgagccaccgcacctggccaatttagccttattatagcatcatgtcttagccactagctcgagttaactaacccaacactcattttattgtgtggaaatgtaatttttgcctataaagtagaaaaaaatctgtttatcatgtgtaataagtgtttttgctcagtgttctttttttttttttttttttgacacagagtttcactctgtcgcccaggctggagtgcagtggcgcgatctcagctcactgcaaccttcgtcccccgggttcaagtgattgtcctgcctcagcctcccgagtagctgggattacaggcacgtgccaacacgcccagctaatttttgtatttttggtagagatggggttttgccatgttggccaggctagtctcaaactcctgaccccagatgacccacccacctcggcctcccaaagtgctaggattacaggcgtgagccaccgtgcctggccccctaagagtcatttttaataaaaatttagatagtttcattattctaacctctagaaaatgggatagtcaatattttttctaaaatatgataaacaggtataactacagtttgctgatatttatcagatcaattttatttcttgcctatacaaaggatttagtagttggtagagacttttttttgagatacatgtaagacctgcgtttttcttcatttattaatatacacacctaggccgggcacggtggcccacgcctgtaatcccagcactttgggaggccgaggcaggcacatcacgagatcaggagatccagaccatcctggccaacatggtgaaaccgcgtatctactaaaaatacaaaaattagctggctatggtggcgtgtgcctgtagtcccagctacttgggaggctgagatgggagaatcacttgaacctgggaagcggaggttgcagtgagccaagatcatgccattgcactccagcctgggcgacagagcaagactctgtctcaaaaaaacaaaaattacacatataatgcctaatatgtttgaaggtgtccaggaattaaaaatgttttggttaacttggaatctacgtttttacaaatagaagaatttttattacaatatagttgtcttaatgttttggtagatgaaataactccctatttgttacttccctgaaatctgaaaagccaacttgttgatatgtacgtttttctttttgttagataaaagttactgatttttgtgagtgacagttcacatagatgcatagtaaaatcttattgtttggattaagagtagaatcatcccataatatggatttattcaaaagagaagaaattaagaacttaccttaaatttttacctgaaatatttttgaacaataggagacatattagtagctttccttttcttctcttaatcaatgtggatactcccagagttcactaaaaacttcatgagaggtttacaagggaatattatcagtcagtttcatcaaaagtaattaccaaaatgatacaaagatttaaaatttttatttaataaaaatcattagaatacatgctcattgttgaaaaattattggagaatacaagtaggtattatgaaagaaatggaaaattgcccgatcatcttgaatatatatctggtactcatacttttaaatattttttgtatgcacaactatatatcaatatttttgtagaaatgggtttatgttctatattctgtacctttaaaagaaccttttaaggatgctgggcttgacttttttttaaatggatgtcatatactatattgggaggaggttggttatatttataggtcgagttctgtatgttcttgcaaatgggagaatcttagaatacctagaatgaaggagaaagaggtcagttgagagtaaggagactgagtagaatttgggagactgaattccccatagattaagatgactcaactcatttgaaattgatcaaggcttaccattcctcaagaaattagtccctaactctcagcagagacatttggtgaatagattttcagtgacaaatcagtcatcttcaagacctttgacaagattgcaaaaacaggctaatttatatttgagccccttgctcttttaaacattttgtcatttgtacacttcctacaccttcttgtccaaggaacttaagtgacctcataatttccgttattgatccaggaaatccagtctcacctcatttcacccttccttgaagagcttcctggttcaaaattgctctttaccaaaataattaattaataaactgttcatttattttttcttttcttttttctttctttttttttttttttgagatggagtctcactcctttgcccaggttagagtgcagtggcgtgatcttcgctcactacaacctccggctcctgggttcaagcaattctcctgcttcagcctcctgagtagttgggactacaggcatgtgtcagcatacccagctaatttttgtatttttagtaaagacagggtttctccatgttggccaggctggtctcgaattcctgacctcaagtgatccacccgccttggccttccacagtgctgggattacaggtgtgagccatcgtgcccagcctcatttactttttcttcttaccttggtatgggtaatgtgagaatgtatgataggtttactttatttagagtcatcttttctcacccagagaataatatataaaccaaattggtttacttatgtgtaaaatatgtagtagagatatttttgagcatgaggtgcttttggtgttactttttcttttaaaatgcagggaatttaatagtatgcagtttcagggtgtgtaaggtaatcttttggtggatgaaatatatttggtggatgaatatgctgtgatttgcttacacccaccccaaatccattttgcagcaccctactcactgtccagagattctgggaaaaaaacaatagagaagacaaagccagtctagacaccatttgactctaccttgtgaatattctgaaagttacattaggctagttgtagattttttttttttttgagacagagtctctgtcgcccaggctggagtacagtggtgcgatctcagcttactgcaacctctgcctcctgggttcaagcaattctcctgtctcagcttcctgagtagctgggattacaggtgcacgccaccacgcctggctaatttttgtatttttagtagagacggggtttcaccgtattggccaggctggtctcgagatcctgaccttaggtgatccgcccgcctcggcctcccaaagtgctgggattacagcgtaagccaccgtgcctggcctagttgtagacttttgatagcttatggttgaatttttatgggattggttaatagattggattcatgaggtagcatgtagggcaacacattctattttggatttttcatttactttgtgtttccttccagatacgaagctcctagaagatggagtcatttcttaaaaatttctatattttcccattagccgtaggatgttctccatatactagccactcattaaatagttgctgaatgtaagaaatacagacttgaatatgcaagagcctatgcactgaattatttttattttattactttattttattttattttttgagacagggtctcactctgtcactcaggctggagtgtagtagcacgattatgggtcactgcagcttgcactcccaagctcaaacagtcttcacacttcagctcccaaagtagctgggactacaggcttgtgccaccatgcccagctaattttttttgttgttgttgttagaaatgggatctcactatgttgctccggctggtcttggaacacctgggctcaagcaattctcctgccttggcttcccaaagtgctgggattacacctgtcagccgccatgcctggccttgaattattttataagtaggatataattacatgtaaatttaccttgcaagttttttcctatttgattttttggtgacatttatgttctgtaaagttttgcagtacttttcatatttgcataattcatgcaaggaacatagttttgcttttttcttcttaagtaatatactttgtagaaaatttggatgaggtaacagctttgttttgaatcatttacaacatgaattttttctcatttgatttttaaagtcaggtttattgagttttaatacatatatggtacaagtcaccctttttaggtgtaaaggtttatgaattacaataaacttacatagtcatgtaaccaccacaatgtaaaattttccttgtaccctctgtagtcagtcctgtccctccactactagcctttggtaaacactgatatattttctgtccctctagtttttgccttttccagaatgccatataaggggcattatgtagtatatagccttttgtgtttgacttcttggtactagaagtcctaatacatttgaaaatcatcagtgttattgtgttttgtcagtactttgttccttcttattactgagtaatattctagagtatgaaagaatcataatttgttcatccattcaccaactgatggatttctggattgtttctagttttaggcagtggtgaatatggctgtaaacatttgtatacaggtgttggtgcaacctaagtcttcactcttttgggtaaatttaagggaaaagatcaactgttgtaccctggtaacagtggatgtatccacataggctgcataggccagtgcttgaactgcatctgatctgaatcttggccgagcactttgtgatcctcttggaatataagattatggaagtttgcgaggaccttatgtgaagccctttctcaatctcttcatctgccgaggaggctgtacgtgataacagtgcctcatcacctcctagttcccatgagatgaggctctctattgtacccttttaggtagtagctgcaggctgtaagactttagttgcagcatggcattggctcctccgcaacagagtgtcatatctatgttgtagtcacctggctccttttgttttagtattgctttacacaagggctgtatcttttactactattccttctgccctccatgtaaatggtaggctttctgaacctaacaagcagttgggcaggtctatcacattgccttctctttgccttgacaataaatatctaatagtgggattattaccgtatggtaaatgtgtgtttagttttatacaaattgccaaactcttttccaaaaacgatggtaccgttttgcgttcccaccagcaaagatccagttgttcttcatctttgtcagcatttggttttgtcaggttttaaaattttagctattctcttgttagtgatgtctcaaaggccatatatgacaagcctacaactaacatcatactcaaccatgaaaagttgaaaccttttcctctaagatcaggaataagacagtggtgcccagtgtcactagttctatttaatcaagtactgcaaagtactagaagtcctagccagccagttaggaaagaaaaataaacaaaaggcatcaaaattggaagaagttaaattgtctctgtttgcaaatgacatgattccttatgtatacaaaaccctaaagactccaccaaaagactgttagaattaattaacgaatttagtaaagttgtaggagacaagatcaacatacaaaaatctgttgtgtttctacatattaactacaaacgatctgaaaaattaagaaaacatttccatttataacagcagaaagaatagaatacttaggaataaatgtaatcaaggaggtgaaaggtctgtacactaaaaactataagacatttatgaaagtaattgaagaacatgcaaataaatgggaagatatcccgtgctcatgaattggtagatttgatattgttaacatgtccatactacacaaagccatctacagatttaatgcaatctctatcaatattccaatggtatttttcacaaaaatagaaaaaccctaaaattcataggaaaccacaaaatactttgaatagccaaagcagttttgaataagaacaaagttggaggtatcatacttcctgatttcaaactatattacaaagctataggcctggcatggtggttcatgcttgttatcccagcagtttgggaggcctaggtagccagatcacctgaggtcaggagttcaagaccagcctggccagcgtggagaaacctcatctctactaaaaatacaaaaattatagggcatgctggcacacgcctgtagtcccagctactcaggaggctgagttgggagaatcgcttgaacccaggaagtggaggttgcagtgagctgagatcatgccactgcactccatcctgggcaacagagcgagactctgtctcaaaaaaagctatagtaatcaaaacagtgtgttactggcataaaagacatgtagactaatggaacagaatggagcccggaaatgtagccacatctgtgcagtcaactaagctttgataaaggcaccaggtacacaatggggaaaggataattcagtaaatggtattgggaaaactatatccacatgcaaaagaatgaaatttgattgttatatcacacatacaaattagctagaaatggattaaagacttaaatgtaagatctgaaattataaaactctttggtatgggtcagatgtttgttcccttcaaatctcttgttgaaatgtgattcccagtgttggaggtgggtcttggtgggagataattggattatgggggcagatccctcatgaatgatgtagcaccatccctttagtgataagtgagttcttgcttggttcacgtgagaactggttgtttaaaattagtctgggagcccccccaccatgtgacatgctggctccacttctgccatgattacacctcaccagaagtacgtgccagcactgtgctttgtgtaaagcctgcagaaccaagagccgattaaacctcttttctttataaattacccagcctcaggtattccttcatacgatcataagaatggactgatacactcctagaagaaaacataggggaaaaagctccttgattctggtcttgacaatggtttttataaatatgacaccaaaagcacaggcaacaaaagcaagaaaagatgagagtgactacatcaaactaaaaggcttctgcacagcaaaggacacaaaatgaaaaggcaatttatggaatgggagaaaatgtgcaaaccatacatctatctgataaggggtttatatctgtgtgtgtgtgtgtgtgtgtatatgtatatatatatatatatatatatatataaatatatatatatatatataaatatatatatatatatatatatataaaggattcatacaacttaatagcaaaaaaccaaataaccagattttaaaaagacctaagtagacattttttcaaagaagacacacaggcgtccaacaggtatgtgaaaatgtgctcaacatcactaatcattagggaaatgcaagtcaaaacaaaaaggagctgtcacctcacacttgttagggtggctatcaaaagagagataagtgttggcaagcaggtggagaaaagagaatccttgtgtgcagtgagaatgtaaattggaacagccattatgaaaaactggttccggccgggtgtggtggctcatgcctgtaatcccagcactttgggaggccgaggcaggcagattacctgaggtcaggagttgaagaccagcctggccaatatggtgaaaccctgtttctcctaaaaataaaaaaattagctgggtgtggttggcgggtgtctgcagtcctagctactccagaggctgaagcaggagaattgcttgaacccgggaggcagaggttgcagtgagccgagattgcgccactgcactccagcctgggcaacagagcaagactccgtctcaaaaaaaaaaaaaaaaagaaaaagaaaaaaagaaaacccagttctccctaaaattaaaaataggacaaacatacaatcccacttctgggtatatatccctagggaatgaaatcattatctcaaagagacatctgcacacccatgttcatttcagcattattcatggtaactaagatatggaaacaacctaagtgtcagtggatgaatggatgaagaaaatgtgtactgcatgcacagttctccttcagtctacatggggcattggttctaggacccccaagtatacccaaatctgcatatactcaaatcctgcagtcacccttgtggaacgcgtgtatatgaaaagtcatctgtcccatctgtatatgtggatgaatactgtatttgtttgaaaataatctgtatattggacccacacagttaaagggtcaactgcatatgtaatagaatattattcagccataaaaagaaggaaaccctgctatttgtgacaacatggatgaacctggagaacattaggtaagtgaaataagccaggcacagaaagacaaataccgtatgatttcacttatatgaggaatctaaaaagatgaacccatagaatgaagcagataatagaatctgcttctattatcggccaagggccgttgggaggtggggagaaatggggagatgttagtcacagggcacaaacttgtagttataggatgaatgtgttttgggggtctaatgtactgtgtagtaactatagttaataatattgtatacttgaaatttactaagtcagtagatttttttttttttgagacagcgtcttgttctgttacccaggctggagtacagtggcatgatcacggctcactgcagcctcacctccccaggctcaagtgatgctcccaccttagccttccgaatagctgggactacatgtgtgtaccaccacacatggctaatttttgtagtgacggggtttcgccctgttgcccaggctggtctcgaactcctgggctctacccatccacccaccttggcctcccaaagtgctgggattacaggtgtgagctaccatttgcctggctgagagtagattttaagtgttgcccactccccgctcccaccaaagataatcaagaaatgattatcttgattgtgataaccattttacagtttatgtgtgtatcatgtcatcatgttgtacactttaaatatatacagtttttgtcagttatacctcagcaaagctgaaaaaaaaaacccaaagcaaactgaaccaaaacaatattgcctgcaagccacaaacaatcagcatctagccttgacatcatctcctgttacactcctttacccttctttgttcactcaacttcagccactttggcatccttttcttgaacataccaggcatacttctgcctcagggcctttttgctttgtatttgttatgccctctgccaggagtactctactccaagatagttgcatgattggttcttttacttccttcaagcttttgctgatacatcacgttcttgatgaccccttcctggctactctgtgtaaaattataacatactcctgccccttgctcactctccctttgcttatacttatccttccatgctttttttacgcctacatattttctcttaacatacagtgtttcttatttatttgtgtgttttccctccctggtatgtgagggcagagatttttgtctcttactcatttccagtacctggaacagtgcctggcacaaaataggcactccgtaaatattcgctaaatgagcgaattagatcttttctagtaagcattagaaaatgtcggagggcagtgaaataaattagttttgggccaggctcagtggctcactcctataatcctagcactttgggaggctgaggcaggcagacttcctgagctcaggagtttgagaccaccttggccaagatggcgaaaccccatctctactaaaaacaaaaaaatttctccgggcttgttggtgtgcaccagtagtgcctcgggaggctgaggcacgagagttgcttgaacccgggtggcagaggttacagtgagcctagattgcaccactgcactccagcctgggcaacagagcgagactccatctcaaaaaaaaacaaaagaaattagttttgcaaatttgaagagttgatagatttatgctctggaaaatgaaagttggcaaatactttttatttgtccagaatatttaatgtagatatggccaacagaattgacactaatattccacatgtggttggtgctttagggttaagcagtttatttacagttacttagtgcaggacttactcaatagtggaagctcatcaaatgtctgaactgatctacagcttcctgggaggtataagcaagggagatattcctattataacatattagatgagacaactcaagtttacctctgactctgctaaactaaaattctgtgaagagaggaattatgttcattttttttttgcctgttatgtcctcatttcttagtgttcagtaaatttttgttgagtaaaatgaacttatgactcacaccatttattttattatatgtttttttccttcctggtcgttcaaaaatagttattgagcatctttccattctgtgaggtcagtggtaagtaactcatggaccaagtccagttctgttaccattttgatttctatgaagaatcttcgttgtaaattttgaattaatggagttgaactgcatataatatgggactgtttttttgtttttcttgatgttatgtggccttacccacttatgtgttgaaggcttttcataaaggcaaggagataggttgttaggaacctacgaaacaaagttgaataggggaagccaacaagggatgccagcatctttcaatatgtagtaccacaagttttctgccagcagatagtgcttaaatagtgattccatgtctccctcaaaaccttttatttatttatttatttatttatttatttatttatttatttttgagacaaggtctcactctgtcatccaggctggagtgcagtggcgtgatctcagctcactgcagcctctgcctcctggtctcaggcactccttctgcctcagcctccttagtactactgctgggattacaggtgctcgccaccatgcctggctaatcgccctcaaaaccttttattctgaatctagaagagcaggctaggttgacaaaaatatttaaattgcctggcttgatataatgtctatacacacacacatctcattgtttttgagagaaaaggaagtttaaatttatggacatgaaatttatattatttctagttttttaatcattcatgcatttgtttataatgcattaacatgcataattatgaattttattcatgtgtaaataatacagtctataccgttaacaaaagaccatgagatctgtggaagaagaaaaaggagaactttatttcctatagaggattacagcctgcagattgggaagtggagcctccagccaaaactaaaagcaagcacctggggaggctgaggcaggtggatcacgtgaggtcaggagtttgagaccagcctggccaacatggtgaaaccttgtctctactaaaaatacaaaaattagcgggatgtggtggcacgcatctgtagtcccagctactcgggaggttgaagcaggagaatcgcatgaactcgggaagcggaggttgcagttagctgagattgcggcactgcactctagcctggacgacagcgagactatgtctcaaaaaacataaaaaaatttaatgttagcaggttagtttgtggtacaaacatgttatgtgcatgtaatgacaaggcattatattccaggtttttttttccttcttttgaaatgagtgattaaagatagaatttctaggactatttatttatttttgaaatagagatggggttgctcagggtgatctccaactcctgacctcaaagacatcctcctgcttgggcctcccaaagtgttgagattacaagtgtgagccactatgcccagcacttcagagttattaatgaggtttaaaaacatgtttttagaagtagatttaaagctctctgattgagattggtttaatactatttgatgttatttgcatataggctcttctgacaaaaatatgttaattaaatcatgtcctctttggccactaatcaggtcccctttctccctttccaaaagtaacagtttttgtccaagttagttaaaacactattttttggtgtatgtggtggctcacacctctaatctcagcactttgggaggctgaggtgggaggattgcttgagcccaggagtttgagactagccttggcaaaaagacgagagagaccccgtctctacaaaaattacagaaattagctggatatagaggtgtgtgatggtgtcccagctagttgggaggctgaggtgggaggattgcttgagctcagggttggaggctgcagtgacccttgatagtgcttgaaatgtcaaatgttactattcatttatatatttccatttggttcttactccatagtaaagcttagcgcttcaactgtttagagacagtcttattgagcagcataagttgtaccatcttacaattataagaaaagactataggccattaataatattcatagaaaggaaacaatctttaataataaaaccccaacaatgccagtaattgctttaaagtactaatgatgtatttcctgatgaaaaaatcaagaacaatataatttttaaatttttttttcctttttttttgagacagggtctcttgctctattgcccaggttggagtgcaggggcgtgatcatgtctcactgcagtctctgcctcctgggttcaagcgattcttctgccttagcctcctgagtagctgtgattacaggcaactgccgccacacccggctaatttttgctttgttgttgttgttgttgttgtttttgttttttttttttgagtcggaggtttgctcttattgcccaggctgtagtacaatggcatgatctttagaggtgaagccagctgggcttctgggtccggtggggacttggagaatttttctgtcttgctaaaggattgtaaacacaccaaacagtgctctgtgtctagctaaaggtttgtaagcgcaccaatcagcactctgtaaaaacggaccaatcaggactctgtgtctagctaaaggtttgcaagcgcaccaatctgcactttgtaaaaacgcaccagtcagcgctctgtgtcttgctaaaggtttgtaaatgcaccaataagcactctgtaaaaacgaaccaatcagcgctctgtaaaatggaccaaccagtgctctgtaaaatggaccaaccagtgctctgtaaaatggaccaatcagtaggacgtgggcatcacaaaataagggaataaaagctggctgccggagcccgcagtggcaacccgccggggtcctcttccatgctgtggaagctttcttcttaggctcttccccagtaaatcttgctgctgctcactctttgggtccgcactacctttatgagttgtaacactcacattgaaggtctgcagcttcactcctgaagccagcgagaccacaaacttatcgggaggaacaaataactccagacacgccattttgagagctgtaacgctcactgcgaaggtctgtggcttcaccctgaagtcaagcgaaaccaggaacccactggaaggaagaaactccggacagatctgaacatctgaaggaacaaactccggacacaccatctttaagaactgtaacattcacggcgagggtccacgggttcattcttgaagtcagccagaccaagaacccaccggaaggaaccaattccggacacaatcttagctcactgcaatctccacctcctgggttcaagcgattctcctgcctcagcctcctgagtagctgggacaacaggtgcccgccaccatgccagctaatttggtatttttagtagagatggggtttcaccgtcttggccagtctggtctcgaactcctgacttcaggtgatccacccacctcggcctcccagagagctgggattacaggcctgagccaccacgcccagccctaatttttgtatttttagtagagacggggtttcaccacattggccaggctggtttcaaactcctgacctcaagtgatccactggcctcggcctcccagagtgctggggttacaggcgtgaggcactgtgcccagcaatattttcttttttaatcagatgagttttgcttttgacaaaaatttgcttctggccgggcacggtggctcacgcctgtaatcccagcactttaggaggccgaggcgggcaaatcacctgagatcaggagtttaagactagccaggacaacatggtgaaaccctgtctctactaaaaatacacacgcgcacacacacacacaaactgaggcaggagaatcgcttgaactggggaggtggtggttgcagtgaatggagatcatgccattcactccagtctgggtgacaagagtgaaactccatctcaaaaaaaaaaaaattgcttgtaattctatgttgattccaaataagatttcagaatagtaagctatttcccaactatttaaatctttgaggagtttattgttgcagatgtgcaaaccagatagatctaccggatgctactttggtatttggtatctttttcaggtttttgctaacaaccacaaaagactatgtttgtttgtttgtttgtatattagaggaaaatatttctgcagcttgggaatatatgggactaataggcatgtgtatcaccagtgtgtatgataccatattactgcctgaatgaacacatcagctgtaagaaggaaggtgagaatttgagaaatactggtctgtgttttgggtttatccattactggagttgcacgttttcccttgtcataattcctgtagcttttagctcttcctcattgtctgttgagttgaattaactctttctcccccaccacatttaactctagggagtgtaaacttgtgctgttctctttctcattccatgtttctgttgtcttttagttaacatcttgtctttgaggggaatgaattaacttctttaagggaagtgaattaactactttgagagaaataggagaaagagcagggacaaaataataacctgtggccaaaaggaggggatgtgatgtatgatgaaatgtcattcctttatcttatcttatattcttgcagtgctagctgttaaaatggatccagtagaccttaaacctaggcccttgtttgtgctgcccgacttcatgtgctatagtgcattttaaaatttattcagccattcatttcttatcttataaacttgaatttgttttaattttgtatagtttttcttatttaggaaggactttgtgttcttacatgagtttcatataatagagtttgaaactaagctattaaattatgatgattgccctaacatgtgcatcaggtacttttttgttttgtagttggttttattggagccattgcatgtcctaacagggtaaggagtgatcatatagaaagcaaggaagtgatgggtttggtctctggtcaaaccatagaagtgagttgagtaattcatttttgctctatttttccatctgaaaatgggaaggatgatatcctgactcccagtttatgcaagttttgttcatagataaaggtgcactggttttcactcatcttttgtgtgaaatttctggtggcataggaatttagaaagaaatcaataaacttgtgattcttgttctgaagatacttctagccttgtaatcccataatggacataagaccattacacgaagaaccgtagcatgtagtaaatggcatgatgacattaccacccaaggaaaatgtgcagtggaaactcatggttcaatttgacaaggcgtttatcaatctccaccatgtgccaagcctttctgggcagctgagagaagagataacaaaatagtttctgttttagagaacagggaatagaaatgatataaggattgagatgatatttttataatactttaggtttattctgcacaggcaaactgtgtattatacgacacataacttatgacacttaggtttctaactgggaaattgtaggtgcttgtttagttattgggtgttgttaatggctttttggtttggcagtttgtctaaggcctagcagttgtttgaggaacatttacatataggattaaccttttgtaatgttttcagaatcctgcagtttcgatgctttctagatatttaggatttgatcattaaccaggtgataatataagcatgaaaaaaatgatttgggctgggcgcaggtggctcatgcctataatcccagcactttgggagggtgaggtgggtggatcacttgaggtcaggagttcgagaccatcttggccaacgtggtgaaccctcgtgtctcctaaaaatacaaaagttagctgggcatgatggcgggtgtctgtaatcccagctacttgggaggctcaggcaggagaatcgcttgaacccgggtggcgaaggttgcagtgagcagagatcgcgccactgcactgtagcctgggggacagagcgaaactttgtctcaaaataataatattttatgtgaaaataaatgtaataaaggttaagcttagtattttaaagtttgtttattcctagggagtaatagttcccacattaaacatgaagagtttttcaaaactcagtgatcattctaattggtatgaagcatgcaggaggtaattagcttaagatgcaatggtggaaaacatgcataatttatatacaagccttgttacatgtgcagctatgaaagagttctttttcatatggtcagttatatgttatatgtcgacaagataattaaaagtagatttataagccaaaatttaatgatggttaagttaatggaaattttccctcaattaaaaacattcaacaataatgtaatatcacctcacctgggtgaaatgagtttattttatcttattatttttttaataggctttactttttagagcagttttaggtttacactgtgaaattgagaagaaggtacagagatttctcatgtattttcttcctcccatcacgtatgtacagccgcctccattattaatatctgtctccagagtggtacatcattataattgatgaatctacacatcattatcacccaaaatttcttttatttttaattaaaaatttttttaaaaaatagtacaaagccccctgaaccttgctgaaggtgtttttttttgttttttgtttgtttgtttgtttgtttgtttttgagacagggtttcacttccattgtctaggctggagtgcaatggtgtgatctcggctcactgcagcctctacctcgtgggttcaagtgattctcctgcctcagcctcctgagtagctgggattagaggcatgtgccactgcacccgagtaatttttttttttgtatttttttttttagaggtgggcttttgccttgttgcgcaagctggtctccaactcctgaactcaaacagtctgcctgccttggcttcccaaagtgctggggttacaggcattagcctctgaacccagctggtgccctataactcttgaacactttagtgtgttttttccacaaacaagaatgttttcctgattaatcacaaaatagtcataacaatcaggaaataatattgatatatttccactgtctaatcctgaagtctccattaacattttgccatgttttccagtgatatcctttcttcttttttgaggcggagttttgctcttgttgcccaggctggagtgcaatggtaggatctttgctcactgcaacctctgcctcccacgttcaagcgattctccttcctcagcctcccaagtagctggaattacaggcacatgccaccatgcctggctaatttttgtatttttagtaaagacagggtttcaccacgttggtcaggctggtctcgaactcctgacctcaggtgatccgcctgccttggcctcccaaagtggtgggattacaggtgtgagccactgtgcccggctgtgttcatttttttttttttttacggctgaataatattctagtacatggataataccacattttgtttacccatttgtcagttgattgacattctgatttttccaccttttgccaattatgagtaatttcataacatataacgttataaatattcatgtacaagtttttgtgtgggcatatgtgctcgtttctttggggtatatacctaagagtagaattgctggatcatatggtaactgtatatttaaccatttgaggaactgccagcctgttttcccaggtagttgcactattttccatttccaccatcagtgtgtgagcgttccagtttctccacattgttgtcagcatttgtggactgtctctttatttaaattcaattaaattttttgagacagaatctcactgtcacctaggcgggagtgcagtggtgctatcttggctcactgtaacctctgtctcccggattcaagccattctcatgcctcaaccttttgagtagctgggattatgggtgtgcattactatgcccggctaattctcgtatttttagtagagacgaggtttcaccgtgttggcctggctggcctcgaactcttgacctcaggtgatcctcccgcctcgtgaccaaccacgcctggccaacggtctctgtttttaagagacagggtcagtctctgtcgcccaggctggagtacagcggcatgatcataagctcactgtaatctggaactcatgggctcaagcaagcctccagccttagtctccctagtagctaggactagaggtagacactaccacatgtggttactattttttctttttctttcttttcttttttttttttttttaaagttgaagtcttaatctgtcgcccaggctagagtgtagtggcgtgatctcggctcactgcaatctctgcctcccgggttcaagtgattctcctgtctcagcctcccaagtagcagggattacgggtgcccgccactgtgcgcagctaatttttatatttttattagagatggggtttcaccatcttggccaggctggtctcgaactcctgacctcatgatccacccgcctcggcctcccaaagtgctgggattataggcatgagccactgttcccggccttttctttgtttttgttgtgtgttttgtgtgtgtgtgtgtgtgtgtgtgtgtgtgcgcgcgcgcatacttttaggtgttatatataagaaactattgcctaatccagagtctttgaagattttctcctaggagttttatagttttagctcttacatttagatctttgatccattttgagttaatttttgcatatgttgtaaagtaggggttcatatttactcttttgcatgtcactatccagttgacccaacaccatttgtttaaaagccttttctttccctcgttaaattgttttggcatcttcgtcaaaaattacccataaatgtgcagttttatttctggactctgaattccattgatctatatgtctatctgtatgccagtacttcagtgtttttattactgtacttttatagttttaaaattgtgacgtatcttctacctttgttcttccgtttcaggattattttggctattctatagcccctgaatttccatataaattttaggatcatttgttaatttctgccacaaaggcagctgggattttgacagtaattatattgaatctgtagataaacttggggagccatcttaatgatagtaacttttctgatccatgaacatggatgtcttttcatttacatcatcttaaaatttctttcaatgatgttttgtagttttcagtgtttagtttttttttttttttcctttagagatggggtcttggtatgtcatgcaggctggaatgcagtggtgtgatcatagctcactgcagccttgaactcctgtgctcaagtgatcatcctgcctcagtctctcagtagtctgggactacaggtgcgtgctactgtgcccggctgattttcgtattttttgtagagccagcatctcacttcattgctcaggctggtcccaaactcctggcctcaagcagtcctcccactgtggcctccccaagtgctggtattacaggagtgaactaccgcacccagccggttttcagtgtttcagtctcgtacagtcatgcgcagcataatgatgttctggtcaatgatggacagcatatatgatggtggtcccataagattataacagctgaaaaattcctaacacctagtgacatggtagccgtcctaatgttgtagcacaatgcattactcttgtgtttgtggtgattctggtgtaaacaaacctacttcgctactagtcgttatagaagagcaaaggcagaagacacacacatcacaattttaaaactatgaaagtacaataataaagacactgtggtactggcatacagatacacatatagatgtagcagctggttgtccaggctgggtggggtgctgcccccatgcctataatcccagctttttgggagcccgagatggaaggacggcttgagttcagaagttcaaggttacagtgataataataaagattattactggtatatgtatttatgatattgtactttttattttagagtttactcctacttattaaaaaaaagttaactgtaaaggagtctcaggcagtccttcaggaggattccagatgaaggcattgttatcagaggagatgacagttccataagtgttattgcctgtgatgaccttccagtggaacaagatgtggaggtggaagacagtgatattgatgatcctgaccctgtgtagggttaggctaatacgtctgtgtctcggtttttaacaaaaaaagttaaagaaaaaaaaaatagagaaaagagaaaatgatataaagaaaaaaatgttgtacaactgcataatgtatttttattacaacagtcaaaagtttatgaggtaaaaattacagtaaaggttaatttattattggagagagaaaatttaagaaataaatttagcgtagcataaatctacagtgtttttaaagtctacagtactgtacagtaatgtcctaggccctcctattacccagacatgttctagtcctgtaagctgcgttgatggtaagtgccctatgcaggtataccattttttatcttttatgctgtgttgttactgtaccttctctatgtttaggtattcaaatgcttaccattatgttaaaactctctatagtattccatatggtaacatactgtacaggtttgtcgtgtaggagcagtaggctataccatatagcctagtgtgtagtatgctctttcatctagatttgcgaagtttactctgtgatgtttgcacagtgacagaattgtctaatgacgcatttctcagaatgtatccctgttaagtgatgcatgactgtacttctgtttctaaatttattcctaaatattttattctttttctgttgtgaatggaatttgtaattttttttcagattacaattatcatataaaaatacagttgattttgtatattgatctttcatggttacttaaacttgaattaaaattacatttaaaattacattttgcatttccactagctaccattcaagcgcttcatagctacatgtggctagtgactaccatatttagtagcacagatttgattattttcaacgttgcagttttattagataccaaataaaaacaaaaaaatgagtaccccttttacctctaatttccctctgtccagaggtgcttcatttatgtatttatttattttttgagacagaatctcgctctgtcgcccagactggagtgcagtggcatggtcttctctcacagcaacctctgcctcccgggctcaagtgattctcctgcctcagcctcctgagtagctaggactacaggcatgtgccaccacgcctggctggtggctcattcctgtaatgtttttatatttttagtagagatggggttttaccatgttggccaggctggtctcgaactttttacctcaagtggtctgtccaccttggcgttccaaagtgttgggattacaggcgtgagccaccatgccaggcccagaggtactttaaactcttatctgtttcttctggtacttgtctccatatgtccatgtgatatgcccatattgctattttttgagattcagacatttttactatgagatatggtaacttagctttcttatatttcttcctatcttcttaacatgtagatttagcaacttttagatttattcattgtatccattatatctatataagtaatcacagctgaagcatagagtggattgtgattagattttatttatttatttatttttgagacaaggtttgactctgtcgcccaggttggagtgcggtggcgcaatctcagttcactgcaacctccacctcccgggctcaagccaacctcccaccttggcctccaagtagctgggactacaggcacgcttcaccacgccctgctaatttttgtattttttatagagacagggtttcgccatgttgcccaggctggtctcaaactcctgagctcaagtgatcttctcgcctcagcctcccaaagtgctgggattacaggtgtgagccactgcacccagccaattagacttcttaaattttttcttttccttggccctaataattcatttttttgacttgcttagttacctgtgaatctatctttaattcatctctaaactctcctctggatgtatgaatcttatatgaacatactgaaacatatcagtaaactaccaattgtcaagaccttcgaagggactgaatttttaccctgtctggaagttaacaggttagccagggagttttgtagatgctgtggcaaaagatgtgagacttctgggtcaaaggcgtaggactttattacagcaacaataatagccagcatattagcattttcttgcactatactggttcccaaggccccagttcacatattgtgataagaagaggcccaggtgatacttgtatatgcaagggttgtattacagggaagaacctgaatttaggtaacctaaatcttttatattggtctgtaaacatgcctgccctttgctccagagggatatgctatcttagtatcttctaagactgttttcgatataaacatttctggaaaagatggtgtggaataaaggtagtcagtacctctgctcacatgagtgcagagacctatggaaaattgtcttctaatatcagtttcatccatcctccccacaagaagacataagtgtgtcccctttgccattctccaatctggattgtctggattgttaacgttttagtcctgcttctcagctgcatctcagaagtttcctttgctgtcaaccttggatttcccttttcctctttgatgtagatcctattttctggatcccatgcttctttctaggctttccgttttgacagtgcatatcctctggtgcttcctgacaaagaatacatggaaagttaaaaaaagaagactgggtacggtggctcattcctgtaatcctagcactttgggaggtcatggtaagaggattgctggagctcaggtgggaagactagcctgagcaacatggtgagttgtttctactaaaaataaaataaaaaaaaaaattagccaggcgtggtggtgcgtgcttctagtccagactacttgggaggctgaggctagaggattgcttgagcctgagagtttgaagctgcagtgagctgtcattgcaccactgcactctagcctgggcgacagagcaggaccctgtctcaacaaaagaaaacaacaaaaaacaaaaaacccaagaggccaggcgcagtggctcatgcctgtaatcccagcactttgggaggctgaggtgggcggatcacctgaggtctggagttccagaccagcctgatcaacatggagaaaccccgtctttactaaaaaaatacagaattaggcaggcatggtggcgcacgcctgtaatcccagctactcgggaggctgaggcaggagaatcgcttgaatctgggaggcagaggttgctgtgagccgagattacgccattgcactccagcctgggcaacaagagcaaaactgtctcaaaaaaaaaaaaaaaaaaaaaacaccccaccaagaaacccctggtgtgctgaaaatcttcaactttcactagatggtttgactagatgtagaattatagattggaaataattttttccccagattgtaaaggcattcttttagtttattgtctcctagcttttgttgttgcctttgaaaagtcaagtagtgttttgattctcagttctttgtatatagttttttttctctctctctgaaagcttatggaatcatttattcctcatgatgatgatccttcctacgggtctttttcattaattgtactgcacacttaatgagtgcagttagtggagacatacttttcaggtctgaaaaaattaacttgtgttttttttgagacaaggtcttgctctgtcacccaggctggagggcagtgttgcaatcatggctcactacgagctcagactcctgggatctcatgtcttagcctcccaagtagctgggatcacaggcctgtgccatcacaccaggctaattttttaatttaatgaaattttattttattttatttattttgagacagagtctcgctctgttgcccaggctggagtgcattggcgtgatcttggctcactgcaacctcttcctctcaggtttgagcaattctcctgcctcagcctcccgagtagctgggactacaggcgcgtgctgccacgcccggctaattttttgtattttagtagagacgggaatctcaccatgttacccaggctggtctcgaactcctgagctcaggcgatccacccaccttggcctccgaaagtgctatgattgcaggcgttagccaccattccagtccaaatttttaaattttttgtggagatgatgtctcaccatgttgcccagtctcgaactcctgggctcaagcaatcttcctgcctcgacctcccagagtgttgggattataggcatgaactaccacactcggcagcatattttaaaatgcagttatttctgaaagtttttggttttacacaatttttttttttttaggtaataagatgtattgtaaggattatgcttacgtatggtacagagtatacttcacattgttcctgtcttttttgtgggggagggaatgaccgaaagcattgggaatgttaaaggcaaatgagtaaaaagaaaactaaaaaacgattacttcttcaaataatgaggaaagcgtttttaaaatttttgtctgtttttaaaaagcaagtttcatgttagatttcttaccacactcaattttttcctaatataaaatagatataaaatttgtgatttgttactttttatgtaagcatatatagtccagtctaaaatgaccaacttccaaatgtgttccagaaaagaatcatgacattttatagctgaaaaggacctaaaaatccagtccttttaatataacatatggtaactgactccttgggagtataaattaattatttaagagcaagtaagatagtagcagagctagaacaataactcagatgcccttatccattctaatatccacagcatttctagaaacctcacttaaggcattaatgtgataggttttactcaaaatagtcaaccacaaatgtagcaaatacctaggtgactttatgttctgaatctcacgaagattaacctctgatcatttgttttatttctaaataacctcctttttctaaagtgctcctctgacactttggtgtgtaggtgaatatcaagttaacctgcctcagttatttccagtttgtctatacatatgttgtctaggcagatgatataacatattttaaaagtgtcatgttattgagaactgaagccagtatatgttaaatgattaaaaggaacaatttaaagaattttaggattctttggtctcaagtgacagaaactgaatttggtttttggggttttttgtttgtttgtttgtttgtttgtttgagacagagtctcactctgttacccaggctggagtgcagtggcgcagtcttggctcactgcagcctccgcctcctggcttcaaacgattctcctgcctcagcctcccaagtagctgggactacaggtgtggaccaccacacctggctaatttttgtatttttagtagagatgaggtttcaccatattgaccaggctgtctcgaactcctgacctcctgtgatccatccgcctcagcctcctgaagtgctgggattacagccatgagccactgtgcctggcctgtttgtgtgtgtgtgtgtgtgtgtgtgtgtgtgtgtgtgtgtgtgtttgtttgtttgtttgtttttgagacagggccttgctctgttgaccaggctggagcgcagtggtagttagtcatagctcgctatatcttcactgcagctttgaactcctgggctcaagtgatcctcccttctctgcctcccaagtagctgggactacaggtgtatgccaccatgcctggcaagtttttaaattttatttttattttttattttttgtagagacaaggtctttctctgttgcccaggctgatcttgaactcctggcctcaagtgattcttctgccttgtcttcccaaagtgccaggattacaggtgtgagccaccacagccagccagaaatgtagtttgaacaaacttaaacaacaaaacgtaaatttattagttattaattaaaccatgtgaaggaacaggaatcactggaatcaggaactcaaacacttttagaattctgtgtctcgtttctgcttctttatgcatgttggcttcatcctttcagatgggcatactccattttctgtgagatatcctttcatgtgttttaggccttgtatattaatagttctgacatcagaagacaaaagcattctctcttttagaatcagtttgaaaaatccagccaggcatggtgattcacacctgtaattccagcactttgggaggctgaggtgggcagatcacttaaatccatgagtttgagaccagcctgactaacatggcgaaacccaatctctactaaaacaaaccacaaattagctgggtgtaatgatgcacgtctgtaatcttagctgctccggagactgaggcacaagaactgcttgagcctgggaggcagaggttgcagtgagccaatatcgtgccactgcacttcagcctgggtgacagagtgagactctgtctcaaaaaaacaaaaaacaaaagaaaaatccatggagggatctatgtcatggtcctgttgcttgaacaaaatcactgtgggcctaaaatgggcaaatgtattggaatttccttagtgtaggtcagactgtggggtgtgggatggagagaaggcattttgttttcctttttaatcaagatgcttctgagacaaatgtgatctgctatgacagattaaggtttttttaaataacataaccagtctttttatatatgcctttatattttccttcattttcatatgaactgaagacttctaattcccaagttgatagaattttcactgattacattttcacttgagttcttatgagtgatgtcttaatttagagtattcagcctgtagtttctctcatttgtagaatgtacaaagatcccaaatctgtactttgcttaatgtgaaaaaatcaatatttttaaaatctgttgtagttagacaatatacaggttatattcaaatatgtgcaagtatataaatgtatgtgtcttagttcattggtccttctaaaacaaaatatcttaggctggggtaacttagcagagatttattgcttgcagttctagaggctgggaagtccaagatcaagacgtcagcagatttggtgtctgttgatgacctgttcctcataaatggtgccttctgtgtgtcctcatttggcagaagggacaaacaagctcccttggacctcttttataagggcactaatcccattcatgaaggctctgcctaatcacctcctaaaggctccacctcttaataccatcaacatcagtgttaggttccaacatgtacatttttgggggggggacacaaaaattcagactatagcaatgaatatttagaaattaagcagttttggccaggtatggtggttcatgcctgtaatcccagcagtttgggaggctgaggcgggtggatcatgaggtcaagagattgagaccatcctggccaacatggtaaaaccccgtgcctgctaaaagtacagaaattagctgggcgtggtggtgcatgcctgtagtcccagctactcaggaggctgaggcaggagaatcgcctgaacctgggaggtggaggttgcagggagctaagattgcaccactgcactctagtctgggtgacagaacgagactccatctcaaaaaaaaaaaaaaaaaaaaaaagaagcagttgtaccctaaaggccttttaagttagttaatgtggtctattttattttaggatttaaaaaaacactttaaaataatttaaaaacaatttgtgttgtcatgtgaggtcggttatcaatgataaaggttcttattggtaagaggatgaggaatgctttaaacaaaaggcgaagtgttgggtggagcagattatttggcttagatttttgagaagctggaaaggagaaatgggatatgatgaagggaaacaaatttggtggtttgggatagaacagttgaggcactgtaaacatgaggtaagaagaattaaagcagtgtaagtagtggaggacagagatggtaagaatagagagagatgaacaggctaaagaagcagtttagcaaaatggagaatttagataccaggaatgacctgattcaggctagtaagtgacgtttgcctagagatcagtctaactggggctcaagatatggcctagctgtgaaacaacagatgatgagtgagaagcccagcatgcagaaaagaagtttgcttggcaaaccagagattctaccaatatttagggacatggctttccaagatcaggaaacttctgagtttagaacattgactcaacacaaggttaaatgggactcttgtttagtctcctttgactcttatgctgttgctaatatcatttatgaaatcagcaaggaccaaaattagggtaacaactaattgttaccctttcaaggatgacgtatgctctgtttattcaagagtaatacattactgaggagaagcgtggcctcagcatgagcactagctccacaggtgtggctgatggctgtcagtgctttgtaaagcatgttctcttgaaaggagatctgaatatatgtgtctggctgccacagcaatccttgcttgaaataaaattttccattactgttagaaaagtcccagagaagtctcctgttggcctgtcttgagtcagtgccttagcctgtcagtggccaacaggttggtgtgcttttggcaggcttgggtcatgtgtcccttcctgaggggatgggagtcaattctcgggcttaaatcaccatatgaaagtgaaattctgttactagagaacagtaatggatgctgaacaagaaaatgtttggcttggtgtggtagtgtgtgcctctagtcccagctgcttgggaggcagaggcaggaggatcacttgagcccaggagttggagtctaacctgggcaacgtagtaagaccctgtctcagaaaagaaaaaagttctctataatggtggtttgctgcactgaattttttcttggcaggggacagtttgctgcactgaattttctctttttgtaggagacagtatagaagttgacagaatgctaaggaaaacagaatgaaaactaaaaaaaaggagaaaggcagagcctgttgtgttgcatggcaataaaaccagatgaagaatgacctgttttcaaccagacagttccttatttctacttaaaacatgactgttctatgcaaatacaggaaaatttaaaagggccattaacatagacattctccatccttttgcctagattgaatgatgtcctgtgtcttatagtgtcatttattgagcgaggtaccctttctcaaagctgtgtctgtgctaagtttgcaggaatcgaaattttgagtgattgtactatattagtgaggaaggctagtgaaaaataattacttcccttgtgatccttcatgaatccttaggagatttagctaaaaataattttttgttagaggaaacatttctaatgagttctgctgttgacagatcagtttggaaagaaaagagctctgcagttgatcagcatagtaatatatttctagtttatttgtatgctggaccctggatgacatagttcctgtgatctcagttattctggcagtagctcagctagttcatatccacagttgtggcaaaaacttttgtactgaaacaagtgaagtacagataatgtgacatccagaatgtgctattgtggtctgtttttcatctaagcatgaaataatgatattgaaaaattgtttttaattataagaggaatatataatgttagataaaataacctgtactttcactgtgaatatttattttcttttaataacttctaatatagcagtataaggtcatgttgtttggacgttctgggggtagttgctttatattcacattcatgtaattgggagtgtattacctttgggtcccactacattttaaatattgagttttactatattttattttgttttttctactggtattttatttattttattttatttatttattttgagactgagtctcactctgttgcccaggctgaagtgcagtggtgcttcacttggctcactgcaacctctgtctcctgggttcaagctattctcctgcctcagccttccaagtagctgggatgacaggtgtgggccaccgtgcctggctaatttttatatgtttagtagagatggggtttctccatgtcgggcaggccggtcttgaactcctgacctcaggtgatccacctggcttggcctccgaaagtgctaggattacaggtgtgagccaccacacctagcctatattttaaatacttttttgttttgagatggtctcactctgttgcccagactggagtgcagtgacctgatctcagctcactgcagcctcacctcctgagttcaagtgattctcctgcctcagcctcctgaggagctgggactacaggcatacaccaccacgcccggctatttttcgtatttttagtagagacagggttttaccatattggccaggctggtcttgaactcctggcctcaagtgatccgcctgcctcggccttgcaaacttttgggattacaggtgtggcccagtgcacctggcagtattttaaatacttttacattaaaaaaaaatttttcgtgagtatataggagtaggtgtatatatttatgggttacctgagatattttgatacaggcatacaatgtgtaataatcacattagggtaaatgggatgtccatcacctcaaacatttaccctttgtattataaacaatccaactatactctcagttattttaaaatgtacaattaaattattttttatgaaatcaccctgttgtgctagcaaatactaggtcttactcattcttttctatttttcgtatccattaaccattctcacttacccctacctccaccattctcactttccccctactccccactcccctacctccctatctttccctctacctcctcctgtcctacctccccactttccccctacccttcccatcctctggtaaccatccttctactctctatttctgtgagttcaattgttttaatttttaactcccacaaataagtgagaacatgcgatctttctgtgcctggcttgtttcacttaatataatgacctccagttccatctatgttgttgcaaatgactgaatctcattattttttatggccgaatagtactccattgggcatatgtaccatattttcttttcttttctttttttttgagacagagttttgcttttgttacccaggctggagtgcaatggtgcgatctcggctcactgcaacctctgcctcctgggttcaagcaattctcctgcctcagactcccaagtagctgggattacaggcatgtgccaccatgcctggctaattttgtatttttagtagagacggggttttaccatgttggtcaggctggtctcaaatgcctgacctcaggtgatctgcccaccttggcctcccaaagtgctggaattataggcgtgagccatggtacctggcctgtaccatattttctttgtccattcatcttttttttttttttaagttttattttgagacagagtttcttgtccaggttggggtgtagtggcatgatcttggctcactgcaacccccgcctcctgggttcaagtgattctcctgcctcaggctcctgagtagctgggattacaggcatctgtcaccacacccagctaatttttgtatttttagtagagacggggtttcaccatgttggtcaggctactcttgaattcctgacctcaaatgatctgcccgcctcagcctcccaaagtgttgggattacaggcgtgagccactgtggctggcagggaaagatacttgtacatgggtcaggaattgaacccgggtctcctgtgtgaaaggcgagaattctaccactgaaccaccattgcgctgacttatccgtagagcagataaacgaacagcaaccttggtcctttaaacttcatcttgaacttagaaataacaagaaaagacccttgagccccaaataactttttgacgagcatgcaaatgtaaaatacacttcagaaaggtttaaaaatcttttggacctcttatgctttataattattccttatagttgactaggatagaatacttaaagtttctattcttttatattaatgcacatacatatttttttaatttttttttttttttcaagagacagggtcttgctttgttacccaggccagagtgcagtgatatgatcatggctcactgcatctttggcttctgggctcaagtcatcctcccacctcaacctctctagtagataggactacaggggtccaccatcatgcctggctgattttctaaacttttgtggagttgaggtctcacaatgttgcccaggctggtcttgaactcctgtctttaagcaatgctcccgcctcagcctcctaacgttgtggaattacagacatgaactgccacgcctggccagcgttatgctttactccttttgataatggaagtaatacatgcccaagttaaaaaaaaattaagccatactgaaaacattttaaaaatacaaatcaactttatttccaacattcagagaaaacttaggttatcattttggagcttactttttggacttttttttgtgcttgtatttacacacaggcacatacagaattatgatgattatgttcaagatgctttgtaaccagctttttttcacttagttatatcgtagatatctttacatagcagtaatgcatagtaataccattttaaattactgcattaatgtactatatgaatgtattgtttagtcagcctcatgctttttctctttcatcattaaatgagttcatgaacatgaatattcttgtctgtacctttttcttatttcattattgtataatttaaagctacaaatgtagcagaacttgtaaaacttcagagtgaaatattgaagcccttgaggtgttggtattttttttattttattttttgttactctgggatcaagattaggaaaaatatttctctctctcaggctacgtgttttctggggctgttatctttttttttttttttttttttttttgagacggagtctcactctgttgcccaggctagagtacagtgccatgatcttggctcactgccttctctgcctcccgggttcacactgttctcctacctcagcctcctgagtagctgggactacaggcgcccgccaccatgcctggctaattttttgtatttttagtagagacggggtttcaccgtgttagccaggatggtctcaatctcctgacctcatgatctgcccgcctcagcctcacaaagagctgggattacaggcgtgagccaccgtgcccggccggggctgttatcttaatgcttacaggactttatttgtatttttatctttgtttatttttgttttttaaatttttttactttttgtgtttttttccatattggttttttcatgttcatatgtaaactgtcatagtatttcttagacatcattaatggatagaaatcttaattttaaaatggaaaagaagaatgagtctaactgcatgtgtcaacttaatttattttaaaaattacttaatgtttagctgggcctggtggctcatgcctgtaatcccggcacttcaggaggctgaggcaggccaatgaatcacttgagtctaggagttcgagaccagcttgggcaacatggcaatttacatcttttagggttataacacttacaatgtttgggaaggaaggatccttttattacttttagtttatcatgattattattaccattttatttatcatattatttataatttttttcttaaaatttttttttcctggatgctcttatagggttaaacattattatcactttaatcagacattatgttatggccacatttcacatattagagtgaaaggaaaagaggaattcagaaaagcagaagaaagtgagtcaaaatttatacgttcaaatcagtgctacctttccaagcaatatatactttgctgccactgctcaaattgtccattggatctcattttctagataatggctttagggttttatttgcatctgtgcaaagatgtgtctattcaacatgaaaacattagtgagttcagtcaatagtttggtttggggtttatgtgataccagtagttttcaattctggtggattagtttttttactttctggtggactcagcagaatcgttgtgatgagttttttggtaggttagtttgctagaaatgggttatttttgaattaatgatcactggtttgttttttttcccagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaagtgagaccacaatattttcctatttgcctatgaggaacccttaataataaacacaggctatctgtaatgctggcagcttttattatgtaagttaactcacatgtacgatttggaaaatagcaacttaatattaggttgtttttagattctgtctttttgtgggatggttatcttctctgtgattttgataggaaagtaaatcgtaatgaattttattaaaactcagttgtcatggtaacataatcagccctataatgaaacttcatccattcccccgcctttttttttttttaaaacaaatttcatacttctttatcaatttaaaaagataaacttgatagattggtggcttgttcaaaaatttttttttcttttggtaggatttatgtttactgggatggtaccatacctgcaataatggaaagactagcaaaccttatgaaattatttttattatatataatttaaaaaaaagtgtattacttcatgggcttgtaaaagttttttaaaaaatgttaatctgtcttcattataaaagccatactcatgaaaacccagaaaaagaagagaaaaagtagaaaaataaaccattttaccacttcccaagcttttctctgttaatattttggtatatctccttgtaatcctttttcctgtaagtagttttttttaaatgtaactgtgggctgggcacacatctgtaatcccagcactttgggaggctgaggtgggaggatcgcttcagcccaggagttccagaccagcctgggcagcatagcaaaaccctgttctctaccaaaaatacaaaaattagccaggtttggtggtgcacgcctgttgtcccagctacttgggaggctaaggtgggaggatcatctgagcatgcggaggtctagactatattgagctgtgattatgacatgcccttcagcctgggagacagagtgaaaccctgtctccaaaaaaaaataaaaaaaagtagccaggattataatagagtcagttatagaataggtataaaattttgggttctgcttttttaacttagcgttaaggcaaacataatctcttgatgttgtaagttcttcataaacattctcagtggctgcataatgttgcgtgtatatgttgtacctttcataatcattcccatattttggggccatttaaaataatactgcagtgaaaaaccaattaagttgtaaaatgcaatttaaaaaatataaaaatgataaaggttttggtctgcctccctttttttgaatagatctttgaaatgttctattttagcactcttgtcatttgaatgattattattcaacactctttttagacctaaatgattagaactattttggaatgaaaataatttttaaatgtgcatattattattatttttaatgtcttgagagttcagggctcttttcaaatgaactaaccatctttgagagtctaaagtttagcaaatttgtataactagaccaaatatagtccagataataaaatcagatatggtatttttgaaaatttgtcagaccaatttagagagatttcttatttaatattacttaatctgaaatctgaatttgccattataagggtttcttcacattttatacaaacttctgcagacatatcatttattgcttgttatattgtgtatcttaagttaaaaaaaaattggtgcgttttaatgagtgtaaggtaaatttcagttgggaaaggcctcctgaaggaaataatcaatgggattttaaatgacgaaatagatgaattttttttttttttaagagacaaagtcttgccctgtttcccaggctggagtatagttgtacaatcatggctcactgcaacctcgaactcctgggctcaagggatcctcctgcctcagcctctcaagtagctggctgggactacaggcacgtgccatgcttggctgattttttttttttttttttttttttttttttttgtagagacagtgtcttgccatcatgctggggctggtcctgaaatcctgggctcaagcagtctcccaccttagtctcccaaggtgttgggattacaggtgtgagccagtactcctggcctgaacttggttttctgtagaaggagggaggttgacaaattgctaatgtgatatagaatttcaagatctattcttgagaatcctaaaatttttccatgtttgaagcattagcaaaggatgttaaaaagaaacgttaaaaaaaagaacaaatatagaagagaaactagtatatttgagttcctaaaaaggaggaacaagttttactaggcattaggggagagtaggagagattatgtgggtaaatgatgacaacaagcaaatagcaatgaaggataataatttattttctgtttagaattttgtagtactttggtagaaaagtgttagcaagctcaaggaggaaggtgaatactcagccaccctagattttgagtatatgtattaattcagttattcagaacattttctttaggagtatcatataaattggcgtttaattaatgtggtcaattaatgctgtcttttaaagctatcttaatggattaagtaaaaaacagaagaatggatagagattaataaactggaaattacagaggcctcagtcaaagctgtcaggaatacgtcgaaccttcttttttcagagttgagtgtctagagggcaatagttggaggggtaatagatctgcaattctcagtggctgttaagtttatacagaatataaattattatgttggataaaggatcaagtctgagaaataggctgatagaggctatatttaagaaataagagtaattttaaaaatttatgtattttctagcatttgcctcaaggattgaaattttttttttttacttgtgtttacaggtagaattctttatttaaaaagtcagttgaatatcaaaactatttgatattcttcagactggaatattattctctagtgtagaagaaaacattttctgcttacaaaacaaatagtaaatactctaaaataggggttggcaaacttttcttaaataaaaggccagatggtaactattttaggttttgtgggccatgtgttgataactattttaggttttgtgggctacgtatggtgtcattctcctattctctctctctctctctctctctctctctctctctctctctttctgtgtgtatgtgtgtgtgtgtacttttttttttttggttgggggatggggtctcatgatgttgcccagggtggtcttgaactcctggtctcaagtgatcctcccacctcagcctcccaaagtgctgggattacaggcatgagccaccatgcccagcaaagagagatgacattgcatgtaaggatagagatgtggacagatttgagagacagtttaattacgttttcttttcttttttgtgtgtgtatttttaaacaatgatttaaaaatgttaaaactattcttagcttctgggccatataaaagcaggcagcgggccacattctggcatggagccttagtttgccagcccctgctctaaaatactttttccaaatgtttgagtgttaaattttattatgatgcttgtattattatttaaaatattgtgtgtttctagagggaaccagggggttcttgagaccagatttttgtgcaacttgggcaaaaatactagattccgagagtttgtagagaagattgagttgaaggaatggagggttcagtcaggtcaaagacaagatcacacatttattggaatggcaataagcctcaagagttgtaagggtagagttgtttaggactagtagatactagttatctagggtattgagtttcttttcccattagtattcttttctctattgcctgggtaagaactttaccacctttcagcctcctagccctttcatctattttaacgaaaaagaacgctgagttggcctgaaaaagatcagggcatctaggctttaccctgactcttctgctgacttgtgtgacatttgacttctttgaacttaggttttttcatctgtaaggtaggactgtttagataatttcttaaatgttttccatcttgaattccttatttttgcgattctcacaaatgagcttgattttatttgcttccattctgttctgttggttctgctctttacctcaatctgtgtccactggtctcaaccctctattactttaatgtaactgaactgtttcccaaattactctgaattgtaatccgaggatgggaattccattgactgtactctgtatcggggagaaatacttcaacaaaacaaagtaataacccactctttctaaatgtcaaatgttttcaaaaacaagatattaattgattaggaatatatagtatcagacacttttttgtattaaaaggacaatatagtattaagtagtatactaatttttactacattcatcatatctataaggcagtattagggttggttcttaacatggattatgttatgtattttagggctggtaaattttaaagaaatttcatctctagctttgttgctgttatcctattcattctttggaaggatattattaaaacaaatgaaaatttttatcttcaaactgatagtggagttaaattaacattaaatatttcccctaaatatatacttatcagagcaaacatgtaattttactgaatacttgtacaggtacacatacctttaagtcagtatagtgtaacattattataaggatgaatgttgcttactgtgcccattattttgtgtccttttctggtaagttttttttaataaaaagtttgcaaaacacttttcaaactaaaactcttatcagtttgtaaactaaaatttttcttttttctttttatttttattttatttatttatttatttttaattgatcattcttgggtgtttctcgcagagggggagttggcagggtcataggataatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggggctaaggtcaccgatcaacaggatcccaaggcagaagaatttttcttggtacagaacaaaatgaaaagtctcccatgtctacttctttctacacagacacggcaaccatccgatttcccaatcttttccccacctttcccccctttctattccacaaaaccgccattgtcatcccggcccgttctcaatgagctgttgggtacacctcccagacggggtggtggccgggcagaggggctcctcacatcccagtaggggcggccgggcagaggcgcccctcatctcccagacggggcggctggccgggcggggggctgacccccccacctccctcccggacggggcgggtggctgggcgggggactgactcccccacctccctcccagacggggcagctggccgggcagaggggctcctcacttcccagacggggtggctgccgggcgtaggggctcctcacttctcagacggggcggctgccgggcggaggggctcctcacttctcagacggggcggttgccaggcggagggtctcctcacttctcagatggggcggccgggcagagacgctcctcacctcccagacggggtcgcggctgggcgccctcatatcccagacggggcggcggggcagaggcgctccccacatctcaggcgatgggcggctgggcagagacgctcctcacttcctagacgggatggcggccaggaagaggcgctcctcactttccagactgggcagccaggcagaggggctcctcacgtcccagacgatgggcagccacgcagagacgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgaaccagactctgtctgcaatcccggcacctcgggaggccgaggctggcggatcactcgcggttaggagctggagaccagcccggccaacacagcgaaaccccgtctccaccaaaaaagtacgaaaaccagtcaggcgtggcggcgcgcgcctgtaatcgcaggcactcggcaggctgaggcaggagaatcaggcagggaggttgcagtgagccaagatggcagcagtacagtccagcttctgctcggcatcagagggagaccgtggaaagagagggagagggagaccatgggccgtggggagagggagagggagagggagcgggagagggagagggagactaaactaaaatttttctaagcgaggcccatcttttttctttgctagtaaaattagtcagtacttatccatgttcaagtttgtcatggcttagaaaaaaagattaagcaaggtcaaaaggcaacataaagaacttaagaaagtagtgctcttcccaccttcccaagggctgagtaggacttactgggccaggtgttaaattagttagcaggtaacaattaaaggagctggaaaataattatcataaaataatataaaattggaagtaattcttctcaagagctaggtattgaaaggcagtggccttaagaactcaacaagtagggtagcttttactgtctaaaaactttaggctgggtgtggtggctcatgcctgtagtcccagcactttgggaggctgaggcaggcggatcccttgaggtcaggagtttgagaccagcctagccaacatggcaaaattccatctctccaaaaaatgcaaaaattagccaggtgtggtggtgcacacttgtagtcccagctactcaggaggctgaggcgggagtatcacttgagcccaggtggtcgaggctgcagtgagccatgttcatgccactggattcaagcatgggcaacagagtgagacactgtctcaacaacccaaaacacaaaaactttatatagatagccttgcttaagaatttctaattttggccaggctccgtggctcacgcctgtaatcccagcactttgagaggctaagggtggccggatcacctgaggtcaggagtttgagaccagcctggccaacatagtgaaaccctgtcgctactaaaaatacaaaaattagctgggtgtggtagtgggcacctgtaatcccagctactctggaggctgaggtaggagaattgcttgaacctgggagcggaggttgcagtgagctgagatcgtgccactgcattccagcctgggtggcaaagcgagactctgtctcaaaaaaaaaaaaaaaaaaaaaggaatttccaattttaattaaggagatacactgaaggttatcaatacgtaattatgcatagaaagtagactttttatacttcccaattaatttcctatgtagtttttatatcactttatataaaaaaactgaaaattactctgttagtaactaatttgttttatgaatgatacataatttgaagcataattgtaatttaaatgtttatttgaaacattagcttactaataaaaaaaattgagacatatttaaaaacacccaatttagttgggttaatccactgtaactgtttgattgcagatgttttcccacactgatgggcagctaactgaggtagtgctatccagtacagtcaactttcaattatctgtggtaatgggaaatgacaatgcatggataatcctaaaacaaaatattttatacagtaccttcctgtcatctgctgtggcctgagcatgtgcttgggttcatgagggagatgtgggagtggggctcaggcttgcaaaggagctgggagtcagtatgattatctcaaggccataagaggtatccttaaggaacctgggtttggcactgtgtggctgaagtgtcatggggaaagcctgcagcatgcaagatcagcttggcaatatcagtgagaaggatggggaagctaattaataaggaactgtgggagaatagttgtttattaagtcctatacaattgcagtgatatatcttggtgtgttttttggttaatgggatctgtagcaaacaataattatattaattgtgtatttgaattagttttggtcatctttgattgctagcagaacacattttttacttgccacaggtgagtgctgttattgaggtctcttctaaataagtaggtttattgtcatataactagtaacttaaaaaacccagaataaatttgaaatacttttcttacttttaaaattcatcctaaatatcagtgttgaacttgtacttccaaaatttaacttaatgaaatttaacattgtaatgtcaaagaatatcatgagggcaaatgccataattactgatactgtgaatttgatgtaggaaaaatatagtagccatattttatttaagaatatgttacaggagctttcctaaatttcttttacaactgacaattgtctacgaatttatgaatgttaaagctgcatgatagatgtgaggagggagtgtttattattctatctaatttgaatatgcttattttctacaagtgaaagctataaaaaaattgaagcagatgattgctgaaaaccttagaatcttctggaccaacctgagaatcttctgcttgtttatgaaatagatttagtgctctctgtcaaattattcaaactccaaatagaaccgtagccattttctaaaggcatgttttcttctgcccacaggcaatactgcagttcaaccccgtgtggtagtatgatggcaagaatgcaaattataccgttgttagattacctttattattatagatgttttttaaaagttatttacttaaaatatctatacttaggcaaattagaggcgttgatcttgagtcgacttttgtgaccaaatttggaaacaattgcagtttgagattgaatgaggtaagggaccagctaattagtccttcctctatagatctttggttctcaaccagggaagttttgcccccaaggggacatttggcaatgttagacatttttggttgtcacatctcatggtgggggagtgctacagttatctacctggatgcttttctatattctgcaatcctcaagacagcagccttcacccctgcccacaacaaagaattatcaagcccaaaatgtcaatagtgccactgttgagttaccctgcccctagtgtttctaagatgtaggcattctttgaagtagacaattaaaaacatcatatagccaaactaaattattttgactttctgtatacttatgctgtttaaaaaacatgccttcagtttttactgagatttgatataaaaagcaacaacaaatatatttttaaagaatttaatcctgggaaacatttcactttcctgatgaattgatatatttcctcgtaactcattatgtttctattttgccttctctccctggaggcttagtgccaatttttttgctctattataacaatgaccctttattttaggcttattgttatctttctatttactgtattggtcttccctttttttttttttttttttactgttatggtctatgggtttgggctaagtgtgtgtttgtgtgtatatgaagagaacatgtgggtaatatgtaaatgtccccaatccctagaccaagtcacatctctataagatcaaatgaacagatttctaatttatattttaatgcttttttaaagtctcaatttttcaaacaagaaatatgtgcttgttataaaatattactgtgtgttagtgtaaataataagtggaagattacttctccctgttcattctctggagatttattaatatttctagtatgtgccaggcatagtggctcatgcctataatcccagcactttgggagactgaggcaggagcattgtttgaggtcaggagttcaagaccatcctgggcaacacagtgacatcccatctctacaaaaaataaaattagctgggcatggtggtacatgcctgtagtcctagctactcaggaggctgaggtaagaggatgcttgagcctaggagttcaagactacagtatgctatgattgtcccattgcactccagcctctgtgacagagtgagaacctgttgcaaaaaaatgtatatttatagtatgcagatgtgaaatagaagctataagcttgtaattctgttatggctgctcaggtttacactcttatagtttcatttctgaataagttaagtacatttctaaaaactgaggagaataaaaacaatgtcttgaggattgtgttatctgatgaaccttttattgatctgacgaagacccattttataaaaaaagtgtcatattttattttttgaagcatacttgatggtatgaaatggtatttctagcccatacttttaatgatttagaatgactcactaaactttattcaaggccagtacattggcttactcctgtaatcccagcactttgggaggccaaggtgggtggatcacttgagcttaggagttcaagacctgcctgggcaacatggaaaaaccccaactctacagacagtagagaaattaggccagcatggtggaacacgcctgtagtcccagctccttaggaagctcaggcgggagaatcatttcagcctgagaggtcgaggatgcagtgagccatgatcgggccagtccactccagcctgggcgacagagtgagatactgtctcataaaaataaaatttaatccaaatgtgattaatttccatttctctaaagttaaaaattaagtgaattccaatatcatcactaatatgcaagcttaacttttctgttacagttttcccaagcagttgaagaggaaagctattctcataattagcctaacatgcgtagaaaagtttagagattattttttttctttttctttttcttttcttttcttttttttttttaagatggagtctcgctctgttgcccaggctggagtgcagtggcacaatctcggctcattgcaagctctgcctcctgggttcacgccattctcctgcctcagccccccaagtagctgggactacaggcacccgccaccatgcccggctaatttttgtatttttagtagagacggggtttcaccgtgttagccaggatggtctcgatctccggactttgtgatccgcccaccttggcctcccaaagtgctgggattataggcgtgagccaccatgcctggctgagattgtttttttcttgaatacttaaaattgtaagattactaccatggttagttttttatttgatgttccatttatacattcgttagctctggaacatatagatcctgttgtttttaaggtctcttggttgtagagaaataagaggctttgaatttgtttcaggcttacctcatacttgaggcagtttagaaggataaatgatcagtgttcagatttcttaaagcagtattttataatgtcatgatgattatcttttcactgttactaccaggttcttttagaaaggggaaattgaagtaggacattgaagtgggactggggaggagttagcaaaaaatgtgtctgttgattgctgcttgagccaggaattggtggtaagagatgtgaaccattttagtgaagtgatttttcaaactcttttgactgcgacacacaggaaaaaattttttttacgttgtattcagcacataattcatgtatatatttatatatataataaacagacttttcaagaaacagtattttaccttactatgtgtacatgcagtctgatgtttctgttctatttgatttgaaataattgctgcttacataccactaaattgcagcttgcagtttaaaaaattttgctttagtgtactaattacctgtgtatgtggagaaattcaccctctgttagcaaatagaagattgtaattacaatacattcttactcgtatgtcttatgtgagcatttaataaatataaataaattaatgaaatattttacaggcattttgtcatgataaaatataagcagctttgcccaagcaacttggtcttttggggtcaaaaaatggcttttttgttttttgacacagggtcttgctctgtcacccaggctagagtgcagtggtgcattcatggctcactgcagctttgacctcctggactcaagcagttctcttatttcagcctctcagttagctgggattacaggcatgtgctgtcatacccagctactttttgtagagacggggtttcgccatgttgcccaggctggtcatgaactcctgggatcaagcaatctgcccaccttggcctcccaaagtgcttggattacgggcctgagccactgtgcctggctttatttttaacattatatttcagccctctttctttttaaataaaaagatgtttaaacatgaatagaaattatactaataggtcattagaaatgtaactagattaatttcgggggctttcttaatcactatattagtctaaatcttaatggagagggaaaaattagcatgctttaacccaggggttggcaaaccttttctgtaaaggagccagctaatatatacttcagtttttgtgggccataccatctctgttgtggctcatctctgccattacagtgtaaagcctagacagataagcaagtgagcggcatggctgtattccaataaaactttacttatggaaaagcaaatttgaattttatataattttcacgtgaaggttttttttggttgttcttttctccaaacattaaaaaatgtaaacaccactcttagcttgtgggctgtaaaaatcagatgatgggccagatttggcctgtgggccatggtttaccagcccttgctttaacctaaaaatggagaaaatcagtagtccagaagaataaaaatttagcaagcatagtttagaatatgagtagcaatattaaatctctaggcatatatattttgatttttgtggatattagaactatacatttttgtgttgttttttacattatattttgcagacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtaggtataatttttttcaagcttttaaaagtagtaacccataatgaaaccaactcttgagaaaattaagctttttatctgtctttctttcctagaggacaaagtcttggcccagttgtggttgtgaagattccttgctactataactgttttaccctttttgctttttcttagtgatgtattctcaagttttaaacagtcatctttgaatgaattatatttgcttggttatgataatacctcctatggtttgagtaaataagtgtcgtgtaatctttccaattttaatttaatatgactgattaaaaaatcattcatcatgttattatgaaagtgtttaccttatctcaagtatttatcagcagacttttggcattagttttcaaaaacaagatatattaatagacatgtactttgaatttttctaaaataattttatcccaacattttgggcaagaatagtgttaggtaaaagtgataggtgaattaatattgccactgcttttgagtgtgtagctattacatattttggctgtcttttaagatgtatttgggtgcctagaacatgcaaatttcatttaaattggtgtttgaacttaatgattcagagctttagctgagtattaatttatgtctgatcagtagtttgaaagacagtgacttatcagatgtgactaaataaatatacatgcttataatgatactgtacagttcatgtagttgattttttttctaatataaacatacttaaaaaacactgttatggatggaaatcagttaaatctaaatttaatggagatctaggtaaaaagaaaatatacactgtaaatttatttttaaaatctctttgtcttcagggttttgatgcaagcactattatctggaatatgatatttaatttaacttttttgagacagggtctcactctgtcacctaggctggagtgcagtggcacaatcatagctcgctccaaccttgtactcctgggctcaggtgatcttcccttgtcagcttccctgggactacaggcacgtgccaccatgctgagctaaattttttgtttgtagtgacagggcctgtctgtgttgcccagggtggtcatgaactcctgtacttaagtgatcttcccaccttggtctcccaaaatattgggattacaggtgtaagccatcgtgcctgcccaatatttaattttatagccaatacctacatgcatttagattactaataagagcatgttaaaataagatgtgtaattggatggttagttaataactgaaatttcttctaacttgggaaaatttattcaaggctaacaactgctaatggaatattttagaatacctctagaatctaatgccaaaaagacacttagaatataaaagatgacatttgtgtttgcccaattacataagaaaaaagtaatcccatttttttaaaatatataattcataggtttacatcccccattcttataatcctcaaagtaaaatgtttttctttcaggattctagccccttcattttttgactttcagtgtttaagggtcattaatttgaagaaatctttaatacagttaaattgtggaataaaacagtatcttaaattcatcagagaaacttctgttcatgacacattctgctttaaccactctttctatgatctactgaaacattattttgttaatgctgaatgcttaacttgttttttctttttttcctttctcttcacatcctgaagtttcaactaacctttcaatgctttttttccttacctcttttatttgctccatttatgcattaagtggttgcttagatttaaggtaagagattccagggctggatttccattctttgttcttatgtagaatattacatatggggagttaaagagattgttaactcttggccttttaaaacccaataaataattcctcctttttgttttattttttgtcatgcaactttgtggtgtgtcttcatgttccttgagggcagatatttttgtctgttttgttcactgctctatccttgtgcctagaacagtacctgacacacattaggtgcttagtaaatatttgttgaatgaatggttattttgtaatgttaatatattttgtgaaactgaaatgtaagctaccctatcataaaaatgttatgaaatataattagctggatttttataaatatagagactttgttatgaattggagggccaattaatgtactttatttaaccctccccctgtgtaatagcctttttattctataaatggtatgctttctgatataccttatggacaatatgtcattatcttttaatcagtataaagaaattgagaagcagaaaatattcagtgacacgggttttttttttaagttgcagtatcatattttgtagaaaaattattcttttttccaaatagctgtataaagaatatatttcaatataaactgtaagagcttttaaaggtgaatataattatatgcaaaacatcaaaagctcatgataatgtttaacagaatatcagttaagaattagagatatttcctgttagaattcgtttcaataatgttttggtatcgtggaggattcgtgataaaagaaattcaactatattcaagaagcctgcctaaaatacaaggttactacaattatatacaaaacttagcatgcatttcttctttgatttttttttgtaggtgagttttatagtttattttcaaatatatattcctcccatctaatacccattatttgccatatctttagtgtagaaagtgatgacaagatgactgagctctgaatcattaactagtactaactaaggccacacaactttcccctgcccgtggtaggtagatttgattggaagagcccaggcatatggacacctgtattattgattggattgttggttccaaatcctcagtcatggtgagtaagatgtggaattgtgaagaaatccttttgcttgaaataggtgggttgcagtgaactagaccaaaagcagactgtggctgctttggcccttttaccctaaagtctgtattcaaattttgaccattgatgtgttaacctccaaagtgatagaaatacacggaaagtttaattgaagaaaaaatacagaaacacacagattctttacccttaaagtttagactagcttgcccaagctactatctcatgcttgttttctctaagccccagtatgattccttcttgatgttcctgcgtcaggatctgtttccattgtgagagacaggccaaacagagtctcctagaaagatctaatgaagaatcacacttagataagatccctgagctttttggagacctgtggattctagcaagtgtcttagaagtctcctgatgagcaatagcattatggattccttatcctcattttaatcagggtagctgattaaatgttcaaaatttaaaacctatttaagacctagtcgtttttctttctacttctctttttctctttctcagcactttttgagctctgtctttgctgctcccattgctgtcatactttttatacttttcagacagtctccagagaaagtcatcatactttaggaccagacatgtgggatttgactcagaagagacctccttgtttaaaagtttaacttttactattttatacagcatgtttgatgcttaattgttcttgacatctgaaatttggattaactgtttttcttcagtcaagttacaaatttaagagttcataagatttttaaaaacactatggtaatagttttatagcaaaggacgtacaaggtcagtggatagaatgccatattggaggtgttttcatatatacctaaggccatataaaagtggaatgtaccttgaactggttcctgttccatactcttgtttttgtttttgttttttttttttttttttttttttttttttttttgagacagggtctcactctgtcacccaggctggagtgcactggtgtgatcatgactcactgcagctttgactgccctgactcaagtggttctcctgcctcagcttcctgagtagttggtactacatgtgtgcaccaccatgcctggctattttttaacaaattttttgtagagatggggtctcactgtgttggcctggctggtctcgaactcctgtgctcaagccatcctctcacctcggcctcccaaaatgttgggattacagttgtgagccaccgtgcctggccagtactcttttagtagtaaaaagaattttaagaccctgttactgaggtcagtatgatgtgtttgtaatgaatttttctgttgaatgcattaaaattgtcactaatgaagctaaacttaagtatttttaaaataagcatattagtttaatcaaaagtaataaaaacttctgacttttaatgtattatttcagttgaacatcgcccaagcagattcttttttttttttctttttttcttttttttgagaccgagtcttgctccgtcacccaggctggagtgcagtggcacgatcttggctcactgcaacctccgcctcccgggttcaggcgattctccagcctcagcctccctagtagctgggattgcaggtgcctgccaccacgcctggctaatttgtgtacttttagtagagacagggtttcgccatgttggccaggttggtctcaaactcctgaccttgtgatccacccgcctcggcctcccaaagtgttgggattacaggtgtgagccaccgcacccggctcagattctttttttttttttgagacagtcttgccgttgcccaggctggagtgcagtggtgccatcttggctcactgcaggctccacctcccaggtttcacgccattctcctgcctcaacctcctgagtagctgggactacaggcgcccgccacctcgcccagctaattttttgtatttttagtagagacggggtttcaccgtgttagccaggatggtctcgatctcctgatctcgtgatctgcccgcctcggcctcccaaagtgctgggattacaggcgtgagccaccgtgcccggccagattcttaataattaatgagcagggcttaagagttttacagccagcaaattaagaatataatacttttaaaaattttgcttaagatcttgaagatccatcatttagccccatgtttaaaaaatggactgttttcacttgagtactatttttagcaagtatttgtcattccttacagaaatatgataaattccccttatatttctagctttcaggtacagttgaaggtacactcttaaaaatttatccgacacagcacctggaggaaaacctttgtagtaacatcaacctttgagagacccatctgtttttgcctataagttccaaccttaagccatcaattctgttttgacaaaagccagttgttagaatctgttttcaaaatcaagcaggagtttgtccatctttatttctcttgttttcttctgctttctttacctgtttctctttcctcttactcctaatcttatgttcccttattctctgtgttttattgttggactcttgactcgataggcttttttgtcttttaaccctttttctaaaaatcttaacctctgtcctgaatttatactctaattcctggtttcagctttgattttcctcagaggatcttttggtccttttcctggtgtcccttaggaattgaagtaggaacatacatcctctgaagagagggatagaggtctctagaaagccaaataattatgtactagatgggactataatggggaacaaaactggacagagaatgaaggcccaaaggtgactgacctcacttttttcccatcctcactatttcacatacagacacaacctacacacacttcccctcttctatttgtgtgtttaaattctcttttcttttttttaaagagatggggtcttgctctgttgctcaggccagagttcagtggcatgatagctcactgtatccttgggctcaaatgatcctcctgcctcggcctctcaagtagcgggactacagccactcctggctgttttttttttttttttttttttttttggagagacgtggtcttgctgtgttgcccagtctggaatcctgttcttttaaaacttaacaagtttaagaaattattagggaagtttcatagagaaaaaccagctcaggtttttctctatgaaacattccgtaaccttcccacattgatatttctttttttttctatagaatctgtagacattgctttttttttttttttttccacgtggagtctcactctgtcacccaaggtggagtgcagtggcgctatggctcactgcaacccccgcctcctgggttcaagtgattctcccttcctcagacttccaagcagctgggattacaggcatctgccaccatgcccggctaatttttgtatttttagtagagacagggttttgccatgttggccaggctggtctctgaactcctggcctcaggcgatctgcccaccctggcctcccagagtgctgggattacaggcatgagccaccatgcccagccagacattgctttttattttaggcatgtgagtcttatttatttcagaatacctttaaagcagagaaatcattctatagaccgttttgtctccttttttttccccgcaggctcccttccttttttttttttttttttttccccacatgcctttactcttgtacctagagggtctagtaggagattaatatataaggtgtataccacacataacattttaggatgtgtctgccactgttctgtggtagtaggtcatctgttaatgggagatttcatagcagaggtgatgtcttctatgaattagagatacttggctgtccaggcatgatatttgtaatgaatattatatcagtattcaaggaagtattgaatgtaccaaagaaggtagagcaggataggtaggagcattgtagaaaaagtattaagtcacaataattggcttaatgtgtggtgccagttgtagtgatctccaaagcctggtcataaaggaactgcttctacctccggtggtatttgcattccttcatcatagcctattgggaaagtgtttgagctgtggccatgcattaaccttcatcacctaaatgaaatatttcttctgttttggaggtttctgtctggtagggaaaaagtggggacttttccaacttttctttcttgtacctaatacctgcttcacttagctcttgaggtcttttcattttatggaataaaaaaatacataacaaaattatgattggtatcggccaccagagtattgttctaatttcctaaactgctgtgtgtgcctgatgatagttctgctatgtttgtaactttaaaaagtatttcaagtgaaattactattatgaagtggctgcagtattgctttgttttccttgtcttgagtttatggtatatgttctgtctctctctctgtcgctgtcgttaagttcctctccatcagcacatagagatctcatgttttgctacttgtcaggaaatgttttctctcttaaatacttccctcaaaatagtttttttaggatcaatcatgatggctgtctagtaaatatatttttatatttaccagattattttagttctgaaatatagtttaactttaattataatatagattttacctattataaaaattgttttgtttggcatttatttctgttcttccttttcttcaaatttgatggcagtatttatattctgcatagcatatttattgttttacttagcgtagaaacatttttcacacgggaaaagctgccttgaggaaatattgaaaaactcttttaatagaaaggtaatgaaatattaggtataaaattagattgtttggacattctacagagactcttgtttcttaagtgacttatgttagtcatccaatcccattaaccaaacaaatatacagtcatttgatgattctacagatcataaaatgtaccaagttatattcatagaaatgttggccaggcatggtggctcatgcctgtaatcccagcgctttgggaggccaaggtgggtggatcacctgaggtcaggagttcgagactagcctggccaacatgacgaaaccccatctctactaaaaatacaaaaagtagctgggcgtggtggtgcgcctgtaatcccagctactcgggaggctgagtcaggagaattgcttgaacccaggaggtggaggttgtagtgagccgagatcaggccattgcactccagcctgggtgacagagcgagactctgtcttaaaaaataataataataataataaatgtccaccagattttaatatatagattgtttattttatgctattttttttggtggggggcgggtaggtccaaagacttacagaagatactgcaatttaaacaaaaacaccttgcataccaaaacttaaaacaaatataagctggaaagctcttttcaaatattttagctatcccatgtatagaataaaattctctcttaaattcctgctccttttccttcctgtttctcagcaaattgatgtagttttagtgtttggttcacttctccctcatcacttaaagtaactttgggttttatgttgtttaaggttgagcttaaaggactttggttaccactttaaaaaaatcttctggtttcagaaattaagatatgcagttttaaaagctattcattatttgtcatattactcctaaaattttccccaaatgtggattgatttttttaaaaaaactttttctggcattttcattttaagatacaagtagtataccctccgcttattaatgagagggagagcaaggataagttaatctttactcttacttgataatgtttgtttttattgtttaaaagcaacaacaaaaggattacagataaatgcttcactttaaaatattgacatttcaaaggtatcatttgtcattaaagattgttttaacatcacacacaacttgttcactgggctattcatttgaagaatttgtttcttgagatagtatttcttgcctattcaaataacaggtagtattttaggattttaaaaaattccacttaagccagggttggttttgatagcctcacttctctgtatacaattatgatttgctttcttaaaatttatattctgaagttacagttataaatgtattctgatttcaatggtatgatgtcttgcaattttatttagaaagtataatttgactactctagccatattatttttagaaaagttgaggtcctttttcaaaatatgttttgaagatggaaattcaaaatattagggtcttaaaatagaatcacatatgaacctgtgtggtgaacattaacccattggtagtctcaacttgagactgcatttgaactacacttgtgagtgatttttcttagctttttgagatagccagggctttctgtataagtgctaacatactcctttggtgacctccattattcccagattatgcatctttcctacacttgcattttcagttggggatagaatagtgagtggagttacggtccagctctgacttaggactatgttacatctttctcatgcctgaattcaccttcagtttgggcccaagtgggtccaattcccattggaactaggacattgcctgtggcccttgtgctgctcccagttgaatgggatacctcagccctaactttctggttcagatgtttaggaacatggcttgaacttctagcagttttcaggtaggtggttccctcataagaagatactaactaaatctgacttataaggctggcccacaatttaaaaaactaaaattttctgtatatattacatgatttatctttatattctctagttacagtggatcatatgcatagttgcatatttttatttgggaaatgtattttgcttatgatatgcttactatctaaagaaagttactggccgggtgcagtggctcacgcctgtaatcctagcactttgggaggccgaggctggtggattgcctaagctcaggagtttgagatcagcctgggcaacacggtgaaaccctgtctctactaaaatacaaaaaattagctggtcgtggtggcatgcacctgtagtaccagctacttgggaggctgaggcaggagaattgcttgaacctgggaggcagaggttgcagtgtgccaagatcgtgcccctgcactccagcctgggtaacaaagcgagactctgtctcagaaaaaaaaaaagaaagttatctctaaaaataaggaattgcttaaaagcattattgtttttgattgagttactctttattaaaactaaaattttgtagttattctatttaattttaattgaatgtaatatcaaataatctaaccagtgatctgttggtgtgatggcctaatggcaaataaagtctttgcatacaagtttataatgatttgaaaatctcatgttaggaagagtcctttgagtacaactgtagagtaatagtagagtagagattgcatatgaaatgcatggcctctaatttttttccctttatttaaaccttcccctcctttgttatgtagtgtagcatattatttcccaaaagtgccactttatttcactgcatacaagttgagttttccttaaaattttttaggtgagtacccagaacatgaagatgggtgggctgccgcgtacaacacctccaactcagaagccccctagtccccctatgtcagggaaagggacacttgggtgagtatataagtagtaattgaaaaccatttcatgtagtattgtttaaaaatgaagcacaacatatttaaattattttttgaatatttgaagagagaacattttctttgtaggattgttgtttgtgtgtataacttcctcttctcttgggaaacacatttttatacttcagaaagatttgtttagaaattgtttttctagtgaattttaaatttgaggtaaaatcctagcccaagttcatagtttattgtaaattgcagtctaattttaattccttttctttcagaaaatgtatatagtcttttatattacagtttaactccaactatcctttttaagctgtgtagattataaaattctataaaacttataagaatattgagcttcaggccaggtgtgttggctcatgcctgtaattcccaaagtggggattttgagagaccaaagcgggcagatcacttgagcccaggagtttaagaccagcctgggcaacatggtgaaaccctgtctctacgaaaaatacaaaaataagctgggtgtggtggcatgcacctgtagtcccagctacttgcgaggctgagacaggaggatcacctgagcccaggaggttgaggctgcagtgagccgtgatcatgccactgtgctgcagcctcagtggcagagtgagcccctgtctcaaaaaaaaaaaaaaaaaagaagaatatggagctttattttggtcctagagttgggctctagatttgacttttggcaaaaatggccaattaatggaaaagcttgacttttttcttctagagcatcgtattataaacttgacttactgtgattgagatttacgattaggttggcattagtatagcccagaagccaggtgattaaaattctgtttcagctgtgctgttactttataattcctacatagtcagctgccaagaattcagttttttcatctgtaaaaggggggtaatatttgtcctctataaatttttcaaggtcactgtaccacaaattggatttttaaaaatgtgtaagacaaagacaaaatgttttgacaaccattggctttatgatatatgctaaacaagtttttaattgacagtcttgtttttggcttcctcagcaccaccaccatcaccaccaccaccaccaccaccaccaccaccaccaccaccaacaacaacaacaacaacaacaacaacaaaacaaccacaaaccttcaaaaaaccgaaacccaatcaagcactgaatcaggataggaccaaatgatttgagatgtagtggaggatagtgctggaagagagataataggacagtaggagaccaaagaataaaaataaattccaaccaggaataggatgactttattaggagtggacaaaataattctgcttagagagagagaaaatctagtggatcaaacaagatttaaacttcaaggtagaatgtagatggcatagtagtgtataatggtgccaggggtcggggtagagagatgaagaggaactctgtttttattttcctatgtaaacatttacatttatatcatgtgtagtgccttatggattttgttgggttttaagtcaagattgttagtaagataagctacttagtccccagaaagtccctagaagaatgaaactttgtgttgttttcaagttttgaagatttgctcatataccaatgtttgttttccttgtatattagcaatggttctgcaagatccttggggaccagagttgctgaggcccactctgctagttgatggctataacctgtttttccacatagtctttgcctagtcaccacattttgttcctttgctccttttttttttaaaaaaaatcttatttgtgtcattgccttcactctgtagttctcaattatcaaataatttttacttggatgcaacagaacttatttttttgagacagagtctcactggagtgcggttgtacaatattggctcactgcaacctctgccttctgtgcccaggcaattctcttgcctccaggcgattctcctgcttcagcctcctgagtagctgggattacaggtgtgcgccaccattcccagctaatttttgtatttttagtagagatggggttttgccatgttggccaggctggtctcaaactcctgagctcaagtgctctgcctgccccggcctcccgaagtgctgggattacaggcatgagccactgcacccggctgcaacaaaacatttttattgcctgggaaaaattgtctgaaaattagatgttggagaaattaatgtttcccattttattgtttaatatttgcattataatttaagagatgctggaacttccttttagtattttaaatccaaagtcctgacattactttttcctcttttgacccaagatttcatccagtgtcccttattttatttttaattaccaatgtatgtatttatgtaaggagactttgaagggtagtagagtaaattgcaaagtgatctcatgcaaaatcagtgatccataacttgagtgccccaggaaagcaatagttaaaggaactctgggatccatacataagtcagtagagcaacatcatttcaggaaaagaaaggtttttaattttcacatcttgatcagttcttattcttttagtgaccaagatctcatctacaatatgtcaattgactgtttatcattgtcataaagaatttggaaacctaagtagaaatgagaactaatttaataaacactaatttccccatgtgcatcctgttccctgtcatatttcctttcttcctcttttcatcctctttacgaggaaattttgggaaaaggcgggaaatatgtgttaataaaatccagtctggtttgtattttacagttcaaagtaaataatatagaaaggctgttgtggtggtcattcccttccccccacctttgtaaatgttgaactctgaggaaggaaagagaaaagagatcaaggtgaaagttgagggagaaagtgagaacggaagatgagattaaagtgtgtatttttgtatatagatatactttaatttctgtatatttggtatatagaaagggaaatgagttgttatggctagtattgatcatcagtgtgggggttatagatcctaaatctagatttgtagttcctgtctttgaatatctttggttagggagagaagggagaggagaataattagtgcattcatgaagtacagttgggagactttaatatgatactaaaagaattccaactcttctaagaagaggtagggtctgggaaacattggcttaaatggtagagaacctttgtgctctttgagaataaatgaacaaaattgcattagcacagggaaatgaggttggagactgaaaaataacaatattcaccaaaaccctaatggtggagaagtgatacattagtaaagactgaaattggtagctgggttatgttaaaacacatttcctatctctgattacaaattgtatctcaactgctggcaactctttgaatttattgtgccgaaacttgcttaatcatacaatacatacgctcttctttttgtaggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacaggtattttctctacctcagtgcaaaatgtgatggtcatagtaccataatctgttcagattacttcaggtaaatctctcattttccaagcactaagttcttttcctcactctattctcccaaacctcatctgatttcacctctctctcctcatgttctgattcaactttgagcagtcaggaagttgataaagaacagacatctcaaagtgcagacttctctccaagttttaagagttcagttgatctggaaaaaaaattatggaccaaatgtgggaaatgtcaggttgttttttggtggaactttacagatgaaaaactatacataataaaacattaatatgggatagtacatcagagtatgattattaattaaaattactcaaatctgtttaggaaaatgtttttgttttattataaaagaagtttcttcagataggcattaaactggaatataaaaaggcaatatttattgttttaatgtgttaaacctcaacatttatcacttgtatttatggataattttttcaaaatgtggtcaaaacaagcttattgaactcagttttcccctcaactttattaataagtaaatatatatatatatatacacacacacacacacacacacacacacacacacacatttttttttaacctgtcactgacttggagctcaaggaaattttattttgaagtggtacgcttttgaattacctttattgtagctacattcatctcagaaaatgtcgggaagtgctgatgatctcttactgtttataaatactcatgttttggtggctcttatttctttagcagcagtgggagtagtggagggagccacccaagtagtcggagcagcagtcgagagaacagtggaagtggtagtgtgggggttcctattgctgttcctactccatctcctcccagtgtctttccaggtaaaacattcatggtgcctcgtcttcacttttcctttctgaatttgattcaatttgtgatttaattatggtgggctttcttcgtaatcaggattttttttctttaggaatcataaatattgggaagtctatatatttgttatttgtaagcaagtgatttgtaagtgtttgctcactttgcacttctctttatgcctttggtgatgtggctcagttgctgctttgaggtttcagatcacactttgttatgagtacaagtttaattccagctagtgttatgacagtgcagtctttggacacagtgggaactcagtgtgagaaccatattagtaacaaaggattgggcagatataaaaagtagttttgacagttaaatttagtggctgtattggaatttagtagtctctgaaaatactaccctcttttctctgaaacagaaaaatctgcttatttgattcgaggagatacacacttaaaacttagttttgaaaacgtgacacaaaatacattaatagaatgttacatacttaatttacttatagtaacaagtagataatgccttttaaaaatcataaagatttgtgttttaaaaaaaatttttaatctgataatatggaatatgtctattttctgatttgtgtaattcaaaatggaaaactgttgttttttagtgtattatgttagttttgtatactatatacagaatgttatgctaaaaataacaatacgaagggaacacttttcttctggagtagtgctttcaattgaaaaggaatgtttgtttttaatgaattgaaaaaatctgcacattaccctgagcatcttgaattatttgctgcttatatagtaatcctttagcataagttttattctttttttcaactctgttcttttggttagtgttaagcactgaatatctaacattaaatactctaataccttttctaatcctgcctcatgtgattgcctcattaatgctgcctcttactcctctttcccctcagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtaagtatttgcttattcattggcaggcagatgcagtcatctggctattctcttacttgcacctctgatttttgtttgtttttggttttgttgtacttcgtattaaaaaaaaataagaataatgtactaaccagaaagtatgtgaccaaagattagcatttcctgagaaaattgaggtaaagtttctcatacatttttccaatagggtagcataaatttgtgtttttttattgcttgaatttcatttattagagatttttaagtttaatatggagctaccttctatacagtttttggaaattatcattagaaatattttcattataggttaagtgattaacaaaagtctattacaataattctaaggtatattttataggaaatatttgatacaacaaatggaaagcctctgtaagtctatttttaacagaatctgttgcttattatagcagcattggaaactcatagacaatggacttttaaagaatttcaggtttatttaagttggctggtgttttaaaattgcaatctaaaatctgttttgattggggaggagatagactcaattgctacgaaatatatttgtagagttaatgatgctggctagtaacaggttcttgtctgctataaaatgtatgtgtttggacatatatcactgtattagtctgttctcacattgctataaatacctgagactgggtaatttatgcagaaaagaggtttaattggctaacggttcttcaggctgtacaggaagcatgatagtggcatctgcttggcttctggggaggcctcaggaaacttacactcatggcctaaggcagaggggaagcacactggtcacgtggccagagtaggagcaagaggacaaggcgggaggtgctacacacttttaaacaaccagatctcattattgcaagaacagctccaagggggatggtgttaaaccatgagaaaccgcccttgtgatccagtcacctccccctaggccccacctccaacattggggattacaattcaacatgagatttgggcagggacacagattcaaagcatatcaatcaccgtagtgttccacttgccagtgaagaacttcatggcatttatattcagctttgctgttatacatgttaaacatatataagatctttacatgttttaaaagacacttttagccaaaatggattttgggtgatgtcttgtgggattccttctatatgacttttaaagaaaagctttctgcagtagataaatgtaaacatggggtgttttttgatccagatacaactgttaggccaaactaactagttaaatataggaatctcgttatgctcctgctttgataaagaatgcatcagaaaggacaaatcacccccaactgagagtctatgttttagtaattaaatattaattgaataacaggtgcctggctcagtgttcactaaataaacatttgttatgtgaggggataattaactgtggtttttaaaacaaaaagcaaggtaaatgtcttattaataatttatatcaggatagtctgttttatacagtacctgagttaccaagcaattgtttttctttttaccaaggtataacttatgtacagtaaaattcaccctttataccatatatgtttgtgagttttggcaaaggtgtactgacatgtaattgccaccacaatcaagttacagaacagtcctatcatcgcaaaaatttcctccatgccccctttatagtcagtccttcccttccactcccagctcctggtaagcccttgatgtgttttttttctctaaagttgtgcctttttaagtataacataaatgaaagcatatagtatgtagcttttttgatctgttttttttggccagatgcatttgagaattacccatgttgttgcatgtttaagtatttcattacattttattgcttagtagtgttgtattgtatggggatgtaccacaatttgtttatccctttctcagaggacatttagatttttctagttttgagtgcttatgaataaagttgctataaacatgtacatacagggttttttttgtgcacatgggtttttatatcaggtaaatacctagggaatagaattgctgggttatattgtaagtaaatttttaacgtcataagaaactgccaagttgttttccaaaatggctgtataattttacactcccagcagcaatgtgtgagtttccagttgcatccttgtcagcccttggtgttgccttttttagctttagccattccaatacatgtgtaatggtttctcattacatgtgtggtttggatttgcattttcttaatgactaatgatattgaacatttttttcatgtgcttatttgccatgtgtatatcctctttggtgaagtatctgttcaaatgttttgttccttctcacctttttaatagggtttttttccttatcattgagttcttttatattctaaatatatgtcctttatagattatgagttacaaatattttcttccattttgtgattcgtttgcttattttctatttttttggcggggggaggaggggcgggcggacagagtttcactcttggtgtccaggctggagtgcaatggcaggatctcagctcactgcaatctccgcctcgcgggttcaagcgattctcctgcccagcctcccaaatagctgggattacaggcacccaccaccatgcccagctaatttttgtatttttagtagagacggggtttcaccacgttggccaggttggtcttgaactcctgacctcaggtgatccgcccgcctcagcctcccaaagtgctgggattacaggcgtgagccactgggtccagcctgttcatttatttttttgatgttgtatttcaaatagcagaaattcttcatttttattaagtgttatttttcaaaatttttttaaatgaatcgtgctttgatggcatatctaagaactctttacctgaagtcataaagattttgttctgtgttttcttctagaagtttttagtttcaggttttatcgctaggtttatgataattaggtatatatatttttaaaaccccaaatggtaaatcgactcattaatagtgtgaatagtgtcttttttttttttttttttttttttttttgagacagagtctcactctgtcacccaggctggaatacagtggcaatctcggcccactgcaatctccgctgcctggattcaagtgattctcctgccgtagcctcctgaggagctgggattacaagtgtgagccaccacacccagctaattttttgtatttttaatggagacaaagtttcaccgtgttggtcaggctggtcttgaactcctgatctgaaatgatccacccgcctccacctcccatagtactgtgattaaaggcctgagccaccatgcccagcccatgtgaggttttagactagatctaactatataaaattcataatgatgttaatccagatgtttttaacttgatcgtaggtttgtattagtttgctatagattaattactgaaatgctaattgtattcagtggttcaaataactaaatatgccttttaaatcatagtttatatgttttcatttttatcatggttacagaggcttctcagttgatagtggattatgtttaagcttgagtgcttaagtttttgatacacatgtaagatgtttaaatgttataacaagccttgagtgctcttataatccttatatgactccatatgaatctaagcttggtaaactttcagctcctgtagaacaattttagtcatataaaaccattttataatcatagacaagatgaaaaattgtcaaagtgttgttttcctctaatacttttaattaaaattaccaagaagatagtctcatattaaggtagaataaagatggtaagactcagctgagaaatatgaagcctggaagaggatatgactgcagtgtttgatcatgaagatttcaacaaatcaagcattcatcaaattccatattacataagtcttatctcactgtgtttcaagtagtttattttagaatttaaaaaatttcaggataaccttaggcacaaatggatagatgagtgtgccaggtatcatctgttcctccagtcccccctcctctactctcccctcttctccagtaggctgacctccatgaaatgtttcagtggattcttttgccctctggcttcctgttgggtttagcaaaagtgttttttttttccttttcacttatctcctccttttctccctttctctttctcctttcctttcccctctgctatcctcttgccctcctccaccttcatctcctcctcctctaccttcctgtcccctttccgctttcttctccacctgcttatttctccgcctcctcttctctcttgccctccccttctcccttgtctgctattgtgctctctcatgggtgctgtggtgctctgtctgtaagaaaaagttctcagcttaatgtaggtgggagtgcagtcaaggtaaagtttagggagtggattatattattaggaaactgatggattatggaatcatgtctccagttgacattagctgtggaagaactctcaagagagcaaaatacagtgaaattgatgataactatatatggacttagggatgatattaaaaataagatatattttgaccctctttttatatcttaatttttttcatgattgtaaattttttagattttaattttaagacaaagtaatgtagctttcgtggtagatttttttgattaaaagaaagaaatgtttgatttggaattacgtcatttaaccttttgttgaaatacttcattttcctttaaccatacttttttgctaccttacgtttattattatttattattttggaataagactgtgtgtcaaacattttttctcttgctttcccaaacatcattcttgtcgattttagttttcagtgttcagtggctgtattttgggggtggagtagataaattttaattaattgtgatgattttgaaaccccatcagatttttaatttagtgaaataatagtgttaagtagcaaactatttatttattttgagacagagtctcactctgtcacccaggctggagtgcagtggtgcaatcttggctcactacaacctctgcctcctgagttcaagtgattcttacgcctcagcctcccgagtagctggaattacaggcgcacgccaccatacctggctaatttttgtgtttttagttgaaacggggtttcaccacgttggccaggctggtctgaaactcctgacctcaagtgatctgcctgccttggcctcccaaagtgctgggattacaggcatgagtcactgcacccggccctaattagtaaactatttagacataactttccaaacttaatcatatttttgtttgcttttctgcttttgtactctgatataatatcagcgaacaataactcaccttgcattgtatatttcagataccagttaaactagctgttatttttaattcttaagatttaggcattgtacataaagtatttaatgatctgagataattttcttttaatgacatatgtatgttctatctctttttcaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccaggttagtttttttgtttttttgcattctatagaatgtatttaattaaaaaccttcaactacaaaaaacccttaattacaaatagtgcatggtaggtggttagcaccatttgttgaatgaatgggagaatgaatgaattgtaggttgttaatactgtatctttcaattctttaaaaaaaaatcagtatgtgatttccacgtaaagtcatacaacttagtttttctgagcagaatttttttgaatattttagtggttatttgctttttaaaataacattgtggtgaatggtatttcctttttatttaatcagacatccttacttttaaataacaaataatgaaagttgtgtgcacatgaacagaatttagaagtggcaaaggaaaagagaacatttttgaagctactttgtgctagggaattatactagcttatacaattctcataccaaacccatggtggaaaaactaggaattgggtaaattgaatcagatataataattacactaaataatcggttgtatcatgcatgcagaataactaatctggaacatatttaataattattattttgtttactccccagagagggcaagaacaaatattagacaccatggctattgtggacatggtatgtcaacttactgcttttttctgtatttttgccaggaagccagtaagcctatgtgtgaacacctctcatactgggttcaactcattccatttttgataagccttgaattttatggagctgcagtttgtctctgtggctgtgacctatagtgatattctttgaaagagtcttgcagaagaaatttgatcctccaacataaacacttaatttaaataatgtttttatattatctcatttgattcttagaatcacgtacaaaataagattggtgatcattttcttatatcttataggtaaggaaaatgaggctgaggtgatggtcaggttaggatttgaacttaggttttctgactctaagttccatgttctttctttctgttttttttttttttttttttttaaattgagatggagtctcgctctgttgcccaggatggagtgcagtggtgtgatctctgatcactgcaatgcctgcctcctgggttcaagagattctcctgcctcagcctcctgagtagctgggattacaggcacccacgaccacacccagctaatatttgtattttattgtagagacagggtttcactatgttggccaggctggtcttaaactcctgaccttaagtgattcacccacctcagcctcccaaagtgctgggattacaggcgtgagtcaccgtgcctggcctaagttccatgttctttctattgtcctacctacatatttaaaaaatttttctcttatcctcccaagtcttctcttttttggaggggaaggcggatgaaaagatgtgatataaagtgcatgaaagcctgagaccttgtcagtcttttatacagttacatcctggaatattgctcaggaactgtttgttgaatgccaaatgaatcccttgttcatttttccaaatcccttcactgttctgggtccctctcgtaaattaagtgctgtatctgtagtccatccagtgcaaaccatagtgtgaataccaactgccttaattgatatatacttcccttctatcttttatcacgtttagtgtttttggctatgccattctttttaaatcattctgaacttaaattttgacaaaactgccctttttatacatttgccttttaaaccatgttttcaaactcacatttgttcaggagcacgggattacaggtacctgccaccacgcctggctaatttttgttttgttttgttttgagacaaagtcttgctctgtcacccaggctggagtgcagtggtacaatctcggctcactgcaacctctacctcccgggttcaagcgattctcctgcctcagcctcccaagtagcagggattacaggcacctgccactacacccagctaatttttgtatttttagtagagacagggtttcaccatatcggccaagctggtcttgaactcctgacctcaagtcatccacttgccttggcctcccaaagtgctcagattacaggtgtgagccaccgcacccggcctatacagggatatttcatgctttgttcgtgtatgctccaaaatagtcctatgagaactctgtaggtagaatttatttgaaggctgtttaagcacatatttaaatgcattttataatacatacttcaatagtttctttgtaaatctgattttcaaatgcttgaaagtatatgttaaagtaaaaagatccccactttatggaatgattttaatgaaaagtatttttctcactcatggaagtaaggtgaattgggattgttaggctttctgtgtaatgtgtgagtcaatttagttgtgcttttttgtttttctgtactctgctctattaagttctgcctttcatctccagggatttgataactgtttaaagtgggtggccacagcattgttagttggttaatcagagtactttttgtaaactaatttttttttaactaaaccattttcttggaaaagctctttttgcaagacttaatgatttgtgaatcagtgttctaaggctgttagatgtacttttattttatattcattagaatattatttatgagtcaagcactgtggcaggtgcctgcagtcccagctcctcaggaggctgaggcagaacgattggttgaacctaggagatggaagtttcagtgagccgagattgtgccactgtactccagcctgggcaacagagtgagaccctgtctcaaaaaaaaaaaattatgtaagtctcctgtattactcccagtagccctgcaattgtccctatttttttcatatttacaatgagaatatttgttgtgctttctcaagtaactaattctctgatttaacaaaaatgatctgaagtgtgtgttttatgagctttttttttgggggggtaattggagtcttgctgtggttgcatgcttctgaggaagtgagctgacaatctttggaaggtttcatgtgaatataaattcagtggggttctgtgaggtgtaaatctagcagtgctgttactatatttgttaatgtacaatttgatctgagtttgaaaaagggcaattataacataggagttaaaatatggaacacccagtgtctagtgccaagtcttaggagcacaataattgtttttttcatgagattatttcagaaacaagttattgaaaggaaaggaaccctttgatcagggcataactgaaatccctttggttctcattatttcttaatctaatccagccaatgaaataggaataccaatttatcattaatcttgccagtggtaaggagggggtcatagaaacacatagggctaattatgagttaacagtctctactttaaatgtaaatatgaaacaccttggtggtcaagaagaatatacatatatctacatgtgagtatgtgtacatatacttacataagccttgtttgttaaggaatcagtaatgtagcatgtaagtattgaagactttaggagaaagtagcctgtattttactgctcatattttcttaaaagcttttgaaaaaatctagttcataaagtgaatgttggttccaagagatgtgtctatatatagttctatgagatataggagtttctgaatgggtatgctgtttcacaaagagaaagtgtcaggcttagtaacccctgaatggttttaaaagcgactaaaaaaataggaaacaatgttgggatggtgctgttccaaaataaaaagccatttcacatattctctaaatgatttgtgaagttacagcatcaccataaatgtctaaaacgtctagaagaatactgatgtgttggggctttagcaaagtataaataaagagcaggagcaggaagatttttttttctccccaaagtcttgctttgttgtccaggctggagtgcagtggcacaatcttggctcactgcaacctctgcctcctgggttcaagcgattctcctgcctcagcctcccgagtagttggaactacaggtgtgtgccaccacgcctggctctttttttttctttaatagagacaagctttcaccgggttggccaggctgatctccgactcctgacctcaagtgatccagttccatctggcgtaacaaaggtcatcccaaattctacttttctccacggcaaacctttaacaaggtggtcgaaattaattcagataccacatccttttctttttggaccatgtaagatctcatctgactagaatgtctgtgagccagaatatactgtctttcttggagttgagctgaaaacaaaccattctaagagaatttaagcagaattttgagcaaagaattgttgcaatattcagttctaatcctagtcattttgttactgctttggcctcccaaagtgctgggattacaggtgtgagccaccgcatccagcctgaattcacttttacataccttttgttctaagttggtattcatgtttagaaaatactacacttacacattgtttatttccttcactgggaaaaaaacataagcatctcaactcgcatgggctatataatatatatatctcctctaaatgtgatgttcagtaatgactttagaagtagtttttagagcgcttattttgtctaatattctcagagtatttataaagctgtaaaaataagatgtaaaagcttaattttatttttccaaactttttgaattggacatctaaaatacaagcttcattgatgcttcagaggactttataaataaccaggaaggttgtacttggaaagtctgtacatttcatcagcacagattcatcatttaggtttggattgcttggaaagccttttactgtttatatctaaacattcttgtatattgtgaaaattacataacaatctaagtttggagatcttttggtggttattgggaaagagtcttgtcttatgaggaatcattttagctaaatgaaatgaaaacaagtttgcttcctgctcttctttgcctgttcacaaaatgactaggattagaactgaatattgcaacaattctttcctcaaaattctgcttaaattcacttaaaatggtttgttttcagctcaactccaagaaagacagtatattctggctcacagacgttcttgtcagatgaaatcttacaaggtccgaaaagaaaatgatgtggtatctgaattaatttcgaccaccttattaaaggtttgtcctggagaaaagtagaatttgggatgacctttgtaaccccagacggaactgaatttttgaacatgccttagactagctttgaaaaaagtctaacttgttaccaagtcattcttttaaggaagaactgcgattgatctttccctggctgctggtggacttttttttttttttgagatggagttttgctcttgttgcccaggctggagtgcaatggcatgatctcggctcactgcagcctctacctcctgggttcaagcgattctcctggttcagcctcccgagtagctggggttacaggcacctgctaccacacctggctaatttttgtatttttagtagagatggggtttcaccatgttggccaggctggtcttgaactcctgacctcaggtgatgcgcccccctcggccttccaaagtgatgggattacaggcatgagccaccgtgcctggctgctggtgtacttcttaaaaccactatggcttcagattttcactttcagaagtagaaaagaaataagcatattcatcttaaaaaaaaaaacctcagtctacccacaaaaagactgctgtaggttaagcacctaatcattcttttttagctgagtaccaaaaggtcattttttatatttggtagagaaacagtgactgaagtgggaaatttcccacttttctgttacacggaaggttaggttacatgccaacagaagaggagcatttcatcttggatgtgaacatgtgccttgtctctactcttctagtgccagttgctgcctgctactgtttctcagttttatcttttttgtctatgctaccttctcctttcttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtattcttagtagagacggggtttcaccttgttagccaggatggtctcgatctcctgacctcatgatccacccgcctcggcctcccaaagtgctgggattacaggcgtgagccaccgcgcccggcccaactaccttctcttttcactgtcttctgcttacccttggaaacagtattatgaacatatcaacagttgttgtaagcctctgagtgggaagcagacacgcaagtcaaggatttactgccaagaattatgactttagggaaaaacctaaccaaaggtgtctttttaagaaaggtaccaatttctagggttatactgctctgttctttgcatctagatattcaagattatctgcttaactcttgtctgtgcatttatatgtcctccctgcatctatccatagcatcaactgtagatattttgcataatctcaacccaaatatatcatatcattatctctccctgacttacctgtttaccatcccatttctttcccagtactacctaccaggcttaacatagttagtgacatctccatcttcatagttacgaagggtaaaaatctaagaatgaccttcagcttgttgctgtccttgatatgctagctaaatcattaattgccaactactctcttcccacacttttaaagttctctccttttctagaaactgctttgatttattacgtgccagccactgggttaggctttccacatccattgtctttttttaatctttgcagccactattggaagtaggttgcattaccttgttttcatatcacatttatggaataggcctgaagaagttaattgactagctatccaaacagccaggaaatgatggatcagagatttgaggctgagtgacctgaaaatccaacctctttccactaagcactcttccaccaggcatataagatccttccctatttcatatcctcccattgatatttctgggttttttactttctctttgggtatcttttcctagccatatggaaacatttctggtcctgtgaactggttatgctgttttatgcctctgagcctttaccctcacttgcttctctcaacttgattatctttctcaacccctgtcagcttggcaggttcccttcttcaagtccctgctgagaggtcatttcattgtagccctccttacctccaccactacttccagggaattgctacaaatattgttgggttaagattatcatgtattcttctgtttcaatagaatgtgatctccttgagagcagagacatgttcatctttttagttttattagtcttaactgtattttggagctaacagaggcattttctctttataagaaaatgcatatcctactttgtacccattctaaaggaaactgtaactgtagagtaatcttttttctttcttttttttgccgctttagtttccacacatacctggcttattagtgcaattatatatgttaaacatctgttgacagtttattagttctaggcactgtgccaggtgattgaggtgcagggaaatacaccttgggaaggagagtggaatgatttgattaaggcctgcacttttctataccatcagggaggaagtgtaccaatgagttgggattatgaaaaattgtaatgacatagcacccgattctcagaggacggttttgatactgttttcctagcaggtgtttgccacttacttagtatgaagtcagtaagtatttgtctaattaatgaatgaagaaccagtttacttgcctacaattagagtaataaaagtatccatttagagtgttgggatgtaatatttttttctctctgtattgacaaacatttaaacttgtaaccttccaaggtaaaattcagaaaacaacatcatggtaatctgcagaaatgctttccttgagaaggcatgatgttaatgatatgaaaaaagatcaattatatataatatatatataaaacatgattgttatatataaaaatgggattatgttttatatatataaaacatacgattatgttatatatatatttaacatatctgtgtatgataaatgcctcctgttgtgattttcaaaaacttactaaaaattcccccagtactttgtttgtgttaatgagttgtccctcaacaggggatccttgagatcactgataaaatgtttgtgaatagtagtttccctcctttatgtgtttattttattgtattatcctttccttttaatgtaactcgcccttatcccttatcctccacaccttttttgtttttgcagtatctcttgctcctcctcctccctccatcctacaggtaactcctcagttacctttaatgggatttgtggccagagtccaagaaaatagtaagtttatgtcttctttatgctgtagatcagattgtaggcataaaatgtcatttatatgtgattgactggatagtcattcatttgctgatacttcaacatttcaatattatgaacaaatcactgtctggctagtggagataaaatagagaaattttctacttttaaataactaatagtaaagacataagacaaatacatataaaataaggcacatataagaaaagaaagatcacatcctactgaggaggtatctttaatcactagatatcccatctttttctctgggttgctcagataagtggtagtctagtttcttatcactggagttttatgggtattataggtggtctgagaatcttcctccagttttgtgattccagatatcagaagggccttttatggtagggctcagaggaccaggctgccagtctgtctcccaagaagcctcataggttggcaatgaatttcccttggcctgttcaggtaactaattttgttcataccttgagtcttctagggaagcattaagggagctcaggaggctgatgacaaatcaggaggcctgtatcaacattcagtgaggaattgctgtcacagagaccagtgaacatagactgtatgatggacaaatcctcttcttatgggcagtctttgcgagggccacatcacaataataaggttacatgatttgcatgaatctgaactaggagaatgatattaaagatctcatgtcatcagaccaaagtagtccagtgtatatatctcataacaaggatggatgacttcactggtggggtagaaatatttgcaatctgtggcttaggactcctgcttatttggaaatgggcactgccagtactagaatgtaagctctataagagcaaggagttttgcctgttttgcttgctagctgtttccccagcacttggaaaagcatctgacacatagcaggcacttttggtccctgcttttttctgcttctgtagctgaccaaatgccccccttttatcagcacattcttctagatgtggttgtattttaactaataattcagtcttactggcctaagggctcagtgtctttcagctgcctttgcatctctatttgctaatttctgaaaatagtctattttacttacttttgtttattggaaggtactccatgaacacctgtaatgtttaccacaccgtgacttcataagatgttttgttgagtttaagagctattttcacatataattaggttgatttcatatgttttaaattatgctattggggccgactcttctttagcttgggtgtgacccacactggctcgaggagaaaactgcctctcagcaacattcaactattaatagttcagcatgtgccaagcacatccatagtgtgatcctctgccaggcttgtgaggtcaagtgtgggatacagggtcactgttgccaggttttaaaaaatgtctgctgcatccaaacaggataaataccaagtagaaaaggatttaattacagtacgagaattgaaggactttccaatgctggttccattctacatactccatacaaggtggaaagtctaagtaaatgtcattacagtaaaataatttttttccatcacaaatccggtttaatcacaatgattaatgatggtagtcacttgaataataccctgggagttttttctgtttttactattgtgatgagtgtacaccttagagaattctgccaatcaattgctactgcatgttctgtgagatgttgtcattcattttgaacaaaagtggttctgagcagcttctggagtaaaggccagattttgaaactgacattgaagactaatccattaatgaaacacgaatgtttgtatagcaactaagtggttattttcttagcaaaaaatgagacttgaaagttgaataggatttaaagcaggatgtcattggttttcgccagtcaccagtgaaagctgcaagctttgtagaaacagcaaaatgtttcatgaaccaaacctaagaagtattgttttaatttaatagtaaagtgcatgactatcactttaagacttaggaatgtcttaagtagatgactgcaaaacattattatagcagcactacctatattttaaaaagtcattccctaatttgaccaccctatcacagttgattgccttttggattggtctttttcatcttttcctacaatcatatacgtttctcatttacacaacgtataaaaaaattgtgtatgaggtgtgctgtgactaattttacagacgtggcaggacttaaacattagtcaaataataaacattatttgaatgtttaagtctttaaactctttaaaacattcaccttggaaaaatacatacatttcttttggtacatcttcaaagataattctttggaattatcttcaaagctttccaggtatattattttgaagatattccttggtagcaaatactcactctgcattaagtttgatgtttggaagaagtctggaataatttggaaccagttatagtgacccagttatactggggtaagaagtacagctatgaccctgttattccccttaaaatctttctgtggctcaccatggctctttggatagagtccaaactgctgtaaggcccttcctgcctcatcctcttcagcttcctgaagctggctactgaatttggacagttctttgaaagtttcttgctttcttacctttgtacttgcattgtctttttttttttttttttttggagacagtctcactctgtcacccaggctggagtacagtggtgcaatcttggctctctgccaccttcccctcctgggttcaagtgattctcatgcctcagcctcgtgagcagctgggaatacacgtgtgcaccaccatgtgcgtctaatttttgtatttttagtagagacggggtttcgccatattggccaggctgggcttgaactcctgagctcaaatgatcctcctgcctcagcctcccaaagtgctgggattacaggcgtgagcctccccgcctggccttgttttgttctttgtatctgacatgaaatatcaatgcctctgccatcctaccctcccctcttcctccccattaactcttactcttccttcaggtttcaggaagcctttcctgacccacataacaagtgtggtttatgctgtgtgcttctatagtatcttaaagcacacactacactcaattgtaaatgaagatttggtcgttcatgtcttcatgacttttgcctactgcccttttctcaatgctgagcataatatccagccatattagttaatgtttgttgaataaatactaatgaagcatgacttgaagtttttaaaatttatcccatcccataatagtgtagcttttaagataataggcattggagttcaggtgcttttccacttacttgctgtcagaatacttaatcttggaaagccagtctccacatctataaaatgaaaaacaccacctcccaatataaagatgaaatgaaataatgcattacaaaggactagctgagtaattggaacattttaagtcaaaagtagtagcttattaaactggcagttacaagaaaagtaaaaatgaccaatggcagcatctttgagtaattttgtagtgtcatttctcaaggttattgttttgaaagttcctttggatctatggttctgtgcagttgtttaaagtcagtctttttatcttacaaatggaaataggataaatttctctttctcacccaagtatatggtaaatcacatatctatatcttttgtttattaataaaaactattaggatgaaagacattctatttaatgactgaagttttaaagtttataaagtagatcagtatagaggggcacagcagatgggaagaatactgataagacagcatggtgttgatgtggctgctcccaccaggcatcagcagtctttgaaaatccatttaattcaccgggcgcggtggctcacgcctgtaatcccagcactttgggaggccgaggtgggcggatcacagggtcaagagatctagacgatcctggctaacacggtgaaaccccatctctactaaaaatacaaaaaattagctgggtgtggtggcgggcgcctgtagtcccagctacttgggagggtgaggcaggagattggcatgaacccgggaggcagagcttgcaatgagccgagatcacaccactgcactccagcctgggcgatagagcgagactccgtctcaaaaaaaaaaaaaaaaaaaaaaaaaaatccatttaattcaattcgtaggcttagattaaaaaatactaaataaattggattgctcagagagtcacatgggaactatactggtacctcataaataagaattagtgctgttcattaaacctggggagctgataaacaggtttattcatttcattctgttcagttgtgctcacgtatttaccaaccattttgaaagcttaaggtagctgagtttgaagataatctttttgatgttactatatattggtatgcaagctgtggaagcagatctccatgtgagatattttaaattactctgatagtacacttggacatttagcctgaagaaattctgaattatagtctgaattagaagaaattctataagtaaacaaacatcctcatagatgaagtaacccaagtttgttgatgatttttttcctcttgaatttggtaaaatgctattttagaaaaattcattaagaggaaagtagtgggttattaaaattttactattccctggactcatttaagtgaaaaaatattttaagaatttgtgaaatatggttttcagtgttagtatttctgataacttacccttgaatacagtgtaaagctcagctgtattgtactgatctctgggtttttttattcttattttttattgtttattttttttttgctgttgttgtttttgagatgcggtcttgccctatggcccaggctggagtggcgtgatctcgactcactgcaacctccacctccccggttccagcgattcttgtgccttggcctcctgagtagctgggattacgggcgcccacgaccatgtgcgactaatttttgtatttttagtagaggcagggtttcaccatgttgcccaggctggtcttgaacttctgacctcaggtgatccgcctgcttcggcctcccaaagtgctgggattacaggcgcgagccaccgctcctggccatactgatctctttggaaagaggatttgtgttaatataaacaggttccagaggctcagttaataattattttgtctaaactttattcagtgtccattagcattaatccaagggcaagagagggagaacgtcatacttggagctctagaacgttatagttggtgggaagacttatcttgctcattgattttttgaaggaatattacatttattttcaagtctaggtttatattccatgaacccagaagcttggataggaaatactgaactttgcataacatatagttttgttgtcagcctgatacgttcttagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaagggtaagtttcagaaggatatctggatagatgggaagaaacctctacatagaaatgaaatttgcggtactgaagagaatcttattttctactaagtgaagttctatttatttgtatttgtgcatttttactgagtttacaaggttcatgattttgaaagttacactagtaaaattctgtgaatatttgattttaaaaaactgatggttatctatattgttcctattggacatgctttttatgaatggtttctatcagtgtttttctgttttcctttggcctcaggaagattatttttccacattattattcctacctccatgctttagaacattagtttgtgtcaccttataatcagatacttcagtttaaatgtctccacatgaaactttcttccacagaataatggtttctcagtttctttgccaagtaatattgggcatttcttttagtgaaaagcttctttgatattagctaattatgatgtagcactttgggatacaagctttcaaatccatcaagactaatcagctcagaaaaaaatgtgtgctgtctggaaggaaattttcttttaagaaaatcaaagctactaacccactgagtctcaaagctggctacacattagaatcacttggagagcttttataaagaaataataggcttccacttttggccaagagagagcaacagtaatcaggtgtaccctccctcctaaaacaggaattttaaaaccccacaaaataatggttttcagacattgaacaacaggcactggagagaaggaaattaatttttttctttatgtagctactataaataccacatgtgatcaagaaagtaaaggagaacatgaacatgagagagacgtggaatatatctttaaaaagagagagagagagaaagagaaacataatatttctggagacgaaaaacacatgctgcagaagaaagcattagcaaccttgatgccatgacaatagaaactatccaaaataaggcacagagaagaaagtggaaaaaaaggcaaaaaggaaaacagagcaacagataatgtgagacaaggtcagatagtctttatgtatgtgtaattggagtccccaggagatgtgagaggaaaaagagttgaaacaatcatagacaaaatatttccacgtttgatgaaaactatattagttgtgtattgctacctaacaagttattccaaaaatttagtggcttaaacaaaacatccattatctcccagtttctctgcgtggctcagctgggccctctggttcagggactcttcacacggctgcaatcaaggtatcagctgaggctgcagtgatctcagggcttgactgagggagactgctttcaggctcactcgtggttattggcaggatttagttccttgtgggttgttggcctgacggcctcggcttcttcattggctgttggccagaggctgcccacaattctggatcacataggcttctccgtagggcagctcacaacatggcagctaacttcattagaatgaacaagcaagaagcgccaaaaagagaatgcaagcaagacactagtccttttttcaccttaacccagcagcgatgacctgtcatttttgccattttctgttcattaaagcaagttaataggattagtcaacactgaaggggtagggattacataaaggcatgaatactatgaggcagaaatcattgggagctgttttagaagttgtctcccacaaaactataaactcacagatccaagaagttcaataaaccccaaatagaagaaaagaaaatcttgccaaggcacatcataatcaatttgctaaaaaccagtaccttagaaaatcttaaagataatcagaggaaaaatgacatattacatacagaggaacaaagataagaatgactgcatggttctcatcaaaaagctgttaagtcagagaattgagcaaaatcttcaaagtaatgaaggaaaatgtcaacccagtgttctttacttagcaaaaatatccttcctaaattaaagatcttttttttttttttttttttgagacggagtttcgctcttgttgcccaggctggagtgcaatggcgtgatctcagctcacagcaacctccacctcccgggttcacgccattcttctgcctcagcctcccgagtagctgggactaccggcgcccaccaccgcgccccgctaatttttttgtatttttagtagagacgtggtttcacggtggtcttgatctcctgacctcatgatccgcccgcctaggcctcctaaagtgctgggattacaggcgtgagccacgaggcagagtctcgctctgtcgcccaggctggagtgcagtggtgtgatcctggctcactgcaagctccgactaccgggttcacgccattctcctgcctcaacctgctgagtagctgggactacaggcgcctgccaccatgcctgggtaattttttgtattttttttttttttggtagagacggggtttcaccgtgttagccaggatggtctcgatctcctgacctcgtgatctgcccacctctgcctcccaaagtgctgggattacaggcgtgagccactgcgcccagcctgtgctttgtattttatgtggtttgccttgtttaatataagaatgctttgggctgtaatcccagcactttgggaggctgaggcgggccgaacacctgaggttgggagttggagaccagcctgaccaacatggagaaaccccgtctctactaaaagtacaaaattagctgggcatggtgatgcatgcctgtaatcccaactactcgggaggctgaggcaggagaatcacttgaactccagaggcggaggttggggagagctgagatcgccccattgcactccagcctgggcaacaagagcgaaactccatctccaagaaaaacatgctttgaaatgttagctctattgtaattcccattatatagttgaataaaaagaagcctaggaaagttaagtatgtactgtaaactattaatagttaagtgttagaattgggatttgactgggtggtataactctagaccccacactcttaaccattgtcctaaacgtgagctctggcatctggcagacctaggattgagtcttggctttacagtttatgagcattaagtcctccctggaaaacttttttactgcccgttttgtatctcttaacttttgtaaagccatctattcttttgttcttctggctcagtgatacagcttttagctagaagtataaatgatatataggaattgtcagataacatttctgtcttcacaagactgtgacagtccctttttttttttttttgagacggagtcttgctctgttgcccaggctggagtgcagtggcacggtcttggctcactgcaagctctgcctcccaggttcacgccattctcctgcctcagcctcctgagtaggtgggactacaggcacctgccagcacacccggctaattttttgtatttttagtagagacagggtttcaccatgttagccaggatggtctcaatctcctgaccttgtgatccgcccacctcggcctcccaaagtgctgggattacaggtgtgagccaccacgcccagccgacagtcccttatctggttcatcttcgtacctctaaaagtcagcatggatgctctattaatgattgttaaaaaatgaatagtgccattaattctttctggggaattcctagaaagcttctcagagaacatggcgttcttggtgccttgaatgatgaataggagtttctcaggcagagaagagagaaaggaagggccttccaagctgagggaatcacgtgagtgagagggcatggctgtttggggcagagcagtgtccagtgcatgagggtgggggtgggttgtagggagagagggtgatatgagcacgcaaagggaataaattgtaattaggtggtgggtggctaaaaatgacaatgcgaaggtgttggattaaaaaaaaaatctggtagtagagggaaattatggaggatttttaaaaaggttaatgataatatccatctacttatgtaactttttttggagatacctgataatagtgtagagtgcattggagaggaaaagtaggagttgtaaagaccattttggataaactttgaagcaagggataatggcctcaaccaaggtagtggtgctgaaaagattgtttacataaataagcagatacaaatagaaggatttttcaagtggcattgtaactgcacttttcaaagttatttgccaaaaatcaaataacgtatcttcaaaaatcatgtttgatgatgtatcatcaaggtctttcttaaattttgttgaaagcaaaggaataagagccacctgatttgcaaacggattgagttactcagtggagtaattcttttaatatgagcaccattattttgaatggtccctttggcacccagtgttttgtactttaagacagtgcaccactgtgctttttttaagtagaaggacaaaaaggatataaaaacttttatgactgcttgactgaaggtatgatctcaagcagatcaattttaggaagcagtacttaagattagaaaatctagaaagaggccaggcatggtggctcacgcctgtaatcccagcactttgggaggccaaggccggcagatgacaaggtcaagagatcaagaccatccagccaacatggtgaaaccccacctctactacaagttcaaaaattagctgggtgtggtggtgcacgcctgtagtcccagcaactcaggaggctgaggcaggagaatcacttgaacccaggaggtggagcttgcagtgagccaagatcactcgccaccgcactccagcctggcaacagagtgagactctgtctcaaaaaaaaaaaaaaaaaaaatctagaaagagagccagttgcatgtagtggctcacacctgtaatcccttaaagtgctgtaaagcactttaagaggctgaggccggcggattgcttgagacgaggagttcaagaccagcctgggcaacatggcgataccctcgtctctacaaaaaattagaaaacttagccagacatggtggtgcatgcctgtagttccagctactctggaggctgaggtgggagcatcacctgagcccaggagtttgaaggctgcagtgagctgcgattgcaccactgcctggggacagtaagactctgtctcaataaaaagaaaaaaaatatcgagagtccctataaactgtctgccacccacactgcttagaaaatctcaggtaccctgagtgataaatgtaatcaattttaaagatgggtgcactaactggggcggtgactatgatgatggagagaagtcgagtgttggtatttgggagatttagaaggtggaattaacaggacttggggatgtcggggaaggtgagtgaggggaaggcaaagatgactcctagtttcctggctccacagaagcgtagtaatcagataactgggagaagacactgtcatggaagccatggaggaaaatgtcaagaagcaggcagaggtaatcatcattgccaaacactacaggaacattagacaaagaactgagaagaggctcaaaagtagaaggccagtttttttcaagtgaatagtttcattggagtggtaggggcagaaggaatatggctgtattagttaagcagcattattttcattgaaacagcatctccagtgggttctaaaacatttcttagaatacattaagtggtttaaccaactcttcattgatagtgtccaggttaactttgctctacctcaggacaggttataacataaattccaaagtatgttaaatgttttgctggcttaggatgaacttttttccatataaataaaatgatgtcaactcacaatatgtaatttaatacaaacagtatattgaaatggataatcttactagcattttgatttttccagtggcttgctagtttagggtacttaattgttaggtgtggttgctaataccctacaatatttggtggtcagtctttttagttcagatcagtcacttctatgtaacatgctccttttgggcctttttgttttacattgttattttagtatcaccttaatttttcccccaatatgtatttaagttacctttattactcactgtgtaactgaataatatagaatatagatgtatttagaagtatccaaaaagctaggccttgtgttaggcgctagggatacacagagatgagtgatgggcccttacctccaggagtttatagtgtagagagttttatgtttagattgctcctctttgtttcaatttactattttaggagagaaaaaatcatctgggtccttttttttctgagacggagtctcgctctgtcgctcaggctagagtgcagtggtgcaatctcggctcactgcaacctccgcctcccaggttcacgccattctcctgcctcagccccacgagtagctgggactacaggcgccggccaccatgcctgctaaattttgcatttttagtagaggcggggtttcaccatattggccaggctggtctcaaacctgaccttgtgatctgcccaccttggccttccaaagtgctgggattacaggcgtgagccaccgcgcccagcccaatctgggtccttttctgctggcatggtaccattattctttgcttatctttaactctgcagcatacttcatataaaattataggattaaaattaaaaagagaatcatttaagctaagaagtttttttcagttttacagaccttcataaaatattctagaatgtattcaattgaaatgctaaatatgaacaatgtactttgaaatttagaatgtatttttactttagcagaaacatttagaagaacaatgtgtaagtccttttctgtttcagtcataactgcacaaaaaccagatgtctagcattttaagttttttcttacatgtgctttatcagttccccatatgattttgatactatgcgtgatatacatgcataattggaaaaagtgactttcttccctattgccaaaaccagttttccagactaaataaaatctagacagattttacatttctcaacatcggtattttgaatattggtgaaaacacagatactttattacaccgctttagagttactttgataaaagtttgttgcactaaatcaagagtattttgctttttgatgaatggctttacagtaaagaattagatgaagtaaactgctggtgtatatctttccctggagtgaagtaaactactggtgtatatctttccctggagtgaaaatgaatattcatttaaaaattacttatcagggtctcgttctgtcacctgggctggagtgcagtggtacgttcagtgcttactgcagcctcaactttctgggctcaagcgatcctcctgcttcagcctcccaagtagctgggaccacagacgtgcaccaccatgcctggctaatttattatttttatttttttagagacagggttttgctatgtttcccagaccagtcttgaactcatggcctcaagtgattctcctgcctcggcctcccaaagttctgggattataggtgtgagccacagtgctcagccagaaagtgaatattctatacagcatatttctgatttttgaaaaagttaattttaaaatagtgaatactaattttggcaaaagaaaaagctgaacagttgttaaaactctcagctctctaccattataaacagtctctggaatcatgttaagtgtaaattctatctaatctagtttctacttttgatttgttttgagacagtctcactctgttacccaggctagagtgcagtgggaaaatcacggcttatttcagcctcaactttgctgagctcaggtgattctcccaagtagctgggaccacaggcacgcgctaccatgccaggctaatttttttttttttttttgtattttttttttggtagagatggggttttgccatgttgcttaggctggcaatttctacattttaaagaagaaaatgaatgtagatagagcttactaactttccacttctaagcatctctgttacaacaggcttcatattctcttctgaattacttttcatgggtttgcatttctttttcttttatttttcttttttgagacaagagtctcactctgtcaccaaggctggagggaagtgttgcgatctcagctcactcaagtgattctcttgcctcagcctcccaagtagctgggattacaggcgcccaccaccacgcttggctaatttttgtatttttagtagagacggggtttcaccatgttggccaggctggtctagaacttctgatgtcagcagtctgcctgccttggcctcccaaagtgttgggattacaggcgtaagctaccgcacctggctggatttgcatttctttaagcatcaggaatgttgtctttccttaaaaaaacactagaaaatattaggttgactagaaatgctaaatattctaaattgtattttctgggtttttttgtattttcttatatttaaacttgtatgccatttaactacatttgattgtgttcaggcatttggttatatattgagaaatgcacactgatctcttcctagcaaggatcttctaaagtattttctgaccaggtgcaggtggctcatgcctgtaatcccagcactttgggaggccgaggcaagtggatcacctgaggtcaggagttcaagaccagcttggccaacatggcaaaaccccgtctctactaaaaatacaaaaattagctgtgcgtggtggtgggcgcctgtaatcccagcacttgggaggctgaggcaagagaatcgcttgaacctgggacatggaggttgcagtgaaccgagatagtgccactgcactccagcctgggcgataagagtgagactgtctcaaaaaaaaaaaaaaaaaattctggtgttcctacaatatcactataatggaaaatattcacaatttaaggaagctatttaatttttattaaaacaggccagaaacaaattttctttagggcacattatatcagaagtccctgttgtagtttgtttctcattgatttatgtgaggcacaaggttgcatgagaaactaacaaagacagtgtgtttgtcttggaacaatggataggtggagatttcattgagtggtataaaataggtacagaagatgaagaggttggagcaaaggataattcttcaagtggaattgaggatgttacagggcatcccagtataactaaactgttgaaattgatataatacttgggaaccagagattatctggttgaaataagataacagttgaaataaccactgagataatgactcaaagagccaagttaccaagtgatttaagcaatgaaaatcacaggagggcttataggtatctgattttcttgtcacttttagtctgttattatagttatattaaattggtgacatagtgcagcatatgttttgaaaaaatatatgtagcggactcccatcattcatacatttaacttggggaaattgaaccaccattctacttagcgaagaggcataggctccagagagagtgagaaaggagacagaaatctgctgttccattagtctggtttctcacttgactctcatagtgtatctcattgccctagtataattctaaggtaaagaaaagctttaaaaaaaaaaaaaaaaaaaccacaatatggtatctcaacacaaactcaaatgaagaaacagccatctttcttgattctaggattgtgtacctcttcaatgaggtacttccctgtaggctcttaaaaggtcatcaaaagcacatttgattaaatgtgctttttccccatttgtactcaatttagagcctaacatccctagaaaatggaatttcattgtatatgactgggtattacttagaaaaaaaaacatgtaagttttggttggtgtttagaaagtcaccatgtttgagtgctacaggatttgggaacagatagctattcactggcttggttctgtctttctaggaatattactgtctttcacatcctgttttgttttcttccctcctagttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaaaaaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtatattcaggtgtcttgttaacttatttatataaataacctctttttctaaggtggtatcttgagtttacgtgttagggataatctgacttttctgttgctctaaaccagggagctgccttttattactgaagaagtcgtctttttaaattttcaaagatttaaaatgttgagctttaaatttgatctcaagtttcttccctgaagacagctgttctaattaagaactttctaatcctgtttttgctccactcgcacctggggttttcttaccacttttctccaaatctaattctgttaatgtacagtttttttaattcaacagacaaacactgaagatgggtgttgactaaaaaatattgcagactggtcagaagtgaatctaaaagacaaaccactaactagcctgtgctttgttgctatgagagcctagattataaaagaattttctaatgatgtatctgagggtagcaagtaagtttgtcttcacaatacccaaaatgatgtttcagcttttctcacttttcaagcccatcttatttcctctgtacctttattattttggtatcattaggtaaggtgaagaataatgtaggaaacaaatacccagctaaaacatttatgggtttctcgtatttgtgaataggattttaggcgtcagagcagtcttgtcttgtctcaaagatagatagtatccaatcttttgttaataagcctattgcttgacttttttgggttactttggaattacacatttggttgaacggctttgtggatctggggcatatgccaattaaggggcacatgccatgcgttctgttttcctgtcagcctgtgtacactgctgcttctgaaggcataagtacaggtgcagtttccacaaccacgtatgattgacagatggtgaacgaaaggggaaggcttccactttttttgccctagtttggtacataataaagtgattgcaaacacattatacatttatacataccttcacatggcagtccaacacgtaattgtgactccaaagatttgaaacaaacaaaaggcattcctttttgtattactttactttgtacttagttctttgtttaaagaagaaaaatcttttttaccttttttttttttttgagacggagtctcgctctgttgcccaggctggagtgcagtggcacaatttcagctcactgcaagctccacctcctgggttcatgccattctcctgcctcagcttcccgagtagctgggactacaggcgactgccaccactcctggctaatttttttttgtatttttaatagagacggggtttcaccatgttagccgggatggtctcgatctcctgacctcgcgatccacccacctcggcctcccaaagtgctgggattacaggcgtgagccaccgcacccggctgagaagaaaagtctttctttaaaagctgttgtcacttaatcaccaatgtatttaatggccaaatttccctagttggtataaactactcttaaaagttaacaaattgaacatatcaaactagtttatttaccacacttaatttcttctgtgtatggcctatgttttgggtaccctgacatgaaatgcaaaaccagattcttaatggtgccgatccacaaacactcaaagtccccatgtttaaatgaaatctatgaattttttttattaaggatttgataagctgatataatgaaaacatgtaaatgaaaaacatttacactgactgtacgactagtgtgctaagccattacaatagtttactgacataactggcaagagtaacttggaaaataacttaatccagcagaacaaaaacatcctcagaaaaacatcctcagtagtactgaatatatctctctcatatatctatctatctatctatatatatatatatatatatatagctttgcacaatcagggagcaaggcacataatgaaatgagcatacatttatgcagaagaaaataatagcaacaaagctgcgagaaaaattgtaacttcatcttcactgagctgtgcataatcctttgaataataatgtcctctacctggtacattataatgaagttccttgtcttcttcatgctttaaaaaagtatacttctacattgtatctacctatggcaaagctcccacagcctacaagttggtgtgagccttgactcttgttttttaaagaactgagggagggagcaatcccagttaaatataatgtgcaattcccctttaacagtaaacaatgtttttaaaacacttagcacaagctaattttatcttaaatgtacatctctgtaagagttcactagtggctgatagtaaaatgaagcaaaattgtttgaaacattccagttaatgcttattttctagaaggggttattttacaagtagcaaaaaaaaaaaaaaaagtaggaggtggggaaataatatgaaaaacggcagtttttggtattaggttacaataaatttaacgaatggacagtttgcaaaatataagggtttctccccctttagtgctgcagacaagttttactgcctaagacgttgaggctgcaacaatcatgagcttggtattagtagccatccatgataaacataattaattctcaacttaaccatctataaaatatgtagtgttcaccatcaccctgactcaattcacttctctaaatgtctttggtagaaagcagccagaccccacgtgggtagtgatgtctcttgtgagacacttttcatttctgccaaaactagaaataccaccttcctttactttcattagcacctcaaagtttgcttgctggatttctttaaaaatattctgccaaaagagttgaaggcactgggggtttacagcaagtattttctctttaaaacggtttattacttcaacaagcaaagagcaaaccaactggagaaatgtatgttttttctttttatttatcaagttttattctacagctaaatttcagatttcttttacatatagaccttgcaagggcacggtaagaactgagcacttgttttatttgagggataaaggtgtagaaattttctctttgaattttataaggaaaggctgggtacagtggctcatgcctgtaatctcagcattttgggaggctgaggcaggaagatcacttgtggccaggagtttgagaccagcctgggcaacacagtgagacccccatctctaccaaaaaaaaaaaaaaaccttaaaagataataagtatctaattcttttatacttgcatttctctttggatcaaatctcaactttgtgagaggtcatacatttctacagggttaggagtaccctgcataatttatacaaatgtaaagtgtatattaaaaaaaaaaaagtgaaagttacctgcaatctaaagggttttcttcccctagaaacagtcaccctctcgtcaagtgtatgacccaattatacctattttatgaaaagcaaggcatcacattgataaccatacaggatcctatgggtttaactggtctaaacttgagtggattaaatcagttgtaattagttagctctgtaggtatatgaaaaacttttggtaatgtacaaaaataggaatgggttttttacctgtttaaagtcactttgtgtttataacaaaattacttttagctgaggaacaaaggtgacaaagatttctgttggtggctgagagtcaaagcaggccaatccacaccattacctgaaatatttttcaggctaatttataactttatggatttcctcgatacaagtttattagtttattctccatatacaagtttattctcccagaatagcagcaaataaaacttgaattggatgtacagctcctaataaccttgatgtcagagttgtcacttggttggaattattatgatcccccaatttaaattttcttgataaactcagcgttgtttgttttcagtgacaagaaaacatacatggaaaggggacccaagacagttcaccaagatagttcacagccctttgcaggatatgcctttggtgggtgggagcacctagattttagaggactataaaacgccatgtttactttgtttgaaattttctgatgaaaagtcttttgtaacttaacattccacattttcatttaaaaagtcccagaaatataaactatccaatttacaactaaggtgggtatctgtaaaaaccttaagaatagttactcttcccaagagaattacagcgtctaagggggggaaagaaagcatctgagcagtaaaagtcaagctggtaaaatccaatacagaatatctaataaaccataagttattttactgagaatagattctgctgccctacagcattggtgccaaaactctaagcatagagtgattctactttgaaattatccatagtagaaattaggagtgtcactaattaagcaagtcactacctctaataagcacctgtttgcactgccctcagcagcaggatgagttaatccatgctgttcacttttcagtacagccaagtcaactgcacagacttgaagcagccaagctgggtgagagctgcagagcagagggcagtgaaagaaggcacagtactagtgtcgtgcggcagtagatgctttccatgaatacaccagagaaaaagagctacagaaatacagtctaggaaaagctacatcccaacaaaaatccaaattaaagaaaacccactagggagtaaaacagaagtataaagtatcactttagtggttttttaaattcagttcatacatgaggttaaaacatttttaatagccatttctgtctgtggaggaatgtaaagggaaatggcctgttgtcggacaagccactggactggggttaaaatgagtctcctcctctagccttactctcttcctggcatcattagtgttcaaaaggatgtctgctattccaggaaaacagaccagaagcatctgttcaggatggctatcatcaggattgatacaagcaagaaattccaagaaatcctgcactgaaaacataaaggctgttgttttagggctcaaatcatgggtgaaaaaaggttagcgggtacattttttccccctcaagaaaaactgaagtgttgtctaccttctcatgagaaaatcaccaccacaataaaactcaaaacctcagggatgaatactttgataactggattcatattcttactaactctaacccacaaatatgggtgcccctcaaactataaaactgcaggcagaagactatgagaaattcattcatgaatcacagtagcgcttggcaatctactcaaacattacccaaatttctgtgcatgcttaaattaacaatgcagatgtgttaaagatcacttcataaatatcaaacacaaaacttggtgaacaatttgaaagacctaaaaattaatggtatatattcttattgctccataaccacatgaacataaccgaacaatattctggagatgtagcaatggagaggtgctgttcactctctgtttacgatgcggttttcgtggagtgtgggttatgcaagaccttgagtatactgtactaattaagcacttttgctcattctagaattatttaccatctcttcccccactttactggcatcactttttccttgtgggacaatgtcaactgatttctgcagtttgcattggtaatcattaacaataggcacagactttcattacaagatgtgctccccttataagtgctgggatggcccatttttattctcttgtttaggagctgctctgagattgttttattcctaatagtccaatttatcataagttgatgagagtacttatttctctcatgtaccaaggaaaattcacagaaaaaagcatatagaagtatagtgtgtcgttagagcactgactccacgttataccaaactgcacacgcataaaacgtaatgtcagttactggacttggactgtcccactccatcagaacacctagtaacctgaactaatcacaaccaggctgcagtcagcaagggtcctggtagccccagtagctataaatgaaactgtcttccctctccatgtagtcccatacttaatgagctttttgtattacatattataacccatatacaaccagattaatgacacctgtacaggggccagttctgttctctcatcacccttcccttctatagagcaatgctcaaaaaatgcattttagaaaatgattttgtttttcataatgcaccatattggggcacaggatgtgtatatttcatataccaattgtctacagatatgtaataacacctacctaaagcacatattttaagaaggtaactggtgacccaaagacatactgggacagaacattacagagataactgtgttatccatcctcttaaaatcaatcaaagtgaggatcatgaagccaagttgataaagcttcataaaacagtactaaaaaggaactatccagaattatagcactaattatccatgtattgtaggcaaagagcttatctgtcagcacatcctaaatgtgggtggatcactgcagcagtactgcagctagaacagctgagttaattacgccatgtatttactttctatgcacaaccacatacagatgatgtctgtgaacatttccccatcctgcactagttacccgttctatgaagctgagagattttcctgatttaaagtgccccttcatgtatagcaatgaagtgtcagtcaagcaattctaacttcagccaactggggaaaaacaaacacaaaagccttatagatacaccaaacattctggtgatttttctcaaccagaaatagcacattctacatctattccttagttatataatacacaacatgcacgaataggctacacatggacagacacttataaataccttctaaataagtgattagaagtttttggtccaatccacatgatatagaaatcttaagagacaacacacatccccttctatgcctcttccacccaaaatacagaacacccattttcagattaggagagaaaaggaataaatagaataactctcagctctctctctatatacacatacacatacatatatgtatacatatatacacacactgtacagctgtgtgtacatgcacgtgtacacacacacatacacatatagctggacactacctgaataacatcataccaggaggctctgaacacctgaattcacagatgatcaggtgagctgattgtagcagtgattacagatatcatgaaaataaagtcctatggtggctaccagtctctggagagcttggtgttctggtctcttttggggggagcaggagggggtcctctccgcaacgttgcatagcctgatatatgactgcctccgtaaccagccttctgttgatcagacagcagttcagggggtggtggaggcaatgccatatcatccatggtggctgttggttctgctctggacatgcgggaggagagtgagccgtgccgagtgatggactttcgttgcagtgtcctgttgaggtcagccaggaatccaggctggacactaaggctggatttgggagaggtgggcacttgtggcacaactgtggccattgttggctgctcagaaatctcagcttgagtgaggcgggtgctatcattccgtttgggtcgtgtgggtggaggggccttcttcactgacattttagaccattgttgtggttgaggattaacgactgccacttttggagaggtgtttcccgagaaaactgctggaatctcaatggggggcagaggaagctctgtttcaggtggagggggtggaaaatcagaatcggatggaggagaaggaaattccaccacggagtcctttccacgcccactcagaacaggggcttttgctgacacacacccttgttggagaactccaggaaggttgactccagaaagattgagttttccaggcttggggggtgctgcaggaggtggtagggtctccttgctgggagaccctgattctgctggcggtgtaaacttgctgactagactgtccaccgagggtctcttgggctcggggtgctctgcaccactgctggatttaatgctggagttgcgctgtggggttgggggtggtttctttcccccagggctggacgtcttactggtctttttgcctggagatccacttttgtcaggggtaggagaagctgtgggtggaggtggtggtggtggggctgggacaggtgatgggggtggaggaggaaacaccaggctgctttcaggagggggaggagggaagtccggagaagggactgggatggagctgggctgccacttgggctttgcttttactgcaggaggggactgtggagctacatttgctgggacaggctttaagggctgagattccatggcagggggagttggagggggtggaaactggctggctatctgcttcacgaccgagggcaccggtgacagtggagagggagggggttttgcacagaagctctgttgcttgggtaatgttggcgggggtactggaacaggaggggtagggggagagggtggaatgtaagaagcagggaaagctggctgcttttttgctgggggcactggaggagtaggtgtgggtggtgcagcttgagtcacaacaggtgccacagtcttggtgctggttggtgcggggatggtcacaaggggttttgggggagcttggggagggaggggtgcagggataggaggaggtggggggggtgttgggggagccacctgagtaatatgctgaacttgatggatcttcagtggaggaggcggggcactgaactgtggaagggatggggcacacggtgcaggctttagctgggccatggcagagcctggggttgggggtggaggagggggagggggtggtggaacaactccattggggggtaccaggatctgaggcttcactgactgtgactgcatcactgggggtgttggcggcttaaacagggcccctgaatgctgagacgcattctgtagccgtgttattgtgctgtacttgacgaacattggggctgctgagcctgcagaaggtgcagactggctggggagtgggggaggagggggtggtggagggggtggtggaggaggaggtgggggtggcggaggaggtagaggtggtgaaggctgtgaagcagtgtagggggtgactatcttaggttgcggggataaagggggcacaagtgaagtgtagggccgattcatagactccattctggcctaaaaggagtataaaaagggagtgggagagagaaaaacacaacaaacaaaacagttacagaggtaagctttgattgtgtaaaactaaaaagcagggagtctgggacatgcatgaaaaggatgcagaagttggtggtgatcataaagatggacaatgtcaggaaggctaaaatctgattgtgcgggcaagaaggaaacagaaaacttgttttaccccacagtaaaatagctagaccatctaacaatctaggaaaaatgtccggctgcaaaagctgtttgaatggtgacaggatgcatgacttctgaccttggctgtatgactttgacacagcctgccctacatggaaccctctgtggcggtcctctgagcactggacttccaaggggagatgtgatggctccagtttacctttcagtccatgactgcatccacatcaagcagatgctataactgggtttaggagggcttcctggtggaatgaggatggctttttgatgctagtaagctgacacaggagagtatgagaatgttgagcaggcgtgcacagtcacacaggaatgaataagcttgacacacacactcgtgttggtgtgagacaattgcatccaacatgcacagaagtccagcaatgcaggtaaaggggggacattctttacatttgttttactggaaaatacataaagaaatgctttgtaaacattatagcaaaagactgtaaaaatatcatacagaaaaagccagaagaaattaagaggaagctctggaaggctagaataaagaaaatgtatcaagaaatggcagctagcatttgccaacaaccaacccatctgggtagctgaaatgatcacatctggtagtttatttcgtggagctaatcatgcacgatggtggttcaggtactttgaaaagaggaaaggaaggacccttgttttaaaaactttaggtacatcttttaggctctttgaacaaactttgaggatccaagataaaccatttgttttcaattttgaatgacatcgagaatgcatgggttagtgaactagaaggctcattatagggctgaattctaatagccatccggacattcacatgtttcttttaaaattacacaaaaagattagtctgtgagattgggatacaggcgtcaccgaggttaatgtgtttccagagaacaacccctgaccttaacttgaccctgtcttggctgcttcaggggcgcaggccttagctgtgctggccttctcatttggcacctgagactgaggtaacaggagaagaaatacagagtgatcaagccttaaagcattactgctgacagcagggttcctactcttctgaaactctgtgcaataacggactttgctgcttaatcacagaacattttgggtctgtgattttgttttccttggccttacacataactaggttctataacttaaaatgcacacggatctcaccattagtaatttggtaaggcaaaggggtttttctttagccatccgaattctgtaaaccaacttctttagtacatttttaaaatactagctccatccaaattgattaaatgggggaagggagagagaaattatttcttaaaagtttgagtctctaataagggagttaaactcagtgttttgagaatttagatcgttagaaccaattctcaaatgctcatttctgaaggaaagggcttcagccccacatggtgctactaaggccttctcttccctgcgggagcccagttagtgaaccacatatacgaatgaaggaataaaaggaaaaatgtccatttattctcattcgtgaatgtacctgtataagtgattcagaccaaaagcaccccccaccaaaaaattaaataaataaataaaaacaattattagtaaaaataaaatagttgagcccagggtgccactggttcctcaatgatggagtgacctcttgcatattgaaatggtgactacagccaggacacatccttgcctacacaactacagatgatgtctgatagaaggccatgatgtctttcaaatgaactgaagaacctctctattttcctaattatagtcttgcaataactatactcatccttcagtctcactgcacaatatactatgcaaggctcaggaatccaaaacttttaagggaaatgattttaatttagtcttccacataaagtataatttgaaaaaattcatcaatgcccaaagaaatggcaaaagcattaaaaaaaaaaaaggtaaggaatgagtctgaataaattaaccaataaagaaataactggactgaatatggtggctcatgcctgtaatcccaggactttggaaagccgaggcaggaggatcgcttgaggccaggagttcgagaccagcccaggcaaaatagccagaccttgtctctaccaaaaaataaaaaactagccaggcatggtggtgtgcacctgtagtcccaactactcaggcaactactcgggaggctgaggtgagcaagcaggctgaggtgggaggatcatttgagcccaggaggcttaagtgagccctgataacaccactgcattccagcctgggtgacgggaaagggagagggagagggagaggaggggatggggagaaggaaggaaaggaagggaaggaagggagagaaggaaggggagggagggagggaagtgaggggagggaggaaaggagggaaggaaggaagaaaagaataaaaaagaagagaaaaaaagagagagagaggctgggcacggtggctctcgcctgtaatcccagcactctgggaggctgaggcaggtggatctcgaagtcaagaggttgaaaccatcctagacaacagggtgaaaccctgtctctactaaaaatacaaaaattagctgggcgtggtagcatgtgcctataatcccagctactcgggaggctgaggcaggagaatcgtttgaacccgggaggcgaaggctgcagtgagctgagatcacgccactgcactccagcctggcgacagactgacactctgtcaaaaaaaaaaaaaaaaaaaaaggaagaagaaaaaaagacaggaaagaagagagagaactgtaaacagcttctctagaatttagggcatttgcaatagatggtgttttgccatccaaactgcttaaaggtggaaaggaagaaattgttatttcttaaaaatctgagccactgatgaaagaattaaactgccagttttttttgtttttttgagattttaagtcattagagccaatttgtaaaatactcatttccaaggggaagtcaaatcaacaggtctctctgaactgtctttacccactacaattaggaagattgaaaattaataaaggagactgaaataaggccaaataagatccccgataaagacataagagagcaacaatttaaacccaaaagaataccacagaattttcaatgtaaattaaaacgaagctgttaccttgctggactcttccaactgagtgcctcgtttccaggcttcagagaatacggagctcacaatgctctgggaacggacgtgtcctgctggctgggtgtcagaaactccgctatcagactgattggagtggtttgactgagactctgtttaaaatagttttttaaacataggtttaaaagagtcagtattctgacaatattcatatgtatgtctagttagatcttttacacaaggtcaagtgctgtgtacaacagcaccaagttattttactcatttcatcataaacacagccagtattttctactagaaaacttcccttaccttggaattaagaaatctcagattagtgttaaatatttcaccatgagagactgataattataataaatgattcacataacattattggtatcctgacacccagtcttgcatgaaatcaactctaaacaataaaagaattaatgaaccatcagtagaggagtctctcaatcatgtctgcattacattgagaatcagcctttttaatacccctgccttaaggtcacgccagaattgtaacttaggaattcggatctatacacaatgattatttccttttttctagcaatgagcaatacttagaatttgaccctctagtgcgaagtgtgtttcctagggatttaggtattggacccatagggtggcagctgtgctgtatcctggcctgtcagcaaggcacaaaaaagttttgaaaggagtggggcctggtgggaatggctgtgagcatacagtgtctctttgccgcctgagcaaggaggctgaggtgggaggatcatttgagcccaggagagttaagtgagctatgataacaccactgcattccagcctgggtgatgggagaggaaggaaggaaaaggaaggggaaccatgttctggaagggttgttggttggttttttttccccattttaataaatattttcttagaatagttttaagatatctacatattagatatttgaatattagaacagttttagcacagaattcctacatacccggcatccagtttacccatttagcaatatgtttggttttaaagaaattctcctttggggaaaaagtgtcctcttttaattttattcccttttccccattattaacatgttacattactatactacatttgtcacaactaaggaaatgtcctgctactattaactacgctccacactttatttggatttcactagtttttccctcatgtgccttttctgatccaggacaccacgtcacagttagtcatcatgtctcctataacggcttctcagaatttcctgtttttgatgacttagacagttttgaggaatagtggtcaggtatcttgtagactgtctctcagttttggtttgtctgatgctttttctcttgattagtctgtttatggaacttggggaggaagatcatagaggaaaaaagccattctcacacactatgtcaaaggtccctataaccaatgtgacttagatactgaccttgaccacatggttgtggcagtgtttgtcaggtttctccactgtgaagttacccctaatccccgttccataatcactggaagcaagtcactaagcacagtccacacttgaggacttaggtaagctctacttccttcaggacaaagtgtcttcataaatcatttagaaatctacacaggacagttctctcctcttccccatttatttattcaatgatttatttacatcagtataaactcatggatatttatgtccatgggttacaatcctatactatattacttattgtattgctcaaattgttccagctttgacctttggagctctttcagactggctcctctgtgtatccctttgacatattctcatcttgtgttttgtgagacagggtctcgttctgttgcacaagctggagcacagtggtgtgattatagctcactgcagccttgaacttttgggctcaagcaatcctcctgcctcagcctcctgagttgctaggactatgtgtactactaagtctggctaatttaaaaaaaaaaaaaaaaaaaagttgtggagatggggtcttgctgtgctgcccaggctggttttgaactactgggctcacgtgatcccttaacctaggcctcccaaagcattggcattacaggcgtcagccactgtgcctggccctactgtcgttttttaagcattcccttactttctggcattacaagatgctctaggctcatcttgtatatattctctgctgcagccctataatttgccatttctttgagagccttggttttcttttctttcttttttttttttttttttgaagaatggtattagaaaccatgatctatttaagcagcatccttggccaaaatttaataaaacgaaaaaacaaaaagaaacctctatgatctagggactgggtattctcattgttcctggggtatcactgcttctagtcctcagtggacagcactaggaaatgtatgtgtatatacacattctaaatttgtttttacttaatagagatgaaatagagtcatgcagcttttaaatatactactaaagttattatttctttcatcacatccaatgcaaaaatttaaaaattctgcttttagatgacatggatctcattcatgaaacattttgaattgaaagaagatttatgttaagatgtaatcatagcatgcacttgtttaaaggatataggaatctgaaggagtgcagcttcttcatggtttctgagtacaaagattctttccaagtaatgttttatcccaaattatgcattaacagtgtccagcagtatgtatgttttgaataaattttataaatataaataa

SEQ ID NO: 568 - DNA, 33109 bp, Homo sapiens
agtcctgctaattccctgaatcaggccactgccatctcatgcctgcgttgcactgaggacctccagtctggaagctcattttccatatctttacaaagcagatctatcactctgaactgttgtctcgacccgagttttgataggtattgtgctgggatctgaccattcaaaatacaatcactggaatctgaagaagtattctgtgggagtgaatggaaatatatatgacttttaaatgggcaaaggtaatgtttttctgtaagaattaaatacctgcagttgtattatttgaaggtgcattttcaggggcgagctgcaaaacatctgtcaggtcccaacatttgtctactggtgtttttttaaatgtggattgccaaaatctttattcatgatggacattatgtaggagtggttaatacttacatagcacttacctgtgtcaggcacactgatcaaaataaccgacgaagtattattcaacataaagaaaaatctaacttggatgtgaatgatcagagaacttaagttttaatttttaaacctttcagaaattgttaatatagatgtttataacttccaccttttaaattatttcacttattgaacagatattagtgaacttctaggtgctgaggaaacaacaaagagcaaagcaaagtccctgtcccccaggagttcgcgttttaacggggaagaaaaataagcaagtgaaatggacgactgtgagaagacggagcagggagatgttactattgcttgtagggtggtcacagaatgcctgcaaaaacaacccttttgaagaattgggaaaaaaataaaaaccatttggctgaaacagccctgagaagggcagcttcttccaccactctttcatcattttaccatctgtgggttatccccggggtcactgctatcccagcctaggttttatacaggatggagtacgaagttcccgcaactatccaaacggtaaaatgtgcttaaaaaaaaaaaaaaacctatttaaaaaggaatcctgcttgttcctgcgctacatttttgtttagtctctttggttgacttggaatctctgcctgttctcggtgcatgcggctcgaaggtgggctagggagcttcccttctcttaaccacctcgcggccggcactggaacccgatcggagtgtatctgtggggctgcggcgatggctggggccctaacgtcgccgaggacgcccgcctcgggagcaggagctgcggcgtggccctggcgcttccggacacccggtagggcggagggcccaacggtggggtccgcgctcaccgccttgagcccgcccctgcgcccggcgccctcagcccacgccccgcccagtcccccaggccctagcgtttacccccacgccccgcctcgccccgcgacccacgtaccccgcctccgagccccgcccccgcccccacgtgccccgcccccgagccccgcccccgtccccgtgcctgcccatgagccgcgccccgccccccgcgtcccgcttagccccccaccccgagccccacccaccgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccgggtgaggcggtcgcgtcgggaaacccggacgccggggctcccctcccccgctggggttacccgcgaccctcggcgcccccaccgcgcggctcgaccttgttgcgtttcagacgggaggagggttgagagggggagagcggagatccggctccccaaaggcgcctcgccctcttaggaagaagcgcacactgggggtcagggccttttgcctggggctcatgggtggggtttagtgatccgtgaagctactaaagttgtataaaaaaattatggataagttcatatatgcatccttcattttctggagggggagtccctaatttccctcagattctcaaaggcatgtgtaatccccaaagggttaaaaaccattggcgtttaggatagtagtgcgcgacttccgcctattagaatcacctgtggccaggtgctttaaaacatgccgatgcccacccccaccccgatccattgaatcagaatgtctaggggatgggattcgggcttcagaaaaaaaaaaaaaaatttaagctccttttggatggttccgttgtgcagccgaagggtggaaacctgtaaaaacaccgaagcacctgactgtgcgtctccttctgggagcttggtaaataccggactctggtgtcccatcgcagtcatcacctgcctcttacttgcacataccacatcccccctcctctgatgagtctctcttggcaccagactaggccaatgattcccgcttttctgcgtttcttcacctcccacaaacgtattgaaagtgcttcgctgcatgtcattttaaaaataatagagatttgggaagggtctgtaaagcttgctataatcattagaatccccaggggtgctgtaagacctggagggcttggatactgatccagatcagaacacaggttttcaagttgaattttataccagtcactttattaatagagatgtagatatttttctggaaaagatactcatctttgcagatatctgatcagtaaatccataatttcttgtaagttttaagaatatgaaaattgcagtaatcagggttgtgtattttcttgttttggctcatcaatgggcagagcattgattagaaagagtagcaaataaccaagtttctagctagatagtccttggcagatagagtctgcagatgtacttgcaagtagcagggtcattgaaaaaagtaattgttgggaaacctcagccttcctcttggacacgtttgtctcaccaaggaaaatgcaccgttaagaacaactgatcagagtatcactttatgaggactttcttttccttattgaaacgtcaagaaatctcttccttctcaagcaggtttttttttttttcctgcttttaaacattattaatcctgtactgatgttcacttgtaactttttttcccgtatttttcagagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaagtaagttaaatacctgccttaccttttttttccccagttagattttagttatgatttggtcatttgaaacgtgaatatagtattgtatctatgccctcctacatagtactaagccaagagattggtacatttccagcctgaaaatcttgagtgttcttttatcttgtggaaatttcttatttccttcctttcttcctttattcaaaaaaatatttcttgagaatcaatcccagacactatcctaggtactggggatacatcagtgattaaaagacagagtctctggcttcatggagcttatattatagtaggaagagacagacaataaatgaatgaacaagaaatacactggtatagtaggtaagtgtcatggagacaaacaagctagggaagcattaaaacaactacagaaatcattccagcttagaatgtatatgttctctttgccaccacctaagttaattctttttttttttttttttgagacagagttttcgctcctgttgcccaggctggagtgcaatggtgcaatctcagctcacggcaacctctgcctcctgggttcaagcgattctcctgcctcagcctcccgagtagctgggattacaggtgtgcaccaccatgcccggctaatttttgtaattttagtagagacagggtttcaccatgttcgccaggctggtttcaaactcctgacctccagtgatccgcccaccttggcctcccaaagtgttaggattacaggcctgagccaccacacccggccaagataaataattcttatggagaccatgccttccattattttgactttagtaggggaaaacaggagttccttttgtggtatttcctgtagttttaaatctataatagaaaatcacattttaaaaaatgccttgggttcccttgttgggccagaaagtaggtcttctctaggactcacgaggacctcacatgaaaccactgatttgaaacacagctggaacttggaaccatatttcctttcaggcagtcatgaaattggctttgattatgtagtaagtcttaatagagtgataaatgtgctgtcttttttcatttgtacaaatgaagtaattaaggctgtccatgaatttcgtggatataaccaagaggaacctcaacaacaactcttttcataggcttctgttaacttgttcttgccaatatgctaggttttctgtatttgttactctttgcttttaataccagatactgaattcccttttcgtaatgaaggaatttaaattaggaattgaaatccaggaagccattgcttagaagcaaaaatcatatcttagaaaagtttcaaaaatgaaattcccattagtacctggaaatattacatgggaataaataaatatcaaaggtaacactgaaatttccatggtaatacaacatccctaacagatggacatctagctgtgtttgaatgtttctggtatgtggcagttactaccattctacaattttaagctttaactgtagaatatcattaaggtaaccacatctacctctgctgggcttggtggctcatgcctgtaaccctgacattttgggaaagcaaggtaggccaattgcttgagctgaggatttcgagactagcctgggcaacatggcaaaaccctgtctctacaacaaatacaaaaattaactgggcatagtggtcccagctcctcgggaggttgaggtgggaggatcacttgaatctaggaggcggaggttgcagtgagccgtgattgcaccactgtgctccattctgggagacagagccagaccctgtctaaaaaaaaaacaaacaagcaaaaacaaaaactcccttctgaccgctgccttactcaagtaccaggtaaatgaagtctctgctgcatggttataattatctccctttcaagaatgaacagtcctcatttcttcacctggacctcaacaggcatggttgtggcttccaaacctttccaaaagaaaggctgtttgttctttttggtcagtggacatgaccctttttgtcagcgcctggtttttgcctgtgctcagaacccagcatggtattctgcagtgcagactaagtagtacccctgactgggcactgtactcttcacagctcagcctcacattgcactgggttttcctgtcagtgacatcattggcccatatgcattttcatgccatgggtctaattttgaaaaaaaaaaaaaaaaacaaaaaaaaacacaatttctaatacagaatttaaagtttaggacttgtatgttctaaaacctgaattatcagcgtgacaaaatgagtatgggctgttcttcactgccttgcatcttcatggtttccacctgaaatggcaacattttcctggcactaacttagggctccaaaggactgtagctgaacatagatccacattattgttcctctttttttttttttaattttaatttttaaaattttctttttacactgaggagcaagtgtccacttttttaatgagggcaggaaaggagtaggaccacatgaggaagaaattaaagctgtcagtctgtaggctcgaatgccaggaagttcagagaagcctctttaggttcctagggaaaccatgtgtgcttttctgaaaggacctttggaaatttgcaaatggtaggacagacttgtactagcaggtacgtttgtttgcatttgcaaaaatcatcttttacgagcctttagaatattcaaaattttcccagcaaatttgagaaatgttaaatgttatgtagatgtattaaaacaatttaagaattattataatgctttatttatgactgacatttatatggatacatttacattgctctcttattctatattgcattcaaatatagggagtttggtttaatcaatactttatctccactgccaaagtaggtcttgaacttttaaatttaaagtgctacctcagacttttgctatcagaatttggtgccaagattaaaatgtggagagtttataccagtttttataaatatatggaattggatcaaaatattcattgcaatctaataataaataatagttttatttcatgagttagaccttaatcacttaatcttactaatcttgttcttacatgaatgaatagtaactttcagcctggcagagccttgcataaagagaaattggcatgtgtggtagccctttctgcagtaatttttttaaaatccaagttatgttgcttaaaatataatcatattttgccaaaaacatacagtttagacaactctatgttgcttgaaactcctgtatgttgcttgaaactcctgtatgttgcctaaaacagacattaggattttttctgtttggatggaaacttttgtaatttaattcaattttgtcttaaaaggttgataccataaatattttgtaattttagaaaatcttccatttatagaaaaaacattaagataaccattgctacaacttttaagcagcgtgtctatttttaaaaattctgaaaatggcgtatttaacttgtattcatactcctttctctctctcacacacacattcgaaaaaggatagaacaaatgagaaagatggtgtgatttagcagtagtttttcaaaatttatatttttgaaatttgaattgtttctttttttgttcttgggaacataataataaatgcaaacaaagaattttccacttcagtaagatggacgtgaacccagaaactgatgatgttttgtactttctcacttcctgatgttgacattgagaactcttagtgctgttagttttcctcccacgtacttccataacgtagaattaggaagcttattaaactttttagtttatttatttaatatatttgtgatagtagtactttgttgtatcaaatagctaaaatctttgattgattcactgattgacacagtctcgctctgtcacccaggctagagtgcagtggcgcaatcatggctcactgcaacttccgcctccggggctcaagcaatcctcccaccctcagcctcctgagtagctaagactataagtgcgtgccaccacacccagctaacttgtatttttttggtagagacataggctccttatgttgcccaggctggtctcaaactcctgagctcaagcgacccgcccacctcagccacccaaaatgctggtattacaggtgtgagccaccatgcccagacaatttatctcttaaattgattatttgtctttttattattgagttgtaagagttctgtagatataagtcctttttcaaatatgatttgcaaatattttctcccatctgtgttgtctcttcactttcttgatagtgtcctttgtagcatcaaagtttttaattttggtgaggttcatctgtttactttttctttagttgcttgtggtttaggtgtatgtatttgagaaaccattacccaacccacggtcatgaagactggcacctatgtattcttctgacagttttatagttttagctctgatagctggacttttcactcatttttagtttttatatatggtgtaaggtaatggtccaccttcattcttttgtatgtgattatctagttgttctgtcaccatttattaaaagaccatctctctttcctcattgaatcatcttgcactcttgttgaaaatcggttgactgtatttacagtttattgctggactgtcaattttattctgttaatctgtgtgtctgcccttacaccagtataagatgatcttgaatattttacttttgtagtaagttttgaaatggagaagtgtaagtcttttaactttgttgttgttttttataaaaactattaacagttgtttattatcattatgaagtattatatactgtacataattgtatgtgctttgctttttttttttttttgagacagggcctctctgttgcccaggctagagtgcagtggtgcaatctcagctcactgcagcctccacctccttggctcaagccatcctcccacctcagcctcccaggtagctgggactatgggcacacaccaccacacccggctcatttttgtattttctgtagagatggggattcaccatgttgcccaacctggtctcaaactcctgcgctcaagtgacttgtttgccttgacttcccaaaatgctgagattataggcgtgggccactgcgcctggccaatatgtgctgtgcttttatatgactggcattgcactaggtttgtttacaccaacatcaccacaaacacggggggtgatgcattatgctacaacattatgacgtcactaggcaatagggattttttagctccattataataatgactaccatcatatgtgcagtccattgttgactgaaatgttgctatgcaacagataactgtattttattttattaacttttacgttcaagggtacacatgcaggtttgttacctgggtaaattgtgatcctctccctcctcccactctagtctcaactaggcctgtttttcccttctttgtgtccacatggatacaagtcttttatttattatcgaggaatttatagaaaacagaaatcttcccacattttttgattctactatattgatatatttgttgacagagatttttactatatatgtgtcccataagctttaattcacttttaacggtatcactatgagaggtaagtttatttttaggaaaattggacattttagttggttactgcttcagagaaagaagatggtcacttaaatttctggctcatgtcctcactaccaaatgcttccagatggagagcaccaaaatggcagattgtttcttttgagtctagaaaagcactcccttcactaggcttatccctattttggttgaattctacattgccttaatttaatgtaatcaatgatatttatatttatgtaaagaataagctgactataatgaatacccataccctgaaatttaaagtaacacaatgcccagaaagtaagtatgttctggttaatttaattgtctattcttagagttaacctgtcttgtttcaacatttgctaaaaaatcatttttaaaatgttttggttcttttgttgccttaataaatatactttatagtaaatataatttaaatattctttgagtcaggatcttacattattgcagagttttctcaccaacaagaattggtaatagtgatgctagtagaattgaccagccacaccagcattcctaacaaatctgcatggcactcatggtaagcttataaattggccacaacagaaggatgcataagatcactctgaagatcacttctttattttattttatttttaatagagacaggatcttgctgtgtggtccaggctggtctcgaactcctggatgcaagtgatcctcctgccttggcctcccaaagtgctgagccaccatgctcggctgaagattattttctcttgagcagtattctgttctttcattcaagggttcatttatgtcctgttctgagggtagcattttattctgcaagatacaacgaaagtatcagatcactttctcccttgaagccttattggtgatataaaacaaatatgtaaaacgttttagaatcagaagatcatatgattaaatactcgtgagagttcagaccatcagtattataggatttaagaataaggagagattagtgattaccaaccattggtaggcagcttctttaacaaatcgctgcctgaagtggactctgaaggatgagtgtagtttaggttctacagagtggaaggtacaagggagggtgacagagccagtatagtcctggtggaagatagaacaaagtgccaacaaagcaggaataaggatacagtactttgggaaggggaaaaaaatcagagtggtagatcccataggatattgaattaaatatttgccgagttcagcaagcagttgaaagtgttgcggtttttatctttttaaattcaattcctgacggcttgtttacttatatttttcttattcttttatgggaatgtcaaaaggtaaaaattagttggcaattttggttgatgttagttcattgaaaatttgctgggtttgtttaaataaattacagatttagagtataacctgatgcaaagcctcagtgagtatctgggtttgaagtgtcttgttggactttcctgatatattgctcttccttttttttttttttttcttcttaattacatgtgtggttttattttagaaaagccagtgaaggtttgaagagtataaacccaggtgagacagcaccctctatgcgactgctggcctatggtaagttagaaccacatggtttcattaaggaaaaaaatcatacttggcataaaagtcatttgcatcttttgtatctttgtagatttcaagtagttgtttattactgccttggcctattggtgtacatatttgcttattatccccgtcttccaggttccttttgtaaatgaaaatgattgcaagtgacccttacctgtatgtccattgtatattaaccaggtttgaaagttagatttttaatgtgtatgtaccctagttaactaagattttctagatgatgaaactgttactttctctgaatcttactttggcttttctaggagtactcttcatattaaagcagttaatatctctgcgtattacactttgagaattatgtttaagattggatctaggttccccacttgggctcaggaatacacagttcccctttacactcaatttcagttctaagccatcaaacttaactctgtagactctgttatcataaagtaagccggagttttggtgttgtatcctctgtctcacctatttcttctgtgcctttctagacccttttctcccctttttcattactctgctgcattctgccattcatttcctttcctcttcccgcttccctctctgattcatcatttagccaagcacatgcctctccagagccagctgtccactgcttcaggaagaacataagcaccctttcccctccaacacactttgtattaactagtccttggaaatttgacttgaaatcttggcaggaaaagagttaacagtgtttttcttcctgtttagtttctggcttgggctttggaatcatgagtggagtattttcctttgtgaataccctatctgactccttggggccaggcacagtgggcattcatggagattctcctcaattcttcctttattcaggtatgtgtctcatagctgtcaacattcaggcttctagtctaaatgatcattcttattggggttcactggcttaggaatttcagtggattggaatttatgttatgtcttttaaaggcgaaatactctgaggcactgtgaagtaaaagacttaggaaaataaaaattctggttagagtgttttagaattttggagtggaatttagcttgcgtaaaattttattttgctgtactgacaatgttgctatatagttgaaatgttagaagtgaatttttaaaggccatgtgctctttttggtttttatgattttatgttatcttcagtagaagccctaatctataattgtcattgtggtgccttttgtgggaataggcagtaaaatttaatctgaaattgagaggaaaaatgggataatagatgagttgatcatttcatccaaatgatgcagctaaaaggaccaactcatttcaaattgctttttcgtccacgagctaaaaattgtcatcatgatgcagtgatcacaaatttgagagttggtagcgtacataattaacatagatttcttctaagttccacaagaagactcttttaaaaatagggggagaacacccactgtatttttagtcgtttccacaacagttatgccattgaaataactgagttcacatcatgatttgtatcttcttttaataacatctatgctaaagctcctcagggagcttatcctctaataagggaataagagaaaaaaaagtgaataagcatttcagtaacactttaaggtaataatggaaaagatataaagaggtatgaccaatttttaaaaatttctgcagtagtttagaggcatgttgaatgtcatagtgatccccaagcccagtggacactcattcaccattcgcagtagaccctttgtttccatttcagttcaggccttgacatctcctctctggcttaccatcatctgccctcaactggttagtctttccttgacacactattcatgtgaatcctgtatgcaactacctaactaatcttccctgctgcaaaaatggtttggcttttcagggcctagaggagagagtcaaggccctttaaatctggctgcaagttagaggacaagaaagtgtgttaatgggtcatacttatttaatggtgcttccaacatagcaaattatctttcttttgaacatttcatcattggcatatttctggcaaatgtgttaatgattgattatactgagtgttaggtctttaaaacaaatgtaatattagtaaagtctgttagaacccgatgaaaattaataaaacataatcgtaaggggtgttagtgctacagtttgttttctgttttcatatacagttaacacggctctctctccctgctacagttttcttttgatatacaggttttgccagcttttttcactagatggtgctaattccctttagtgacctaggctgttttcatacgatgtttaaaatgattcttttggtagtaaaagaaaaatttgataccaatttggggattgtatttgtaatttctaggaattaaaggaaaaattcaatattcagtaagctatcttaatgtctttagctaagttagcatggcagactggctatgttataaatttgtatctatagaatgaaagaacagtgttgttttatcatttgcaagtttcttactgttataacatcattctttgaagcataaactttgaattataaatttaagaaattaatttgtattacatttaaaaataagatccccaaatttatatttattgtatttatgttatttataactacttgtaattaccatttatttagacacaactcatttttgccaggtaaatccataactttatatgtttagtatactccattacaaatgcctaaataataatcagaataaataaggaatgtagggtcactaattacagattaagcatttttaatccaaaaatccaaaatccaaaaatgctccaacatccaaaacttccttcaccgacatgacgccacaagtaggaaatttcacacctgaccttgtgtgatgggtcacagtcagaacaagaaaaaactgtttcatgcacaaaattattaaaaatattgtgtaaaattaccttcagtctgtgtgtatcagatatatatgaaatgcaaatgaatttcatgttttggccaggtgtggtggctcatgcctgtaatcccaacactttgggaagccaaggcaggagaatcacttgagctcaggagtttgagaccagcctgggcaatatagtgagaccttgtctctactaaaaattaaaaaattcagctgggtatggtggtgcccacccatggtcccagctactcaggaggccgaggtgggagaatcattgagcccgggaggttgagactgcagtgagctgtgatcgtcccactgcaatccagcctgagtaacagagggatactctgtttcaagagaaaaaaaaaaaagaatttcatgtttaaacttgagtcttatcccctaaatatctcattttatatatatagatgcacaaatatttcaaaatttgaaacacttctggtcccaaacatttcagataagggatattcagcctgtagtatatatctgtctatattagtatgtgttaataagatccatactatatgatacctgtgtgtacataggctcttatgttacaaacaggcatagtttataaataatgtttatgtataggttacttcttttttatttgtggttatgttgtaggctagcattaaattttactagaatcattaccatttcttggtaattttgtatagagacaaaagtatgggaattggaatcctaggttcgaatcttatcctggctcattaatttagtattttgggcaagtccatttgattattgaatcactcattccatacataattattaaatgtttttagtctaaaggagttataccaagctatgaaaatagagcccagttaccattcataacttccattcatagtggggaataaagacaaacagctaattacaataaagcatgatcaatgctacagtgaaatgaggaagagccatggggcacaaaggacaggctgtaacccatgctcccaggccacagtaccttggctttgcagcatttatcacaggcgtcattaagtaatggtatagttatttgttgaatgtctttttctccagttgggtgctaagccatgcaagtgcaaggacgacatctgtattgttcactgctctgtcctcggcatcttgtggagtcctttatttctagatggcactcaataaataacttacagaaaaatgaaagccaggcacagcttatggaggaagtgccataacgagtagagatttacttaaagggtgaataatagctaggcaggcaaagaaaggagttgtcagagaaagatgttcgaggcagagggaagaggcctctttcctccaggcctggaggtaagagcagtattgttcacagggcaaaggaagtcttgtccttccatctaatcttcaatttcctgatctttcaggaagggcagaaataacgcctagctcagagttgttgagaattaaatgaaattaatttagagaatatgtatttaagtgcttataagctctaaactggcctaagaatattattaaggtggagaatttagcgcttgagatgagaaaacagaattcagagagaagataatttttctagtattatatagaatctgggtttttcattccgaattacctcccttatgctttagaagaaaaaatgtctttagctagtacctagtaaaaaagaacagctgatcattttattttaaaaaattccccagaccatttcacttctattatattttctagacagtgcacttaaaacctaggcaagcttttaaactttttagccactaaacgtttcacaagggaaaaccaatatgggtcagaccacatatggagtgttgtattgttccaagcattgtgatttaacaggaatactgaagaagtaaaattcatatagaaagaatgttgtcagtatgatagaagatctagaagccatggcctgtgggatatgactgaagaaagaaaaatactgagcttgaagaaaataaaagaggaatgtgggagattatttttgtcccaatttgtcatttcctgtaataagtctcatggtggctggaatgttcttttctaccctttgactttgagctcagtcatgtggcttgaattggccaattagtggttatgatgtaagttagaggcttaaaaagtatttgcatgattggaccttccttcttggactctggtgccatgagaagaagataccttgggaagttaatggccacttagcctggacccttgaatgaatatacccagagccacacagagcccaccccaggagcttgcagcagagttttccagctgatcccagcctttatcagcaatgcacagtcagcctttagacctgtgagcatgagaataaatttttgttactgtaacccaatacattttttatctttcattcacttttctattcgtaatattttaagaataatctctacagtgtggcagtttgttaaagtttagactcgactgaaagctctttgtaagcaagactatctcaatacctacatttccaaattccaaagtagtagagaaagtataacatctcctaatgatacagaaaaaatgatcaacaatagattgtaacctgcagttcttatccttttatgatttcattagaatcttaatttcttgtaataagttgtcacaactaactgctactgtttatgatacagtgatactctatacgctgtatatatcatcgaatttgtatttttcattatctgttttctctttctctttttttctaagagataaggtcttgctctgtcactctgtcactggaatgcagtgttaatgatcttagctctctataaccttgaactcctgggctcaagtgatcctcccactcagcctcccaagtagctaggaccacaggcatgtgctgctatgcccagctaatttttgtattttttgtggagatgggggtctccttatgttgcccgggctagtcccaaactcctggcctcaagcaatcctcctgcctcagcctcccaaagtgctgggattatagggtgtgagccaccacgcctggcttgttttctttatatcaatagtgtaagcctttctttccagctgctcaaataactgagaatagaaaattgtactttttggaatgcactttcattaaatggatatgacctatcatagtctctagtagcttgtgatacattatgaaatgcacacatcacaggcatcagtcttcaggcagtgtgtaagcaggcagctcagtgtattgcttcacagtctctagctgaaagaatgacatgggctgcggctgtaagacttgatggctcttctaggtatgtttcaggccacactgaatcactgatgtctctttcctcacacggatgaatggctaggctctgctgactacctttcggcgcagttgaatgacttgcacttctccattctctatagaccttgtttcttctcatgggtaaaattgtccttattttcgtcagccactgctgcctttatttttagttatttattttattttattttacttttctttttttttttactgagaccgagtcttactctgttgcccaggctggagtgcagtggtgcggtctcggctcactgcaagctctgcctctcgggttcatgccattctcctgcctcaccctccccagtagctgggactacaggcgcctgccaccacgcctggctaattttttgtatttttagtagagatgggggtttcaccatgtaggccaggctgttcttgaactcctgacctcaggtgatctgcctgcctcagccgcccagattgctgggattacaggcgtaagccaccgcacctggcctgtttttttgtgtgtttttcttcttcttcttcttttttttttttttcttgagacagagtcttgctctgttgcccaggctggagtgcagtggcacgatcttggctcactgcaacctccgccttccaggttcaagcgattctcctgcctcagccttctgagtagctgggattacaggagtgcgccaccctgcgcagctgatttttgtatttttaggagagacagggcttcgctatgttggtcaggtttttctcgaactcctgacctcgtcatctgcccgctttggccttccaaagtgtggcctatttgtttatgttttgagacagggtcttgctctgtcacctaggctggagtggagtggtgtgatcatggctcactgcatccttgacctctgagactcaaacaatcctgccacttcagcctcaagtagctgggaccacaggcacatgccactaaactcagctaatttttttttttttcctgtagagatggggtctcactatgttgtccaggctggtcttgaactcctgggctcaagtgattctcctgcctcaacctcctgaaatgctgtacctagccactgctgcttttaattttcggtgttttgggggttttgtttctttttcttcagtgaatttcacagacatttttttttttgtagccacagtgagcaggataccatattacaggttactgtcctgtagatatgattgcatgagacaaaagtcccatttttaaaacatcatccagtatggtatcactcttcactcagccccataggaatacatattttattaattacatctaatatttatcatttgaaagggaaaaaaaatcccactatttccaactttattgctcagtctagccccgccccccggcaacctctcagcttgatcccatgcagctccatggccatgttgggaatttggcctgggaatcccagcatttatcaacctcctccatgcccacttcttaccaaagatgttcttcagtgctgggaccacttgtaccagttcacttttccccctttccacagctctgctaaagacagtcgtaaggttcacgtcagggttcctgcattgccccacttcccacttttaggggaatggttcatactgtaacatgtttcacttactgtgcagtgttccaacactatttcctggaaacaaacttatttgcataaatgtttggaaatctcttgtttctttggaggaattaatcagctttgaggtttactttaatgggtggatttattggattttactgccttttatagttattcgaaaccctcaccaaagacttatacttgaatatttttcgtgagatcaaagtcctttgtttcgggtggtaagctacattttcatctctagtgaggctttctccctacattcagtggacaacaattttaaatactgctgacttcttatcagaaattctggaaggcagtggaacaaggtctttaaaatggtgcactcctgcacccttcctcatctcagttaatggaattccatccttccaggtgctcagttatttcttagaatatttcctgattcttccctttttctcccataacttacatccattccaactgtaaaccttacctgcaatttccatctaaatcttcatccaaggtcttatgggcttagctttgctttataaatggcatagatcaggtttgagagcttgtttggagcaaacatttaaagaaatggtaaatctgattttgctgaaactattctaggctagagacaaacatagaaattaattagttttgtgaagtcagtgaagcattaatagaaagtaatagaatcccgagaacctgtatccattgcccgctgcctgaaggcaggtcccccattaggggattgtactccaggctgccttgggcctcatgatcccaatggcagctctagccagtgagtttaggcctgttttttgttttgttttgttttgcagcatttttgtgacagtagctggttgctgcagggagtttcaaatgttttttaatgtgctacatatagaaaaaaagagttgacttgtggttcttcaaagagccttctcaggatcagtgagcaggagttagagcagggtttctcaacctcaccactattgacacctggggccagatgattcttggttgggggctgacatgtgtgttatggggtgtttaacagcacccctggcctctgtccactagatgccagaagcacccctgtcccccagttgtgataacccaaaatgtctacagacattgacatattccctctatgggccaaatcatcccagctgaaaatcactactgagttaaaagaaggcagatttgggttcggtttgagaaggaactttctcatagtggccatttaatgaaatgaaattggaagtattttggaccatgtgggttatcttcattgtgtagaggacgggatcagacaacttctagcaaacctcccaatgctgactccacagtgatgagctaatttgaggagagtgtttcataattcttcagcattttctagggggactttaaacattaaaataatgtcttagagaaggttatttgattagcaatctatatctatattacagtaaatcaggccgcagaattctcttacattctttaaaacaaaaatgttaagttaaatccccattagagaaagtcattttcaaaagcattcattcagctctggggcccgactcccacttgtgccagctgactgggggatctctcaagagtctggagagtttctacggccaggatggatggaggagtgtctcctgcttcatggaaccctgaaacccctgacctttctactacttagaaaaagaagccaaaagcccattgatcttcacatcctgcctctgggcagctgcggctgagctttggccttgggaagtcctcctttgtctgtggctgccaccacccagcagcagcctttggcttgctctgacttagttagagataccctgcccgtgttaggggaagctaggtgatggcagtttctgtgctggcaggaagccagtattagacgcaattgctgtcttaggccattagctttgcaaggacagaaaaataggcatcgggaatgagggaaaggaacacgtgtgaaaatgaaggtgcttatgaatctgtgtgttagagcatttggggtatattcaggaagggtgaaggagccaaatagtaaatgttgtttctttttttttttttttttgagacggagtcttgctctgtcgcccaggctggaatgcagtggtgccatcttggctcactgcaacctctgcctcctgggttcgagcgattctcctgcctcagcctcccgagtagctgggactacaggtgtgtgccaccatgcctggctaattttttgtattttttaggagagatggggtttcaccatgtaggccaggatggtcttgatctcctgacctggtgatcttcctgccttggcctcccaggcgtgagccaccccgcccggctgtaaatgttgtttcttgaagataacactgaaacgttttgcttagaaataggttagaaatattcactaccaagatactttgacttagaagtttattagaagaggaagtccattatcgactagacagttacagtcgtcacaaactgatatacagtacttgttagaattattccgctttctgattaatgtattacaacatataaaaattatggaagctccttttattaatctgggttataaactaacgttgatattcttatggttaacttagggaagtttttttggcttaagaatattagaacaggctgggcattatggctcaagcctgtgattccagcactttgggaagctgaggtgggcagattgcctgaactcccaggagtttgagaccagcctgggcaacatgacaaaaccctgtctccacttaaaacagaaaaaaattagtcgggcctggtggtgcacacctgtagtcccagctactcaggaggctgaggtgggagaattacctgagccccaggaggtggaggctatagtgagccatgatcgcaccattgcactccagtctgggtgacagagttgagaacctgtctcagaaaagaaaaaaaagaatattagaacaaagcaaatttgggggttagatttactgaaggacttttagaattttatatttaggaacattaactgagaaaggtttagtaattaaaaggttgtactctagagatactattagcaaattttcattactagctggaatttgttccttttactaatgagaagggtttaaataggatgtatgtagctgtagccacgtgtgtgtggcagaatgatgcagatatccgggtctgtttctgttggacctcttaaccaactgcagagggaggaaagagtaaatcccggcattctaacatagcacgtcgtgatagtgaaggctgtgatgaccatcaaagccacccggaaacgagagctgactgcataaatgagccgagtatgaacatagcacggtattttaatacatgtccaagggatctcttctagatattgtgttaataaaatggtaaactgaaaggatggggaaaggttctatgagactgtgtttcatgtgttgtaatagtcccagtggctagaaagtgcctggcccatgctggccactgcagacatacttgttatgtgggttgatgaaagaggggaggaagaaaataaatgtaagagtaatacaaagtcagaggaagaaataatctacaagaatgaagagaaatgcatttttgtttttattttttatttatttttttgagacagggtctagctctgtcacccaggctggagtgcagtggtgtgatgatggctcgtgtagcctcaacctccctggcctcaggtaatcctcccacgtcagcctcctgagtagctgaaactacagctgcacactgccacgcctggctaatttttgtatttgttgtagagacagggttttcttatgttgcctaagctggtttcgaactcctgggctcaagtggtccacccacctcagcctcccaggtgctgggattataggagtaagccactgtgcctggccaggaatgcatttttaagacatagtcaagtacccaggagacttggatataaatggtcattgctggctgctgtctcactttctcacctgatagtacaactcactgagaactctggcttatttgtctttgaatctgtagaccatagcacacggtagctaccacatattaaaaagatatggattgccaagcactgtttttccttgtaacagccctatgtggtattatccccattttaaaaataaaggaaatggaagctcagagagtttaaatagcttgtccaaagccacgcagtggagctgggattctaactcagaaccatctgactctaaagataatatatataatcttcaggccaggctgtctaggtgctcagtagattgtgttgaatgtaaaaaaaaaaaaaaaggaggagggtaggtgttaggaaataatttacggaggagaggtggcatttgaactggattgtaaataaaagtaagattcggatgtggtgaaatggagaggggtggtgctgaggggcagagtcttcagacaaaagggataatctatttaaaaagaaaaaagaaaaccagaggtatagacagagtgaagaagagttctggttttcttccataggatgcagttgaagatagtagagaacatggtgtcaaggtaattggggtgtagattgtagaggtccttgaatgctagtctgaggtgtatggacttgactttggaggcaaagtcaatccatcagacttcttagtaagaaggaccaagaaatatggacctagaatttggaagaaagtcagggctaatgatgtcttgaggatgcttgcctaaaactcacagtaatgctcttttggacaagaggagactgaaactcctgtaaatgagagaatttttgttgttttgtttttgttttgttttgtttttgagatggagtcttgctctgtcacccaggctggagtgcagtggcactatctcggctcactgcaagctccgcctcccaggttcacgccattctcctgcctcagcctcccgagcagctgggactacaggtgccctccaccacgcccggctaattttttgtatttttagtacagacggggttttaccgtgttagccaggatggtctcgatctcctgacctcgtgatactcctgcctcggcctcccaaagtgctgggattacaggtgtgagccatcgcgcccagcccctgagagcatttttaaatgaactgtaggccttgactataggagcataattgtgtctcagtgtccctggtaaacacttctttccccactcagtattggtcgcaaagaaagaacatccaattggaaaaggcaatcgggttttattccctggccagaaaacggagaaggtgagctcttgtgctaaatgtactttctccccaagcagtagaaggcatagggggactaggtgtggggcgggaaaggaatgtgagcatgtatgggatgggactccagacgtgaaggtgctatccatgaacatatgccttcatatattatatgtgcatgaaatggcagggattttctttcaggggagggagttttagcattgtaaagatatgctgatgatctaaatgcaaataggagtcacctattccagtttgtgctggttttgcgaggtcttcctctggtatctggtcaggggtcaagaagctctggtgccatctcgagccatctggtttctttaagcagctgtgcctattgataaaggaactaaagaaaaacagttaaaaaaaaacaaaaacaagaactaaggacctttcccggttatttcatcagggctgccctggtaacatcaatattcagaaagaatggcaaacataagctgccaaacagatgacaccttaatggtgtcattgctttctcttgacatttgattgtcatctagattctgaaaaacccttagaaaatgaacaccttatgatttctttaaaaaatcagtgtttccatttgtgtcagtttctgtcttgatcttttctgacacaaaaactttaaaacttaaactgcactcctgggcatcttcagcggtctcagctccccgccgtcaccaagcatctctctccagggaggcctccttttccggggtcatcaccggggttaaaatacatcactttagcttcatctgccatagcgtcaaaactttggaaactgtttctcttctaatttagttaaaatatctaccaccgtttactgaaataattacacgtttacaccagatataacagctttctttcatcacaacagttacgtcttttagttttgcatgttttagaattcatatcaatgaaataatacgcattttttcacgatacggttttcttttctacataacattagattcttgagataatttatatcgtagaccatatagtattccattgtgtgaatagagcaggatttatttatccattctggtaatgatggacatatttcattattacagacagtgctgacttaaacttatatatgctccttgtgcagatgtgtacgtttctctagagcaatggctctgaaacttgaccgtgcctcagaatcacctggagggctgtttaaacacggattgctgggctcccaccccattgtttctgattcaggaagtgcggggtgggtccccataatttggagttctaacaagttcccaggtgcagtgatctattaatttcagaactaattgcttcagagtctagctctagctgcagaattgctggagtgaaatagagaatgcaaattcctctttaatttgtaatgctagactgttttcctatcagcagtatgaaagagagttgtcagacttgaatttttgccagtctggtgggtgttaatgatttcttattatgtggctgaaagaggaaatctagatgcctttttattttccatgttaacctttgcagaatatatagggcttgcccactttaaataaagactgttaaccagtacacaagatacacagacaacatacacacagaggtagtgttccccagaaaaaacctggtggtgctgatcaaattcagtgccagttgcctaagaagcattgtagataattactgtgattttaaatatttttcttttctttcttcttcttcttttttttttttgctctgttgccgaggctggagtacagtggcatgatctcagctcactgcaacttccgcctcccgggttcaagtaattctcctgcctgagcctcccgaatagttgggattacaggcatgtgcctcccgaatagttgggattacaggcatgtgccaccatgcctggctaatttttgtatttttagtagagctggggtttcaccatgttggccagctggtctcaaactcctgactcaagtgatctgcctgcctcggcctcccaaagtgctgggattacaggcatgagccagagcgcctggccatgattttaatatttttccattgctctttttcaaaaggatccgaggaaaaattccactttagtgaggagccttgtttaaacagaagatactccttttcattgaagtctctctttactcgtgcagaaggctcactgggaaaaagctggctggacatcacagtaattttattgtattcctcagggaagctgcctgaaagccagatcttaggcgaccttttattgaacaggtttacattctagacaagaagctgtggcagtcagtcccctgttccgcagtgttgctttttgagtgtgtcaaggccctgtttctgtcaggtggtgttaaactctcttgctgaggtgtggtggacaccccgagagcccgtgcacagtgccagggtcctcagtggttctgatacctgtaggagtgacactaatggtcggctctctttcagctttcatgacgctggtcattatcttgctgcatgtattctggggcattgtattttttgatggctgtgagaagaaaaagtggggcatcctccttatcgttctcctgacccacctgctggtgtcagcccaggtgagtgttgccgccatgctcagactgtattctggaactcaagtctatgtatctaaaatggtaaattctactctagatgaaatacacgctcatgagaacatgaggaaattcagaaaagctatttaagtgaatgaatgagtcatgtaagtcttaccacaaaaagaccaccactattaattttttggtgtgtcttattgaaatatttttttccctgctgtttatttgcagtgatttgtctctctctaacctaggtcagtttggaaaactgttcattctctgtgacagctgcgtggaaaagttgcgtattccagactcggcaccatgactggaccttattcctagctctcgtataacacatgtgtccttggctagcatattttatttaatatagtttttatctctctctctctgtttctaattagagtatgataatcaaggatggggccttatcttcaatcttcgtatcctcaattcatggcacatagtaggtggccagtaaatgttggtgtatattgaatagttgatactattctttttaatgattaaaaggaaagaacctaggaagtttgaaaagtatataccaaaatgttcatagtagttctctgtcagtggcagatttcagagaatgattacataattgttttattaaaataacacacctacagaaaagcacacaaatcagaaatgtacatcttgatgaattttcacagtgtgaacacacctgtgtaactagcacctagatgaaaatcaaaacattctcagcccccaggagcctccctgttcgaccagtcactgcccccactgagggtgaccatgacgctggcttcaacaccacagcttggtgctgccttttggtatttctgtcaacagagtcacacaacgtttgctcttgtgtctggctcctattgctcagcatgtttgtgggattcatcttcacatcactatagatggctcactcattgctgtatagtattctaccatgtgtctataccataatttacccatttgacagcagagaggcattgatgttgtttctagtttgagatggagtcttgccctgttgcccaggctggagtgcggtggcacgatcacggctcattgcagcctcgacctcctgggctcaagtgattctcccaccacacccttccaagtagctgggactatgggcatgcgccgtcatgcctggctaacttttaaatttttttgtagagatgagctctatgttgctccggctggcttcgaactcctgggctcaagcgatcctcctctctcagcccctcaaagtgttgggattacaggcatgagccaccacccctggctttctcattcttatctattgtgaatggtactgctgtgaacgttctaatgtatatctcttggtgaacacacacacacacacacaacacacacacacacacacacacacacacacacacttcttttgggtatacgcctaggagtgggactgctgggtcatggggtgtacatgtgtcgactgttcataccactcaattttcagagtgatggtatcaccttacactctgccatcagtttacaagttgtggttcgtccacctcctcactgcattctctttattgttagtcgtcctgctggctatgtcatggtatcataaatacataaattgataaattatagtaaaagttttcatttacgtttccctgatgattaataggttgagccccatgttgtgtggctccgttgacagaaataccaaaaggcagcaccaggctgtggtgttgaagccagcgtcatggtcaccctcagtgggggcagggactggtggaacagggaggctcctgggggctgagaatgttttgattttcatctaggtgctagttacacaggtgtgttcatgctgggaaaataaggttgagcaagtcttcagatgtttattggccattcggataattctttttgaagtgcctgttcaaatcttatgcctattttctttttgatttttaggagttctttatgttttctgtaaaagaaaaaatcttttgtcagatgtatgtattgcagataacttctgtggcatggtttgtctttacattctcttaatgtctttcggtgaacaaaagttcttaattttatatagtctgatcagtttttctctttatggtttcactttttgagctttttaataaatattaacctagctgaattttaagttttaaaatttgttctatttttctcatttttgggttgtaattttctacaacaatcatgtattgcttttgtaattgtttaaaagaggaaaaatgttttttaaagaagagaagaacaatacaaaacagtgcagcactctgtaaaatgagttaaaattcagtggatttgaggtatagaattattgtgaagaataatctagaaaatgctcaatgcctgccatgcccacggaggcctcttgagaagagcagtctttctgcataaggtgctacctgtaaaatctaccactttcttcaggccttctttgacagccctaaggagatcaccttgtttttacccatcctagcctcatcgcaattataattatgctgtcctagcattcatcacaatttgtgactaattgtttcttcattcattacctgcctcccttactagtacagaacctccattaggatagaaactttggtctcaccaaggtgtacacagtacctctcagcattccattagtgttctttaaatgaatacacttttggaacccacagcaattgtgcaactgaaaaagactattccctcatgttcccttgagtactaaggattcatactaaagtaatttggagttgtctcactttcttgcaaattctaagaaccaatttaacacagaaatgaatagaaactagttacacgacatgcatcttgtattgtatattccattaggttctgcctaatgactgccttctagggttaccatctgaatacagcaaaacacgggacccacagtatctgctgaccagcttagttctacatgcctcagggccttaacgcatgacacacatcatacgtttggtgaaacacacccaagttcttgaaagtattccatgcttccctttatctttggttattccacatgtttaataagcttgctgttattacccaagctgatttatttttcttttgcagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcacttggctttcacacaactgctctccgaaaggggtgctcagtggtgtgcgtcctggctgcacgagaatcacctgggacagtgtaaagccgactgattctgggctccaccttccagagctaattggcctgggcacgtggtgagttttaaaagcttcccaggtgattctgatgtgcagccatgttgagacccactggtttggtatccaaataggagcttcctgagaacaccttaagtggatgagaatctggtctttagctgtctcctaactcaactcgtgctgagcaagtaagtatctgaatgtcaaatcctggttatcttttatcttcctaagttctgaagtcacaaaaggctaaagggctatcacccctgctcactgtttgcgtgtacttcaccatcttaggagaacacggtaggttgggcttctaaatgcaataataaattacgctgactgtggtaacttagccaaagtaagatactgattaagccgtatttttctgaagtgcttccattccaggttttgctttctgaggcattacattgtttttgagtatagattacattttattaactaaaaatgattgttttgtgacttccttgggaaggtattttaaaatcaggaatttttatgcaatgtctataagcctgtttaaagctttccatgggctctgccccaaggccgttggctgcagcgttcaccatctgagtgccagttgctggactagttgaggtgaagtgcattgttttctctctgagcagctgtgcggggagctgagtgatgtgccctgggacaggcttcactggagctggtggaagtataaccagaagcacaaggaaatgagccaaaagggtgtcattgacacttttcatttgctcctgtgatactaacaacactttcacccaaatggcttaatgtaatattggaaatagatcttaaactgccaaatctcacactattgcataatccatatgctctttagatctagtcagtgtctctgggttttggtagcagatacagcgttccctttacaggaatacccaaggtgttctttcagcttccagacaggtcctttgatttcctttataaagggaaaattctggcaaatcgtgcctttactattagaaattgttcccagttgatgtcttttggggagctggtggcatgaaatgcaaatgacctatacattaaagtgatgtctcagtgaataccatacatgcagtagaacattcagaagagaggagcagcaatcctgaggggctgggggagtgacagtggcaggacggatgggcgggtttgacagattgtggtgggaagaagaatgatcatgtttaaagctaacatagccagtgttttgggctagccacacatcattccagagaccaaaaccttactcatgaactagacctttatcgatatcagtgaacccccatgtttaaaatattagaatgtttagagataaaatagagataatagagataaaagaagaggagggcttctatcaatgctgtaaacagtctgataagcgactgtggttattcccctaaagtttacttcagcactaacactagtgcttccgctggagtttgcagttttccagctttatacaggattttcctttgactggaagagtcaaggatatagagactcaacagtgacatttattgtacaacatcaaggggaataggatactcatcaaactgggattattcttatcaaaacatggtcttctttgaataagaaaaatacatagttggttattatggacttaaaactgtgttaaatggatattctgataaaatatttgctgctctgtagagtgtggaaagtctgagaatattagctttactcatcttgagctttgaggatgttctctgtacgccgatggtttcatattaactaaaaaagctgggtattgtaaaatctcatttataaaaactcagatgagaagaaaattttctttgatggtgagactgttgtcttagttcaggaaattatttaataatcctttgttacctgtgaatgaaggaactttgtaattctgatttatcgtaaaacatgagcctttccagagtcagcttagacactgttgtcgcaaatagccatgctttgccttatgccaaggaggcccagagggagggcctagtcttcctctgttgctgtacatatattgaaatgcttttttttttttattttgcatttgttatctataatgagctttctgagccctgatattatgtgagacaaacaggagttattgatgttatacactcccttccattcaggattttctgcttggagggaaatatgttgaccttagagaattgtgaatattgttgcaattcttgaatatattaccatgtgaataatagagactgtgttgctctctagtataagctatatttatttttgattcatttgaattactagttataactggagaaattttgttacctctatcctggcttgcctgactggctgtataatagcagcagcctcttttagagcatcttaatgaaaacatggatgaaaggaattaatgatgatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactcctca

SEQ ID NO: 569 - DNA, 83578 bp, Homo sapiens
gcgacgctccgtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatgtgagtcggagggttggactaggccggatccggcgttagggcgggggcccgcaggcggcccgcgcgggcgggaaccggggcggcagtcagcgggcgcgagctcagggcgcctccggggtcctcactgcgctccccacgcgctgtgaccccatttgttgcacgtgcatgttcaggtcgagagagggatgcgacgtgttcggggagcagcccaccttgtgggtggccaatccgggacgggaatcttaaacttttaactcttggtgcaaagactgatccactggcggctttacgggagcgggaaaaaagtatgtgaagcttgccacggtctcgagaccgaggtcacacgttagcagcctgccggctacatttggaccatagacgcagagtgtttgcccccaaaactggaggacctccagaatgagattcttggcgtgcaccaggccttttcgctcattcagccggcgttcctacccaggcactgcatcgaccctacacttgaggacagcttttgggtcaggggaattggtgcctggagtgagactgctctctgctttcaaggctccagctgtatccctacattgctcaggcaattcctctctctaggtctcagcttcttcatctgcaagatgaaaggtctgtcctccatggtagcccaacatacttccgagtgttattatcagtcccctccccggggactgccagagccagggcaggttggtcccaacaggcagccccttgcagcagagagagcctgggctctggtctcagacggacatgaattaggaacccagcttgtttatctcctttacttcctggctctgtgatcctgagcaaatcactttgtaatgcttaacgttgtttttactaaccttgttttttaatgccttaccttgtttttactaaccttgcttttagactctttttttccccttaatcacctagccttgtttccacatgaattagctctcccttagttgagaaagccggatgaactccatctggttccctcatttacaagacatcaaggactccttacccacccctttcctcaaggagttaacttgtgtaagcagaatctcaacatatcaaagagtccaattaactgataaggtactgaaacaagcaatgtacgaagttcccaggattttgctcaaaagataacaccataaaaccttgagttggtgtcgggcagagcacccatatctaacattttatgaaagatttagagcccctgcacctggaactgttgtttctctgtaaccatttgtcttttaattgtttctctgtgactctttgtccttttaatttttgcatgtttttacttatgtagaattgttgcatctgagctcccctccccttcctaaaccaaagtataaaggaaaatcaagccccttcctcgggccaagagaatttattagccgtctcttgggcactggctaaataaaggactcttaatttcgtctcaaactgtggcgtttctctaactcgctcgggtacaacaactttacctcttcaacgtaagtttccttacctgccaaatagcgaggtgattgtaagaatgaaaaaaagtcatatgtattgagtgcttggcacatacatgtgttccttacattattgtctctgtttaagcacagcataaatgcccccgatgtgcctagtctagcaatcttaggacaatccctgtgtctgtctgttgtgttcctggtgatggctggcccacagctgggtgcacgcagtccagaattttttatgtttttgtttttttgagacagagtctcactgtcacccaggctgagtgcagtggcgctatcatggctcgctacagccgtgacctcctgggctcaagcaatcctcctgcctcagcctcctgagtagctgggactacaggcgcaccaccactcctggctaatttttgattttttatagagatgagtctcatgatgtggctggtctccaactcccggcctcaagtgatcctcctgcctcagccacccaaagtgttgggattacaggcatgagccactgtgtctggctaaggtttatttgttttgttttgttgtgttttgagatggagtcttgcactgtcgcctaggctggagtgcagtgggacaatcttggttcactgcaacctccacctcctgggttcaagtgactctcctgcctcagcctcccaaggagctgggattacagacgcccaccagcacgcctggctaattttttgtatttttagtggagacaggggtttcactatgttggcgcagctggtctcgaactcctgacctcgtgatctgcccaccttggcctcccaaagtgctgggattacaggcgtgagccacggcaaatttaaaaggatgatttgcagcactagtggcagatcattttaaaaaatgctggtgcctgggccctactaagttttttgattgaattagtttggagtggggctcagacacggttttgtttgtttgtttgttttaaagttccaccagttgatttcactgtgcagccaaggggtggtgaccactcgttaaagggatgaggccaagctggtgagggttcctgggatttgcagtggctcactttcctcccattcctgttctcagatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggaggtaattgtgcggtaactgccgattggatggaagtggggaccacttgctggtcaggggatgaggccttaaggatttagggagcgtaggatttgccaggcagtatgaattacctgcatggtgatgtttttccagctggaaatggaaaaaaagatcatcagtgcagccatacattggcattgaaaaagataaaatgatgcagaagcatatgatagaatttggaagcctggttgtaaccccatatccccagagacagccacagttaacagtctggcacatatccttccatgctgtttcccactggtatttgtgcttaaatatacacacacaaagctacttttatagaaatacgtgtaaaaacatggaggccaaaagcataggctttgaagtcagacctagatggaaatcctgaccgtgtctcttgctgaatgtatgagctttggtttcctcatcaatcaagtggggctacagcagacctatgctgtaggatttatgtgatggataatatatacattatttatacatttatacattttctttttgcaaaaaacaagattttctcttacacatactattctgtgacctgctgtctctgctttggctggggacacattcctgtgtcgtcatgacacatctacctcagcctcttttaccgacacagcagagcagagcacgttccctgtggctgtagcatgattgattcaggcaggccccctctcacccagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactggtaactccccagagggcttcaggaggctgtggagcaggagtgttcccagcctgagtgtgtcgcacatgtagggtcattcctgggtgctcaggtctgatgagatgccagttaactccagagccagcaggaaaagagcttaggtccttgtgcagggactgggttttggatcagttagctgtagtctctttagccccttcaatcattacatctgagtgcttttcctttcttccagttctgtgggtccacagagatctgggactagtctgttttaccttccaaagtagttatgtgaaacagtgagccctaatctgtgcttttcagcctgctgtattattttgagaccccctagataggacctctgtgtagcatcagattttggcccccttttgtcatcattgcaagagtcacttggtagtgccatgtggttctcagagctgtgcatgtgaagcatgagggtttgaacagtggttgcagtgacggtgtgaagggaggcactcatagcctgagctgacttccactgtgtgtcatccaaaatgtgaatggatttgaaaaatgacatcaggctttccattttgtgttttcttgatagattgctgaacaacttttgtacgaacactggaaaaagaacaacccgaaacttcgagaggtgaaaatcagagatctccattgatttatctaagtagatgaaatcatgtttccagacacttttttttttgaacacgtatcttgtaccgggttgaaacagaggagggaaccttgagccacctgaaaagagcgccaggcagaagatctggcacaggctgcgctgagcggctcattcggttgttgaacaaatgttgattgaacctccgctgcctggtctgccaggtgcgggcatggagattagacatggtttctgctcattagcttgtgtccagcatgggagctcattacagggcaggatgcagggtgctgggccagcctgagaggatgagcatgggccagcgcactcaactctggaggggttggggaggcttcccagaggagttcctggggtggaagagtttgaagggatgtatgtgtgtagaggtgaggaaaggatgttctaggttgatgtgactgtgagaaccaggcttgagactcgagaacagagcgagccctgggagctgaaagtgtctgggtgaggctaggatgtcagatagtgagggagaaccccaagaaatgacgctggcgaggcagagggtgccagacatcggaagagcttgtgtgaccttcctccaaaggggctgggggcagcatacaggatcccagctgcatttcagagagactcctctggtagcaatgtgcccgccgacagggaggggtgctgcgacagcccagccgggggttggtgaaggcctgaactgggctggcaggggagggggtggcctcttggcttggtggccttgttcagtggagatttggctgcagggagatcatccctcactgttattcatttattttcaacttacagtttttgtatacatttggtgccttcgtgttattcgtagttacatttagaaatcgccaggcactaaataatggaacatctggtgcttttgtgcagtttgcactaatctgtgggaggactccttagccctgttggcttcggtggaatcatccagagccgttaaatcagaaaagtttattcagaacattcaagttaattgcctatgttcacagctgtaagttgggaaagattattttaaaacttttttatagagacagggtctccctgtgttgctcaggctggtctcaaacctgggctcaagtgatcctcccacctcagcctcccgagtagctgagactacaggtgggcgccaccatatccagctaattttataaacagtttcccaaacaaaagatttggattgaatgttgtgatccattttctaatccaggagattgtctgcgctcaaatctcttactaacaatgctaaacttgttgcacctactggtgcatcacttgatacagggagtacgtagtccatctgctttgcagaggaaacttcggggagccaggcacagggttgagtcttctcactcagctgtctcccagggcctggcatgcagtacatcaacccaaggtggcctttgaaattgtatttccatttcagcgtccagcccaaccctagggctagtgggagggaagtctctgttactttgtaccagctcaaaagattggtgtaggagtgcctggtcctttggtcttctgattgacatgcattcacactatacatgttgaagtcaccccacgctctctactagacgcctgtgccactgagtccccatgaagcgaagtcatggccacgttcccgcaggtggcacagagggcaggagcacactgtccccacagtgcccatctgtctggtgaggaaattcacatcgtcccccttccatcctcagatggagctggaccttcaccagaagcatgtcgtaaactcttgggaaatgcagaaagaagaaaaaaaacaggtgtggtatgtggctctgggaatagccgcgtattctgctgtgcgagactgttcacgtctttgcattcgtttaccgttttcagcatcagtgactccagttaaggagtgtagtgtactcttttcttagtttacttgacacatgtgaaaactgaatgtttgctcttacatataccagaatcctatgtgataattcccagggcagaataaggccaggtgaccagggctgggaggtggcacatacagcacgcgtcttctttttttcttttggaggcagggtcttgctctgtcacccaggctggtgtgcagtggcgcgactcacagctcactgcagcctcgactggctgggctcaagcagtcctcctaactcagcctcccgagtagctaggaccacaggtacgcaccactgcgcccagctaattttttaatttttgtagagatggggtcttgctctgttgctcaggctggtctggcctcctggccttaaacgattctcccacctcggcctcccaaagtgctgggattacaggcgtgggccacagggtccagctaggacgtgtgtctttaagggcatttttgtctctcttttgatgaaatctgcatcgtaaactcgcagccctggcttactgtaacccctttggggttaagcttccacacctctgtgcactggtcgctttgctgcctggttcattttagaaagtgttttgttgagtggggaggaaacccaacattattgagtccctccctgacttggcgtctgagggcgttgtcatttgggattcaggcaggaactgcctgggccctgtggcctgcagaacggcggcaggaagctaggtttttgttggcttacggtacagatattgacctgtgttcatttggtcccttgtagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggtgggcacaagcccctctcagccgtgacctcctccacagctgctcgttagcatgagatgggcacttgagaggctgccctaagaagaggccatagcagggctgagattctgcaaagggcggcagcagccgggttctccctctcacatgcatccccatctgccttgtgctttcccatcctcctcgtttgcgtgcctgaattccagaacattaacgacatggagccagtagctgttctcttagaggtggttagcggcctgctgttggagaaccttcttagaatctggattttccagtgcactgagtagacacaatttaatcgggtggtctagcacccagctctccgtggggagcaggtttcgggtctcgaggcataactgagggtttttggtccaggggctgtttttggagaacatggcacagtttccttgaaagagatctttctatttagaagagggaggcccatgctcctgtgacctcacttccccttgcccaggccgtgatttagcaactacattcttagtgcctactgcttattctaggtgctgagcactgggttgggaactagagatagagcctgaccaaggcccacagtcctgacctcctggtgggggctgtgtcaggtggaggacagttgttaagttacagtaagagtggaccagtacaggatcctgtgggagtttagagttcagggctcagaaaggcccttgcaggaaatggctcagaggggattggatgagtaagtgagtggtgggaggggatcgtgaccacctgcatggccaggcctctgttggtgtagtgtctgcgaaaaatggagatggagaatgaaggaagatctgattcccacgatctcagatctcagtcgagcttactctcatcatcaccacaggcgaccaaactaaagaaggagcaggagaatctgttgaagcagcggtgggagctagagaggctggaggaagagcgaaagcagatggaagccttccggcagaaggcagagctggggtgtgtgtcagaagggccccccactcttcccaggcgggtgggcctcttgctttttcagacttgcattcgtgttgctgaaaccataaaggagacagcctggtcagcagttatctaacttctatttaattctttctgagatactgaaggcagcccacatttgattctccttcaggcgtttcttgagacatcagtataacgctcaactcagcagacgcacacagcagatccaagaggagctggtaagtctgaagagacagcctgacatctttcttagcctcttttgtaaaaaaggccttccattgcttagtatatgagtgcattctcgtaagaatgaagacagtgaggggttgggggaaaggggagatgttggtcaaaggatacatccctcggttgggagatctgggagtagtgtccatcatgttgatcacagctgatgataccatattgtattcttgaaatttgctaagagagccaatcttaagtgttgtcaccatgaaaaccaactgtgaggtgatggatatgttaattagcttgaccgtaaggatcctttcccagtgtctgtgtgtatacatagatggatagatacaggtatcaaaacatcaaattatttttcagtaactgtgttacttaaaaagcagcacaacacaaagtgagatcacccccttgaccagcacctgcaatctctgtctatccccagaggtgcctgtttagttcacatctttctagatgtatttacatacagagaggtggaggtttttgtttttgtatttaaatctaattgaggttgcattcctcagcatcttcaattaacactaaatctcttaatttttaaaaagatcggccaggtgcggtggctcccgcctataatcccagcactttgagaggccaaggcaggcggatcacctgaggtcaggagtttgaggccagcctgaatgacatggtgaaaccccatctctactaaaaatacaaaaactagccggacatggccgggcgtggcggctcacacctgtaatcccagcactttgggaggctgaggcgggcggatcacctgtggtcaggagtttgagaccagcctggccaatgtggtataaccctgtctctactaaaaaatacaaaaattagccgggtgtggtggcaggcgccttaatcccagctacttgggaggcagagacagaagaatcatttgaacctggtaggtggaggttgcaataagctgagatcaagccgttgcactcaagcctgggggacaagagcgagacttctctcaaaacaagaacaacaacaacaaaaactagccaggcatggtggtgcacacctgtaatcccagatactcggggggctgagacaggagaattgcttgaacccaggaggtggaggttgcagtgagccgagattgcaccactgcactcaagcctgggcaacagagtgagactctgtctcaaaaaaacaaaaaaaggtcattatgcttagattgaacctgttcttttcagatagctcctttgtattcctaagtactttgatgagctcccttgaagtgagggagacagacctaagctgcccttcccatccctgcccactgcggtcagggcaggacatggggcacagtggcatggttggtcctggtgtgcagctgttttttatggggtcttgctctgttgtccaggctggattgcaatggcgcaatcacggctcactgcagcctcaacctgccaggctcaagccatcctcccacctcagcctctcgagtagctgggaccataggtgtacatcacaatgctttgtagagatggggtcttgctacattgcccaggctggtcttgaactcctaggcccaagtgatcctcccacctcagcctcccaaagtgctgggattgcatgcattagccccagtgcccagcctcctgcattattttaatgcttccattatgttgatgtacatagtagctaattccccaccaaggagcattttggttgtttctggtttttccctcttacctaaaagctgcaacgagtgttttgcacttttgtgtcactgtggtctttgttcttataagtgggatttttgccaagttgtattccaaaaagttgtgcaaccaggtgtatccgagggcatgtggtggtggctgggtctccctttagccagagagaagctcctaggcctgtgcagtgtctgaaccacccctcgtgattatccccagtctgttccagaaataatccaggatcttcccatctctgtcttgagaacactgtgtagaatcacgaatgtctatgtagaaaggaaagggagggcaggcccctctgtaggctctcattgcagaaggactctgtccagcccagccacgtgccgccctctgcttcctctaggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgaggtgagtggcagctgctgactgggctggatgctcctggcctcaactctgataccttgaaatgccccatgggtcacctgttactgaaatatctattggctgggcgtggaggctcacacctgtaatcctagcactttgagaggccgaggcaggtggatcgcttgagcctaggaatttgagatcagcctgggcaacatggcaaaactccaggctctaccaaaaatacacaaattggccaggcgtggttgttcatacctgtagttccaactactcgggaggctaagtgggaggatcacttgagcccaggaggttggggctccgattagccatgactacaccactgcactccagcctgggtgacagaacgagactctgtctcaaaaaaaaaaaaaaaaaaaaaagaagaagaagagatagctgtgtatgttgtccatcattcctgaggagcacatcttcataatggacctggcctctgggggtgtttcccttgtattatctgaggtggaaatcattaaggtttagagtaacgatgtgttcatctgaaatcttagaggtttagaaggaaattatttttttttttttgagatagagtcttgctctgtcacccaggctggagtgcagtggcatgatctcggctgactgcaatctctgcctcctgggttcaagtaattctctgcctcagcctcccgagtagctgggattacaggcgcccgccaccacacccggctactttttgtatttttagtagagatggggtttcaccatcttggccaggctggtcttgaactcctgaccttgtgatccgccagcgttggcctcccaaagtgctgggattacaggcgtgagccactatgcccagccagaaggaagttattatagagatgttgaatgctgcttacatctataaaactgagtttgggtcctaaagactaaactagtagattgaaatcatcaaataataagtagcatacattgagcacttactgcatgctggacactgtgccgggtgctttacaggcctcatcttactgagtcctgacatccagccaagtggtggcttgtgagacccggagacttgaagaggtcactccgtccagggtgagctatcagtgacacaggcatgcggtggcagggttcaggcacaggcagcgccctcctctccatgttctgatggtttcattcatctctgtgttaaacagccacggtgtaagtcatcccaattcctttttataaggagatggggtattaaaagggtaacttaaaatacttccaacagggccaggcacggtggctcacgcttgtaatcccagcactttgggaggccaaagcaggtagatcacttgagatcaggagttcaagaccagcctgaccaacatggtgaaaccctgtctctactaaaaatacagtaattggccagacatggtggcacatgcctgtaatcccagctactcaggagactgaggtactagaatcgattgaacctgggaggtggaggttgcagtgagccgagatcgcaccactgcactctagcctgggcaacagagcgagacccatctcaaaaataaaaaaaatgaaaaacttccaacagtactttccgtggatgctgtccttaattgtaatcttttcaaagtgcatgtggatgtttatctgcagtgtggtcctgcagaagccatgtgccctgcagccctgtctgttccgtagctcgcttcctgccagggcggggaggagcctgctgtcatcccttttgtgtttgcccagggaggaggccaaggagatgtgggaaaagagagaggcagagtgggcccgagagcgcagcgcacgggacagactgatgagcgaggtaatcccagctgcggcgatgtggaccggctgttgggtcttgggcaggtgtctggaagtccatggtcagtcaccctgccagatgctctgggaacagagtcttctctggtcattttaagtgggctttaaaaatcattgaaaaagtaatatgagcttagtagaaaagaattcagaagtacaggaagtagaaatggaaaaaagtcccccagagcccatcctgtatgcagccgtagctgctgcttctgtctgctcttctgtttctatgcctgacattttttctacatgtatttcttactgtcttgtgctatttggcttcaagcgttgtgacatgctgttacatctttataaacggcatgtcaggggctgtatcacggactgtcctctgtcacccgctgcctttccattccctcttatgggtgtgctgtgttgttctaattggaagccattctgagaaacgctgcagagagcctcttggtgcctgaggctcttcccacacgtttcccccctcggggtagatgacagccgtgacctggaggacataactgctttcctggtcagtgtgtacactgtgcgtggaagatataccccaaccgcagagaaatctgggaggagaagagagagtgttacccatgggctgaaagctgttgtaaagtggtttcaaatgagaaactctacgttgtgtctggtagtatgctgtattttggaatccacaggaaattgggtcgtgattggtgatgttttgctcttgtaaataccaagaattctccagtgccttttgattttcctcatttaaatttccctcctgatggcggccactttctgttccccccagccctgcagcctaactgttgagagtgtcaggtggttttctgctcctgactgtggcctgggctggagttcagatgtcacacggctctggggccaggtctcaaacacagcaggttcaaaaggttagaggaccaccccagctccacctctggtcatctgtgtggcttgtggctctcttgtttttggaacccgctgataggaaggagactcaccttgttgctccaaggtttctctggccccggggagacagctccatccccatctcctttgatttctttggcactcagctgtctctccatagtacacagtctggatacattttgtgtgtcttgggttgcgagggaaacatttcttgtatactggcaagcgtggccgacatcgtgagagcaaatcctgtcatctggctctgcctctgcgtacctgggcctgaggcccaaggatgaggctgggccttgctgtggctgcagcctgtccaaggcttgtagaaccaggatctgttagggtcaacctcaaagctgcccttttctttctgctgaggttaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggtagggctgagcccaagggcgggaggcaccgggcctgccaggttctctgcatcatcatgggacagggttcagagccgctggactgcctggcagggcttgcgcacgtttgagagcacggtgctcccgtttccatcccagctgcagtcctcatcctcttgactgtggcttctttccctccacatcctccatgtcgtgtgggtgaggccggtactgctgtctgttctctttactctgtctgcttctgcaagcagttggcttaccgggggccatagatctctcttcatttcagtccctgatacataagacagaacagtcctccaaacacctggccacaggccgagcttttcacgaggtacacgccacgcatatgtatagcctctccagctttccatgaggtacacgccacgcatacagcctctccagctttctacgaggtacatgccatgcatacagcctctccagctttctaccaggtacacacaatgcatacagcctctccagctttccacgaggtacacgccacgcatacagcctctccagctttccacgaggtaagcgccacgcatacagcctctccagctttctatgaggtacacaccatgcatacagcctttcaagtcccgcatgctcccttccgttccttggcacgtgcattgctgttgctcagctggattctccagtctgggtagggccgcaggcttaccttcctcatcagaggcagggctctgccctgtgggccttgtcttggggtggtgactttgctcttggcactcaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaaggtaggaagtctgccaggatataggccaacaccggcaagacagactctgcccggcccctgctcccctgggcctgctcatcgccccgcgccggggtctgctctccggccgtccgggttattccttgtttctcttctcttgtatttctctcttccctgaccagcagggagccctgacacaggggctgttccagtccttggttgggcctcaaaccttgaagtgattttgctctggccttgcctactaagctgcatgcctgtccaccctctttggtcaatctaagaagagctgtggccacagctgctgagaggggtcagagcagtagatctaggcctcaactgttgagacagtgaagcccgatgaacaagagaccagtcctcctcctcacctcccctccctccctcctgtgggtgtcctcttcctcccctccctcccgtgtgtgtatctgtttctctgcctctcagtgtctttgttcccggacctgtctgcacagcaccatggggagcacagagaagcaaatgctgccttccctgccctgaggaagctgatgactgaagcacctccactgctggcttgtcccctctgccctcctttacctagggccaccctggccacccggtgcctagagtgcattccccaggacacatgctgcagaatgagggctggctcccttgtggtcagatgacactgggaaactgagtgaaacataattagagcaggtgctgcgtttgccataggccactcgccctcaaacactgactgtcacagtcacagggaacagcatttcctaaacccacttggccgtggatcagtgagagtgtcagggtcagggtttcacagatcatatgtgaaagtgtttcttagggctagtactcaaaaccaaaaagatatcaagtgcctcatttatggcttagggtcagattttttcagctggaaatgaaacagccatttatattgttcttttagcttgtagttaaaacaaggttaattcctcatgctgcagatactgctgatctgatcactcttatgttttctttcttttctcagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcgacagcatggcttcctggctttgttacggattttctgattgactgccgttaagtgcattgttggtgacaggctttttactgatttaatccacatctcccacatacaggcttggctattttctatgactgatcacgttttataggttatattcatttttcttaggaaagtggtttctcccttctttcaattggaaccacagtgaactgagtttaaacctttttttttttgaaacacggctttgttctgtcacccaggctggggtgtagcagtgcaatctcagctcactgcaacctccacctcccaagttcaagtgatcctcccacttcagccgccccagtagctggaactacaggtgtgtgccaccaggcctggctaatttagtagagatagggctcttgccatgttgcccaagctggtctcgaactcctgggctcaagtgatccgcctatctcagcctctgaaagtgctaggattacaggcatgagccactgttcctggcctgaattttttttttttttttttttttgatacagagtctcactcttgttgcccaggctggcgtgcaatagtgtgatctcgtctcaccgcaatctccgcctcccgggttcaagtggttctcctgcctctgcctcccgagtagttgggattacaggcgtgagccaccacgcctggccagttttgtatttttagtggagacagggtttctccatgttggccaggctgatctcgaactcctgatctcaagtgatccaccttcctcctctgtctcccaaagtgctgggattacaggtgtgagccaccacacccagcctaattttttgtttttgaagcctggtggtaatcattagcattaaaattatgttacactggttcactgccctaattaaatgtttctgctctacactggtccaaaataatttgttttctaaacttaaagtttccactgtcttactatttctactgtggcccatacacctctgggcccagggtatttgcattttgtatttttattgtgttgtagttacagatacatatatgggttttattgttgctaagcacctttttctactgactcgaaatgagtggtttctagattattctttggcagtttcttctacaaaggtccattcctttggtacagatggtgctgaaaccactgctaggaaatgcttcttgcactggtatagaagtgatgacttggctgggcgcagtggctcacgcctgtaatcccaacactttgggaggccgaggcaggcagatcacgaggtcaggagatcgagaccatcctggccaacatagtgaaatcccgtctctactaaaatacaaaaggttagctgggcatggtggcgcttgcctgtagtcccagctacttgggaggctgaggcaggggaataacttgaaccgggaggtgggggttgcagtgagctgagatcatgccactgcattccagcctggatgacagagcaagactccgtctcaaaaaaaaaaacctcgctttctgctcctcgcttagcacacgttctctctagggaaggtactaggcctgggaagtcacagctgaccatgaacagtgacaagagtcagacgctcgaatcggacacatggatgagcagacgtcactggcaaacagccagttgtcactcatggggctgaagagatgtttgtgcaatatgtacagtctatacatccatatttatggatacgactttttcatctgggtttttaggtagtttttggtgttcataaaatatagagcaatcatttaaaagatattgtaaagcctttaaaaacactggccttagcagttcttgatgacctcgactaaattcagccatgaagctctgtggagttggattttaggaaactgattttacattgtaatgtcttccttttagagggatgtttatgccttagtatcactcaaaacacagtatctacctcaaaggatacatgcgtggttttttctgcaggtagctggagttttttactgctgtaagaaactgattgtataaattcactatcgttcgtttgttcattgtcacttgtttagtttccagttttttctattaaaatggagttgctggaatcctccgtgcacataacttctagttcaggtattctagttgatctccagcaaaatgactagaaaggggccactttccatattacagccatcaggatcatgatggaaaagcctggatttatgtcagggtactgccttgacgctgccctagcgcttttcttctcattttctcccaattaactgctctagacactgcagctccctttcttcatttccccacaacactccctcttccatttccatatggaaatgcttacagtaggaggctggcgggcggggatcccccacgtgagggtgctcaagctgtgcggcactgtggtccgtgccgctgactcctggctcctgagacaaaccaagcatctggacctaagcagctgggccaccgacactggcttccagttcacatgtacagctcttctctatccatcggggttgctgatacacatggggttctgtggatactttgcagttactgtggcctctgccggtcataatggagcagtgctagttttctgggcccaggcctcaccacccaggccctcctaggtgatgtgagccaggcctctgccttctgctgccatcctcacatcagtaactcctggctctgcagctctagtccagactctgatgtccctacctctctgacatctccacggtgtctcagaggtgcctcaagctcagcatagccaagacgaatgagtgatctcccccaaacccccatcagaaaaaaaaccccagacgcatctggcccttctgcagtgttctcagataagcgcctggtgatgccatctatcctgccagttgattatgccttagaccgagggcaccggctcctggtggcctcctgaacctttggccatccactttgctctttaatgtccacccttcatgtcaccaagccagcccatttttttcttcatcgtagagtcagagatcatttacaaataaacacctgaaatgagactcgtccaccttcttcagtggctgctcactgcacttagtaccaagagccaaatcctttcctggcctacaaggccctgtcctgaccggccctgcagagctttcctgaaatgtactgctctgccttctggcccagaagatagaaataccagattggtacaaagatgttgctcacagcattagtatggtaacagaaaccaataacctaggcatctaacaccaagaggctgtttgagcttgggatgttatgcagtgaattaaagtggagtggaaaacaaagttatggagaaatgttctgccacattaaaaagttaaggccagcactttggaggccgaggcaggaagattgcttgagcccaggagtttgagatcagcctggcaacacagtgggaccctgtctaaaaaaaaaaaaaaaaaaaataggcatggtggttcgcacctgttgtcccagctacttgggaggctgaggcaggaggatcacttgagccctggaggttgaggctgcagtgagctatgattgtgccacttgcaacgtagcctaggtgacaaagggaaaccctttcactaaaataaaaaatctggtatattcattcaacgaatacaacattgacattgaaaatgaactaggctgggcacggtggctcacgcctgtaatcgcagctacttgggaggctgaggcaggagaatcacttgaactcgggaggcgaggttgtggtgagctgaggttgcaccattgcactccaacctaggcaacaagagcgaaactctgtctcaaaaaagagaaaagaaaatgaactagctacacacattgacctagttgaatcttgcaacattaagggaaagaattcatcaatagggttctgtttgcacgttcaaaaccagtcaaaaccctaagctgtgacctagggatgcacacaaaggtttggttcagctaaacgcaaggaagtgataggcaccaaagtctaagggaaagagggaccctgtgccacccaggctctattcctctaagcctcctcccaaggcaaggagaggaccacacaggaagcagccttcccaggggcctccctcctctgacactcccaggaaggaggaccgggaggagatgggagccccaagtctctgctccacacctccctcccgccgcaccactgccagggttgcagccagggttgaaagaaaggcactgttctgtttcttaacctggtggtagttacacaggtagccactttataattgcacatagatgcatcagacatatttctttgtttataggtcacaataagagagagactgagagaacacttgaatcaagtgtgaggggaagaacagcctgtggcccacactggcccgggttctagtcctgatgcccaccacttagtggctgggtgaccctcctggcccagttctgtgaaatgtggagaagggagatgtgaaggtgtgaaaagatagagtaaggaagcatggagctcaggccaggcatggtggctcatacctgtaatcccagcacttttggaggccgaggcaggtggatcacctgaggtcaggagtttgagactagcctgaccaatatggcaaagccccatctctactaaaaatacaaaaattagaggccgggcacggtggctcacgcctgtaatcccagcacttgggaggctgaggtgggcggatcacctgaggtcaggagttcgagaccagcctggccaacatggagaaaccccatctctactaaaaataccaaaaaatagctgggcatggtggtgcatgcctgtaattccagctacttgggaggctgaggcaggagaattgcttgaacccgggagttggaggttgcagtgagccgagatcaagccattgcactccaccctgggcaacaagagcaaaactccgtctcaaaaaaaaagcatggagctcagaaggccctactgtttctgccaataggatgctgccccaaggagtccacctgcctggggtggaactggccatggctctgcctttggactggacttgggcaggatttccattgcttccagcggaagcaggtcaactcctggctgtgcacctcattccccagcactccctggactgggagactctccctcaactctggggatggggtggaccggcctgtgccatgccctgaagggaggcttctgcttccagcagcaggcacagggccgctcctttcagaagggccgctgtgggggaagtcattgtgcttgtgaatgaggctccttgaatcattccagcagtggaactgggcagcgtcctccacacagagttcagagtcttacctgagcagtggttactgaagatctcaatttgaaacaaacagaaaagacaagaaatatttgtggcagcagtaaggaattgaaagacaaaatacaaacccggccacccaggctctattcctgtgagcctcctcccaaggcgaggagaggaccacacagtaagcagcctccccaggggcctccctgctccgaccctcccaggaaagaggactgggaggagatgggagcccccaagtctctgctccacacctccctcccaccacacccctgccagggtcacagccattcctcaccctctcctggttccagaaggcctgtcgtccttggcctggatgtccacctgtgccagtcgagccctgcggttaagagcacaggctcagtgctctcacttgctccaacatgaactgggctccaagggccgagccttggtttctttatctgcaaaatgggggtagttttaattcctacttggggagcctgctttcataactgactgggaaatgcccagagcacttagcccagtggctgctcggagtgcaggtgtcagctcagcccctctggtctgaaagcaacaggccgggctggggaagaacctgaagtggggtcctgggaaggggcggcgggaagagggaagcagagagcagtttgcatccctgggccccgaggggaggacaatttgcatctcctggctcggaggggagggccaaggtaccactcaggcccggggatgcaaattgcaaaaccaaattagacttcaaaacgcccccatgaagggccaggcacggtggctcacgcctgtaatcccaacactttgggaagccaaggtgggaggatcacctgaggccagatattcgagaccagccgggccaacatggcgaaacccatctctatgaaaaatacaaaaattagcctggtgtggtggcacatgcctgtaatcccagccactcaggaggctgaggcaggagaattgcttgagcctggaaggcagaggttgcagtgagctgagatcgcgccactgcactctagcctaggcgacagagtgattaaaaaaaagtagtatgaaaaagatgacagccgagcgcagtggctcacgcctgtaatcccagcactttgggaggccaaggtgggtggatcacctgaggtcgggagtttgagaccagcctggccaacatagtgaaatcccatctctactaaaaatacaaaattagctgagcatggtggtgcatgcctgtaataccagctactcaggaggcagagtcagaataatcgcttgaacctgggaggcggaggttgcaagccaagatcgcaccattgcactgcagcctgggcaatgagagcaaaactccacctcaaaaaaaaaaaaagaaagaaagaaagaaagaaaagaaagaaaaagatgaattgctaacagtgttggagcaagtggacagtcatcttggaaaataataaagtggaatccctccctacctttaaaaaaaagaaaaaaaagcaatcgtgtatgtaaagtgttctgggagcaatggggcttacaggactaagccaggccaagaggccagggctaggtgaatgggattctgaagggaagggcagtggagagccaggcccaagggggcctgtgggatgatgcaaaggagggggaagatgagccccaagaagggaaggtgggggttgggtgagaagagagactttagagaaggagacatggtctttggtgagaagcctcctttgggagacaaatgaggctgagaagttctgagcaggtttgagtggtttgaggaactggagatatagcagctggggagctgtgagcccagcaggggcctgggtgtggggcaggacggacggtggggcaggtgggaggatgaggcgagggtccaggccagcctcttctcatctccagcacccctccctccaggactcggtgggaagttgacacacatactttgaacacagctggaaccaccgggcctggactggagttctggctcctggttccatggctggctagcagacgctgggacccccagagtccatagaccacagggacctgtttctgggcaacctcacgcgcccggcctgctggacagcgagcagctcctcagatggtcgccgagtgcacttctgccctatcagcttcaggggatagagactgctgcggtcacagtgttgtgagcaaggggacaggcgctcagacagtccttccagtcagccattccacaaacgctagagaggtccaggcgccagggactcagccccctgctcgagggcctctaggctgtgagggcagcaactgtcacggctgtgaaagttatctgtttacatagcctgttgcccacctgcccccccatatctagactcatggggaggagcctttgaggcgctgcagtgcagccagcccagcagtgccagctccacgtggagcccaccttccctgactccattagtttttttttttgaaccaaagtctccctctgtcgcccaggctggagtgcggtggcgcgatctcagctcactgaaacctctgcctcccaggttcaagcgattctcctgcctaagccttgcgagtagctgggattacaggagcctgccaccacacctggctaatttttgtatttttagtagagacagggtttcaccatgttggccaggccggtctcaaacttctgacctcaggtaatccacccgcctgggcctcccaaagtgctaggattacaggcatgagccaccgcgcccggccccgactccattgttgatggtagtggctgctgccattatgccagctgcagcagggaagcacagctggggctgcacactccatggagccactaggagccttaccccttctgggttgggatgggagctctcagtgcctctgcagccaccaaaactgcagctgcagacccaggcctcccgctccaggagggtggggctactgccgcccaaactgcagttgtggatttgagcctccttgtgctcttgggttcttgggggatccaggaagaggcaggatctgccctcctgggtacagctgcagccactggacctatgactgcagacctgagcctcccgctccatgaagcaggcaggagctggggacaatcgggaacccttcctcttctcagttggtggggcgggagctcccgggtgcagctgtggctgccctcccaggtgcaggacctgggtgtctctgcagcctgcatcctcgggtgccccagaaaggaccccccagtctctgcaggctcaggggtgtctgttcccactgcctggcctctctcagctcccagcaccctctcccatctcagagcagggttggggccaagccctggggccatgaatggcagcaggaggcagacagtcctgggtgggagtgggcagggtccccagtaaggcctcacctacaggccagggggggcctgaaggctgggggccaggctgccagtcctgcagacctgagtggggacttgtggtacctcttacgggcctgcccatggccacccatggaccagtcggcaggcacttcctccccctgtggtccataaaagccctgggctcagccagagcagaccagaggatggagagggcggagagatgatgacgggacaaccagctgcagagaggagtgctctctctgatgacagctgcagatgatgggacgactcctctactactgcagagaggagtagtaccctttcccctgagagctgcagagacaacctgctggcagagaggagctaccctctctactgagagcttcagagacctgcagagacgtccgaatgacttgcctgtggagaggagccaccctctccagggcctcctctctgctgacagctgaacacttgacgggacgacctgcctacagagaggagctgttctaacactaaataaaaatctttggccaggcatggtggctcacgcctgtaatcccagcactttgggaggctgaggtgggtagatcacgaggtcaggagatcgagaccagcctgaccaacatggtgaaaccccgtctctactaaaaacacaaaaattagctgggcatggtggcacgtgcctgtaatcccagctactcaggaggctgaggcaggagaatcgcttgaacccaggaggtggaggttgcagtgagccgagattgcaccgctgcactccagcctgggcaacagagcaagactctgtctaaaaaaaaaaaaaaaaaaagaaaaaaaaagtcttcaccctccacttgtctgcgtacctcattcttccaggatgcaggacaacaagaactcaggcaaaggcactggccagatatttccagccagaaaaatcgacaccccagagatcctgtaacattgtgactccgccggaggctgggaagcgcaccctggtggtgaagaggagtaaggagcatgacagcaactgacacactctctccttggatgtgaggctcggcctcctgggctgtaaacatccttatctgaaaaatgggaagaaaccactcacttcatctggctgtagtgaggatgaaatgaatgaacatgtgtcaagaactcagcacaggccaggcgtggtggctcacgcctgtaatcctagcactttgggaggccgaggcagacagatcatgaagtcaggagttggagaccagcctggccaacatagtgaaaccccgtctctactaaaaaaaatacaaaaaaattagctgggcatggtggcacgcacctgtagttccagctactcgggagactgaggcaggagaattgcttgaacccgggaggtagaggttgtggtgagctgagatcacgctgctacggtccagcctgtctcaaaaaagaaaaaaaaaaagaactcagcacagtgcctggcacagaggaaatgtcagctaaaattataatgatgacttcacatgactctcctacactaaaacatgtttaaaagcagaagccaaggagctgtgtggtgggaaaggcctggaaacggtctacagcagagcttcgcagagtgtggtccctggaacctgttagaagtgcctactcctgggccccaccccagagctgctgaaccagactgtgggggcccggcatggtgagcctgccagggttccaggaggtctgctgctggctcttttgagcctccttgcctgaggaggttgctctgggtgtgagctgtgtgagacactggtcctaagcctgcacagacgtccccctgaacaagcaggatcacagcgaggacgtggcatctttctgacttctcacttggaaaagtacccgtggtgctcaggccctaccccacccttcttccatttgggagtagagtcccaagtcacctaaccagaggacaatcactggtgaccatgggcagccctgatgaacccccatgcaaatctataccagctccccctaggaacctgcacaggtggcctttctctgaaaataaaataagaccagtggttttaagacactgagctcattccaggaccccatcacctgttaggaagaagggagggcatctgtgctgggctggctttcgctgcattaaaaaaattaaacgtaggggccaggcacagtggctcacgtctgtaatcccagcagtttgggaggccgaggcgggtggatcacttgaggccaggagttcgcaccagcctgggtaacatggtgaaaccccatatctaaaaatacaaaaaattagccaggggtggtggtgcatgcctgtaatcccagctacttgggaggctgaggcacgagaatcgcttgaacccaggagatggaggttgcagtgagctgagatcacaccactgcactccagcctgggtgacagagtgagatcctctctccaaaagaaaaaaacattaaacttagggaataaatatattatgataagatgcatggaactagtatcttgatgcagcgttcaaagaaagctatttgctctgggtgccgtggctcacacctgtaatcccagcactttgggaggccgatgcgggcagatcacctcaggttgggagttcaagaccagcctgagcaacatggtgaaaccctgtctctactaaaaatacaaaattaaccgggtggggtggtgcatgcctgtaatcccagctacttctgaggctgaggtaggagaatcacttgaacccgggaggcggaggttgcggtgagccgagatcacgtcgagccgagatcgcgtcattgcactccagcccgggcaacaagagtgaaactccatctcaaaaaaaacaaaaaaacaaaacaaaacaaaacctatttgctaagcacagaggaagaaaaagatagtcattactgtaaaactgcagagccccaaagcatatgaaacactgcatctcactaatgatggcgttttgggagaacttcctcagaccttttacagagtatctggaaacatcaactaattgatggggagcacagcattaccacaaaaacacttgtagagcctgtttattgcataactagcaggcacaaattccaaaacgattttacaacacttaaagggcacaataattacaggaatagaatgtacaataaaaagtacagaataatgagtgacagggatcaaacacgttggaataaaaggcatctcagttttcctatgcagcattttcttttctaggaacacgttaccttcaaccaggacaaggaaagaaagaaaactatactattggaaagctcatgggtgccattgaggacaaaaacaggcgagttttgctcttggttctgcaactgaatcacttgagaagccgtgcacagctcccgagttgtgcgtttagaattctgattacatgaaatgctgtgtttgatctttgggcccaattcactgttctttggcaaataagaactatttgcattccaaggcagatgacgatttctgtgaaaggagcttagaggtacagctgtttccttctgttcagtcaagtgccagtttcataaagtgcacctctgccctatcagctttgggggaagggtggcatatggggaggaagggatcattgagaatacagggtgaaaaagaacgacgttactgaaggtagacattgctagtgcaaggtacggaatccatgtgcaaaaggtggctggaacaaatgttcagataaggtgcgatttgccaacaggagcagagaactctgacaccagatctcagatgaggccaaggaaatgcgcggggcacatacagagaggacgacctgcagccctccaatggccacgtcattccaccggggaacttgtttggagttttggcaccgtgggctaaccgagcactcttctgacatattcttacaactggaaatgctttgttggtccccatgttccttgactttctctagggccataaaggcaacatcttctattgcaggtcctcaaacattccaaggaaaacactgcttcacctcctgcagacagctcatttcccagaagcctctacagaagcccgtcctccctgggacagcaggggcaggggtttgcaagataaaggagggtcagctaaggacatgaagcctgcagaaaaggctatcagatggcgcctgaacttaaggtgggaggcccccttctagaaggcatcccgggagcatccaacagcaatgtggcacttagggctgtgggacaaacaagtggaagagtcttttggagacgtggacccttttcccatgctactcacagtgaagcaaaatgcgacaaaagcatccacacacggtgacttagtaaagcaagcaccgtcggggtgctactttcatgacagcatatggtcaagctataaaggtgtgcatcgatcagtcctgtgaaaatagaagcttagttattagcatgtattgaggcaacttgtactttgattcttgtgtcttcttcacatgtgtgaatgactgctatgggacagaacatatggttaaaaacaggagcgacagcaacataacacacagggttggccggctccattacgggtaagactcagaggctgctccaggtgtgtccggggaagccaggccctcacactgcacagcttacagggccctggggtgggggctgtgagctggcagcctagaggacacagctcacctgcacatggtctctgaaagtgttcaaattggttgccaacatttataaatggagagatggcaccaaaaaacatctaggtttcttgtctcttgaaaaatcaaagctgtggccaccctaggcccacttttccacatggcaacaggcgtggagctgggggctactgcccctactgtgtaggcggtgggctccccatagtctcctctgccctgctgccgtgtacctggctcccttcactcatccacatcaccggccctaggccagggtctgaaccacacacacagaatggctgcagtaagcaggaacgggaagagctttcacattcagaacaagaaggggcttttgagtaactaaaaaacaatctgagcatgttccagcacttcaaccttactctttcagagctttggggtagcaggcagccagctagagcacactctctaaggaactcttgaaagttgatgtctaatttttaagtactcatgaggtgatggaggagaaactaactcagatgactgcgatacgatacatctttccttataagaagtccttaaagatgatgaaaaatgtgaagcaactcatgtgagaaagctgtaagtggtcagagaagcaagctgacttttggatgaagggtacaacacagtgtcagggagtaggtgatttcttttccctatagttcatggtagtgatacctaaatgggtggcacaaaatgagttctggcttgttagactgatgcttctctttgctgcaggttttgaacaaactgtctggcttacaggggtgagggagagcacctgacaatgggtggtgatgtgcgtggagctcctaccctgaacatggcttcatgagatgtcctgtggtgggtcaatgctttatctcattccatggagccttcaagatgacaagaaaacatcaagagataggagcttgagataacaacattaaataacagaacatgtaacagggtaaaacactgagaagaaatgaaccaattcattgtttcctcccaagagagactgtgacactagttttaaaaagcggcaaagtcctttctctacatacatgcttggagataccccaaacttagagattatgaagtaggccaggaaattcacttattgcacgatgcttggcagggaacaaatgacgctgattttttcttttttaactgaactctctcaagaaaatgttttatgaaaaatttcatttatagtttcagccataggcagggagttttaagggatggaaaagttttcacaaactttagacaatgaaactatacttttggatgtatgtgatcaactcaacagttgttgacaacacaaccgaacatcagaaactaaaccagcaaataggcacaaaataaggcaagtgggttaaatagttgaaaattggttagaaaacatgcaaaaataatactgagttttcttttaaaaagttttaaaccgtcattaaatgtttctttttgtagaaatctgaagagttctgcgtctgaatttgaaattggactttataaagcctagaaaacagaggaggcggtgccctgcccttgtcagttgttgttctctttggtggtgatggtaaccagctgcttggcagccttggcgatgtcgtacgcacactggatgacctgctgcgtgaccagctgaacgtctgtgggtgagccggggtcccctgggagggtcttcttgcactctgactgcagtcggtaggcactggacgtcagtaaacgaagggaagtcctcaccatatcagacttgggtttctaaaaggaaaaagacagccgtttaccctgaactgcagggcagacatccaaaagcaggggacaaacattcttctaaagcaaaccaagctgctccccagagtgaaaggcggtttggtcctgccctttctcaaaggggtgcttcacacactccaagctttgcagcccacagcgtaagagatgctgaaatattctgattcaaaggtcaaagtgcatgcagggtaattttagtagtatgtggtattttgaagtagtttttgaaaaatattaatccatgtgggtaaaatattccagaaaatcctataaattttaaaatgtgccttttagcacgacttgtatatccttgtcttattaaatcaacattcatgcagaacaaaaatatttcaaagctctatacgactgcatattttattttattttacttttttttgagacttgagtttcactcttgttgcccaggctggagcgcaatggcacgatcttgactcactgcaacctccgcctcctgggttcaagcgattctcctgcttcagcctcctgagtagctgggattacaggcatgcaccaccacgcctgactaattttgtatttttagtagagacagggtctctccatgttggtcaggctggcctcgaactcccgacctcaggtgatctgcctgtctcggcctcccaaagtgctggggttacaggcgtgagccaccacacccggcctcgactgcatattttaaaactgcatgtgctacaaaaaagctaatgtaatatataggtcataaagaaatttcttgctgttcatttaaaaggatttaaaccaagtgagtaggaagtgacttactttggggaataatgctgccatttctgtaacagctacgtgtatcctctctgagcagggaatataactgcaagaatattgaagaagttattcaatgacagtaaaaatgattcggaggcaaagaggactcaagtgctagaacagattctgtttacattcccttcatgaaggggctagggctgcagtcagccgtgcatcccacaccaccagagggcacatggttataaagcaggactctcattgcttcctaaaagttcaatctgatgaaaagtctccaggtatgaaatatggcaacatacactcttggtcaggtgaggccacacaacagtacagaaacataattcacccctcctcacgtcagtcatttacttctcatgtgtttcatcgtcccaatttctagaaagagaaaggatttccatgcaaaaggccacagaagtgaaaaataaaggactgaaaaaattccttaaaattagaattggagtctctcaagtagctggaacttcaggcatgcaccgccatgcctggctgatttttaaatatttttttgtagaggagtcccactatgtcgcccagccttgtgttgaactcctggattcaagtgaatctcttgcctcagcctccaaagtgctggggttacaggtgtgagccacggtgtccagccctttccccattttttaaaccatgaagttggcttctgaatagattgtcataagcaacttatgcacttcacctttgtaacaagtctagtttcaaaactattataattaaaactgtcggccgggcgcagtggctcacgcctgtaatcccagcactttgggaggccaaagcgggcggatcacctgaggtcaggagtttgagaccagcctgaacgacatggtgaaatcccgtctctactaaaaatacaaaaaaattagctgggcattgtggcgcatgcctgtaatcccagctactcaggaggctgaagcaggagaatcgcttgaacccgggaggcagaggttgcagtgagccaagattgtgccactgcactccagcctaggggataaaagcgagattccgtctaaaaaaaaaaaaagactgcctacattttaaattaaaccattacatttcaagaaaatggtttatagtatccaaaaatgccttcattggaaatcctgacttctacctttgtgagcaattagaatcacaaaccatttaataacaaaaattccaacatatatggagttatttaacttgtaaatatgaaggggcaacaacctatctggtcacacagatttcagaaagagaaaaaagcaatgtccacagccgtcacatgtatcatgcatactaataaactgtgtgtctgttaatatcacagtgactgagaaccacactgaagttttttttttgagatggagtctcgctctgtcgctcaggctggagtgcagtggtgcaatctcggctcactgcaacctccgcctcctggcttctccgcctcccggcttcaagcaattctcctgcctcagcctctcgagtagctgggattacaggtttgcaccaccacacccggctaatttttgtatttttagtagagatggggtttcaccatgttggtcaggctggtcttgaactcctgactgatccacccgccttggcctcccaaagtgttgggattacaggcgtgagccaccgcgcccagccagtgaagagttttatattttgttgtttatggtttcatttttgagaaatacgattcaccctttcctcctgctacacagagaaggaatctttcctaaggccatctctcaaaagctcactcattatgaactatttggggaagtcctccacacgatagaaaagcgagcacacccggattaatgaggaagccctcctcctctaacaggagtccatattcacaacttcacattggtatctttcctcaaaaaggttttcgtgcataatatgtcataatccctgaattgtatgtgtgcctgtgtgagggcaggagtgaggctggaggcccaggagacaagaccagacttcaggaaggtcaggggctggggttgcttacatggatcaagaggagaaaacaagagaaaaaggcatgggtttaattcgtacaattcaagatgataaataaaagcatcttgaattttaatataggattgaacaatttatgaaatataaattctctagaccaattatggttttaaaccaaaagaatgagctaatgattaaaatctctgcatcattctctcatggtcttaaaaaaaaaaaaaaggaaatcagatcattatatgtgttgttgaatggatttgtaaattttaaacaaagaaagaaaaaaaaaagaaatttcccaaattgtaccaagcaccatattgcatctttgaagtagaaatggcctcagggcagatatttgtatttttgacaaagacagcaatataaggcaagcacattttagtttgaaatacaagcacagcacttctgaactagaggaaatgaaaagcgaagcacattgacaaatggggtcacggtgctcgggaagaaagtgttattgaatcatgattacattaaacgctgtcaaaaactttggccaagcacggtggctcacgcctgtaatctcagcactttgagaggctgaggcgggtagatcacttgagatcaggagttcgagaccagcctggccaacatggtgaaactctgtctctactaaaaatacaaaaaaattagctgggcatggtggcatgcacctgtaatcccagctacttgggaagctgaggcaggaggatcgcttgagccaaggaggcggaagttgcagtgagcaagatcgtgccactgctctccagcctgggtgacagagcaagactctgtctcaaaaaaaaaaaaaaaagctctgtactttggaaagccatgggacactttgctttctgtaatcaaatatgaagtcactcactgccaagactatggtcctgagcaaagtgagtgtgcttgtaacccgtggggtcccaaaggcatggtatgaagagaatgcctgggaaaggagggaggaggaagccaaataattagacagtttttatcgaaggaggcttaaaagttatgcatgtttctctttttctctgaggagcttccagcagtccctccagaagactaactcttatctttcaataaacatggattattcccttctttcctagtgggaaataaggacactgggagatgtgtgagccatataaaaaagggtacagaaaagggaggttggcccagtagtgccaggactacaaaagggaatacaaaggcccagatgcatgtttgtgtggaagaagaaaacagagagaagagtaaacagcacagcatcccttgaatactttttgctcgtgcaaggcgtgaagaaagttcttcactgaagtcctaaactttgctgacctaatgaaaagaatgagatttttcttgggtttgactgaactctgctggtttagctaatgttttatgagtgtctacatcctgccaaccatgggaagctaggatgttaccccaagcagttcgcaactcaccggaagttctcagagaattcactctcaaagaacaaaaggctaagttggagcaagagccagtcccttcctcagggtaagaattaaccacaggacgtgcttctagtcagagtaaacagcctcccctctcaagtgcagagatggacttgggtgatgatgagatcaactttatttattttgagacagtttcgctattgttgcccaggctggagtgcagtggcatgatcttggctcgctgcaacctccgcctccagggttccagaaattctcctgcctcagccttctgaatagctgggactacaggcacatgccaccatgctcagctaatttttgtgtttttcatagacacagggtttcaccatattggtcagactggtctcgaactcctgacctcaggtgatccacctgcttcggcctcccaaagtgccgggattacaggtgtgagccactgtgcccagcccaggataccttttgtgtcagcggccttgtccttagccaggccagggtatagccatggccagaagcgaggtgtaaggtagcccctgtccccctcctagaactagcattgtcaccaccctaactatgccgcaatcctgtttctagaggcatttattttcggagcttcgtaacaagatgaaaaaaaagaaaataccatgtaaatcaaacaagacaaagcaaaccaaaactgacattgttcttaagcctgttatgtagacttgttttcaatgaccttgaagtcagcatgctgggaatagctgccattaggaacatgggcatcatccctttctgggcgcataactcatgctctcccaaagcagggtcttcaatcctgcttacctgtcatgtttattttcttgggctgctcttaagagctcctgtatgtttttggtgatctgttcagtcttcctgatgacatcttcggtgctagggagagtggggcttggggccacatggggttctgctgtgtctggtaccaagccatcccctggccacaccatacttctttgccgtccctttcggcttgacctgtgaacattaaagatgcagttaaatacagcaggtgcttatcagctgcccctctgcttctaggagccactttgtatgcactggctaaatgcatgagcaggctggtctcgtcatttcctttatcctgtctagcaggagactcatggtaaggctctaaaatcggctatttcactctaccatagggctggaagtgttgactctcacaggaagggtgaaggaggggaaaagggagggaaatacctggagcggggagggtgtttgtttataaagccatcctcaggtgggccaactccttgggtacaaatgcagaatgtaacctaatgttgtcttcatgatgaagtggggtaatgactttaaacacactacagacagctagagacacataacatgctggtacaaagaaaaaggcctttcggcaacaatgtgagatgacaagacatgtaaactacgagcgtatgcttgaatactttaagactttatgagtctgaaaatagagaaaaggggtgtgtgtggtgaactgcttctgctggcccaggcctgccaggtctctggccctggggagcccctcccctggcacgctcgtcctgtgcatgtaccccatgccatctggctccatgtcgttgggagtgttgtcgtagtcactctcaggtgtgctgttctgcttctccagcctggatgcctacaagaaagaagagggaccctcatgagtttgtaacatgagactcttctcaggagtcttccccaggaattgttacctgttaggctactggccttcacatcccaaatctcatttgggacaggggacaactctctagtgaaaatttagtaaaagatgaatattggatccagaaatggcctctttccttctttgcaccattttcttcttagctcagtggccacttcctaatcagatccttagtacaaactaacagacatgcaaggcaacatatcctcatttagttctcaaatttataacataatgagatgcagttaaaatacaggcagggtgtggtggctcacacctgtaatccctgtattttgggaggctgaggcaggacgattgcttaaggctaggagtttgagaccagcctgggcaacatttaaaaaataaataaaataaataaataaataaataaataaataaataaataaataaataaatcagccaggcatggtagcatgaacctgtagtcccagctcctcaggaggctgagggaggactgcttgagcccaggagttcaaggttgcattgagccatggtcgcaccactgtactccagcctgggaaacagagtaagataagaccctgtctcagaaacaaacaaacaaaaaaacatgccagcacttatatgaccacagaccttcagcactggaagccaccttcagattatctcattgagccccatatgagaaaatgaagggccaaaaaagctgggtggcccaccaaaggccacaaagtctgcagaaaaacaggaccaagcaccaggtctcctgcctcctgctacctccaatatttcatgcctgggctcaaatctaccccttaaaatgtaaagatttggtgcaactgtggtgatcaaaaatgggatacagattcaaaagaggaatcctaaaaatgttttgaacaaatggcagcactgctaaacacacgatcttctagggtgacgaaatttgaaggggactttattccttcgaaggggactatgttctgagtatttcatgaacattattttccctatttatttcacccataatgcttgagaacttctctggaacagagatcagtggaggctaatttaaaacctaaaccacttaccttataaaatataagtgtgagctatttctagctttactccttgaatttcatccaagttaatcaaaacatgggactaaggagttttattgatgctgcaataaaatgtggctaaggacacagatgtaaactaagagctttgtttaaacatatggaaaccctgtagcttcatccaaaagagtggctacttttgagtaagttggtttaagaaggtctacatggccaggtgcggtggctcacacccataatcccagcatgttgggaggcagaggtgggcagatcacttgaggtcaggaatttgaggccagcctaggcaacatggtgaaacgtcatcgctactaaaagtacaaaaattagctgggtgtggtagtgcacacctgcagttcagctactcgggaggctgaggtgagatgatctcttgagcctaggaggcggaggttgcagtgagatgagatcgtactactgcactccagcctgggtgacagagctagaccctaactcaaaaaacaaaacaaaacaaaacaaaacaaaaccaaaaagaaaaaaaaaaaaaaaccccacaaaactctacataaagcctgtcactccttactgataacacctggtgggtacaggcaaggcagccggacccacgtggagaagccccccttattcacaccacactttgtttgctatccccatacactcttctgctcccagggcgcatgttctctcctctgtcggctgaggtcttccatccacacctccacgcatgctgtttagttcccagctgctcaaatacaagacacttgctgtgggctcctaaaattcactatgaactcgtgcatcctgaagccactcaaatccatctggcaaatgattaaacgttagcttggagccatatggggagtctgtaaagctaatttctgtagaatcgacaactttgatgatccctttgtttatatctcctatcaataagtagttctgcttctcttgctgccttgttttgatctggctttatgaacagtcagtgagtttggctgctagaagtttatagcaggaagatcatgggcaagcactgtggtcttccagagatgagcttagaaaatgaaaaagaaagaagaaaaacccaaaacccttcttatctttcacagggaatgcctaacttttttcttttttttttttgagattgagtttcactcttgttgcctgtggagtgcaatggcataagctaggctcactgcaacctccgcctcccaggttcaagcaattctcctgcctcggccccctgagtagctgggattacaggcatgcaccaccataccgagctaattttgtatttttagtagagatggggtttcactatgttggttaggctggtctcaaactcctgacctcaggtgattttcccgcctcagcctccaaaagtgctgagattataggtgtgagccaccgcaccctgccaattttttttcttttttttttttgagacagggtctcactctgtcgcctaggctaagtgcagtggtacaatctcggctcactgcagcctcgacctcccagactcaagcgattctcccacctcagcttcctgagcagctgggaccacaggcccgtgccaccacgcttggctaattttgtacttttttgtggagacaaggtctcactatgttgcccagcctggtcttgaactcctgagctcaagtgatcctccaactttggcctcccaaagtgctgggattataggtgttagccaccacacctggccccaactaacttttaagttttattttggtttttatatatacacccacacagaggtgtgtgtgtgtatacatatacacatatatgaatagataaaaacttgcatttacgtaattatactgaaaaatttgcccagagctgctccagtggaaaacaaactagaaacagaattaaacccagaaaattctacatttttataatgaatcttttttatttatttatctggagacagagtcttgctctgtcgcccaggctggagtgcagtggtgcaatcctggatcactgtaacttctgcctcggcctcccaggttcaagtgattctcctgcctaagcctcccaagtagctgggactacaggcacccaccgccacacctggctaattttttgtattttaatagagacagggtttcactgtgttgctcaggatggtctcaaactaccgagctcaggcaatctacctgcctcggcttcccaaagtgctaggattagaggcgtgagccaccatgtctggcctttataatgaatctttttgccttccctgatgaaaatgtgataaatcgcaaatcaaatgcattaccctcaatgatgaaaagtaccaagtttcatttaaacattttagaagagtagtgactcatatacctaataaatgcatttggtaaatgttttttcaagtatggaaaacaacatatagcagcaaccacccaggaaatcagttacttacacgttagttaagtccttccatcgttgtcaacaaaagcatatgtacagaatttcagtgtagccagcatttaattgtatcaaaaatattataagcatgcagagccaaaagctattggttaagagtgctgctctctcaaagctgttaataggaaggttaccttatagctggtgctggttcaatgtatttaataggtttgcagttttctctgaataaagacacgccataaaaatctaaactcatgatgaagctgtcaggaacaatcagggtgatcagtttaaatgatttttgtacaaaactctgtctcagcaagcagtccttgcaatgatttttaaggctaccatacaaattaaaaaacaaaaatttcacagtagacaaaagaggtttgacttacaaaatttctaatgagatatttaatcactgtctaactgtcctttagttgtatctgggctattttaatgaaacattacagttcaatttcagaactgctcaggagactttttttttttaagacaatctcactctgtcgcccaggctggagtgcagtggtgcaatctcggcttactgcaacctccacttcccaggttcaagggattcttgattctcgtgcctcagccttccaagtatctgggattacaggcatgcgccaccacccgccgctaatttttgtatttttagtagagacaggttttgccatgttggccaggctggtctcaaattcctgggctcaagtgatccacccaccttggccttccaaagtgctgggattacaggcatgagccactgcacccagccgagactttaagtacaatgtatcaagaattctttttttttttttttagtacagtaattccttttttttttttgagacagggcctcactgtgttgtccaggctggagtgcaatggcacaatcatggctcactgcagcctcgatctctcatggtgggctcaagtgatcctcccatctcagcctcccaagcacctgggactacaggtgcacatcaacacacccggataattttttatattttttatagagatgggatttcgccatgttgctgaggctggtcttgaactcctgggctcaagcaatccacccgcctaggcctcccaaagtgtgtgagtcactgcactcggctgagaattcttaatagactgaaagtgaagtgaagaattccaaaagggtcagggcatggtggcgcatgcctgtaggcccagctactcagaagcctgaagtgggaggactgcttgagcccaggagtttgaggctgcagtacgctatgaccatgcctgtaaatagctattgtactacagactgggcaacatgagactctgtctctaaaaaataaaaaataaaaaaacgaatcctgaaagggccttggtaatccatatgccactggaactaggaaagaaaggctctccataattcctaggtgtggagggaatggcaaaggcccagtgcaaaccccaccttgcctgtaaaggtggtcccttacccacagccaccttcctcctcttaccttacattacccttccattaaaaaagagatggagccagaactgggacgtggatttcaaagcctatgccctttccacggctttcccaggttgtggtcatgtaccactctttatgcatgaaagtattttttaattgacagtgcctttgggagcaggggctgtgccagctaagtccttaggaccctttcattgacttacccaaacgctgtgtatggaggaggtgcttaatacttactgcctgactactctaaaagaggcttacctgaatcatgcactgctattgagaccataaattatacaccagtaggtgaggtttaaccaacccgtacaagtgaacagctttaggttaacagctgcttgcatagctccaatgccacaaggtgttacaattctgattcaagatgcagggacttgtaaaccttggtttgtcagcacttgtggtgctgacataaaatgtgtcacaggttaaaaaaaaaaaaaaaggcatgacattttagtacttcagcgagtccacatacagcagtttcaatctgacaactgtagccctgaacaaattgaacaaatttggcctattataatatctaaccagcagccagctaattttctcgttgtttaaaaaaacagtttgctcagaataaatgctgtagggtgatttgcaaactttgttaaatatgacgtgaacatgagcagtatggggttagagaaagggaggcgccctcgatgggtgagcgtgcatgtggacgagtgtgagcctgatgcactgtgagaaaccaggaggaagtgctgcctcatgcaggacggaagggcagttagcagggacaggagggccagagcccaagcacaaagcgcccaggagcacggcccctcctccagagagcagaccattcagaatgtacttaacccttcgggcgctttcgtccctcgaccaggaaagtgtggaggggaaggaaggcagagatgaagaggaggtcacaagtgcactcctcccgatctggaatgggaaagagaaacacactcgggaaaatacaaaacaaaccaaaaacctaccaccttgccagcttcagtaaaagaatcctggaacaccacacattatgtgacgtgagtgctgcaatctcagtggccaccagtgacaggaccccagagatgcttaaacccttggtgaaacacctcctggaaattactctgaatttaataaggctgcttttccataagggaaatacctaacataatttgtcaaacttgtcaataattttttaatggatactatgaaatgcatatttgtttttcaatcaggactgatgtgaaatgagaaactataaaaatgattctaagttgctatacactatcaatctaatttttagtacaattacagtgccttcctgatatatctttatattctaattttttctaaaataagaaagtacactgaaaaataacaaagttgcttttcctaaattttgtcttcagctatacaaaaataagattcttaacttagggtgggcatggtagctcacacctgtaatcctagcactttgggaggctgaggcgggcggattgcctgagctcaggagtttgagaccagcctgggcaacatgatgaaaccccgtctctactaaaacaaaaaaattagccaggcacaggaccatgtgcctgtagtcccagctactcaggaggctgaggcaggagaactgcttgaacccaggaggtaaaggttgcagtgagctgagatcacaccactgcactccagcctgggtgacagagcgagactccatctcaaaaaaaaaagattcttaacttagttcagtggcattcccattacatcaaatgtatcaaatcaattgccttagaatgttaaacccaaatatcttaaaaagaatctgagataacagactcccaattatagtaaaacaatattgtaattttaccacactgaaaattgacaaaattaaactagggtttaattcacgaaaccatgtccttgctttgcatctaccttgagaatttttttggaaactcccataaaatttgactgaagaaataataaactttgacactcaaaaagacaaatactactctctgaaaaagcatcccatgaaaaagtttaaatgtaacatcttggcaaaacacatatttttataataaagtaatccagaagaaatatatttgaaaaccttataacacagtatgtatcccaatgcaaaataagattgtaagaaccctgctgcagaacacaatctctggaattcagcgcttctaagactgatgtagagtattacatttccttttctgagacaacaaagccacacttcccccaccacggtgggaggagcaggatgcagaagcgaacctagcaggcacactgagcacacatggagaggctgcggaagcctggagccttccagccttgcctgggtacctgggccacagactcaaggccacctgcttgaggaggagctgaaaagacgtcttggattctaagggctccagtacttaaaggggcacatccctgtctagctccaagaaggcaacacttccttctgagagtgaactttatgatttatttttgtttttggaagtagagaaggaaggaagctttaccaaaaaaagttccaacactggctggttgagaaataatcatggatgtgggggagaaaaaagcagcagttcgggcaagagccagaatccccaacttggttaggaaaccatcagcccatggccctgtgtgcttgtgggaatatcgcaagcatctgtggacatgttaatacagcaaacacaatggtaactctcttagtccaatttggcaaagcagagctgtggggacctgtaggttcagaagagggaacagagtagacaggctgcatagagtgaacagcagaagcgccagtggtgttacttacgtgcgcggggaagggctggagtctcatcctgctctcttcggggcggctcgcttctcccattgggagatatggtttctgacctgatccggtctcgtacatggacatgggcctactgccccgggcagacggacgtctctttaaggaagagtggttggaagtgtctgtgtactcagaaccagtttgcacctgatatacattggttgtggcctgtttcctgaggttcgaattttcactctggagtgtttgaagctgaaagaaatgtttggcagtgggactgtgtttttttacagcaagcagaaaaagcaaacaccaagtaaatgaatacaactaccagttttaaacaataaggacagtaacagctagccgggctgaaagtaaaaagccaatacaaacaaggaccctttcttctggattgggtgaaacacaatcaactcccttcatcacgtaagcaaattaaatagcttcatttctgaatgtggaaaagttgtggtttggacttcctcaaaacaaaatgtctaaccactttaaaatttgtcatggtggggctgggaaatgtttgcaggcaagctgtacactggattattactaaggctgtttcaagcaagagttcgagatcattaaaacatcatttaggtaacttgcttttcaaatgagccctgagcaatttgtaaaggccaaaaatgacagcagacaccatggaagcagcacaaagatgactagggttgctttgcaaagcaagaaagacagaagttcagcttgtgaaaaatcagatcgcctattgctttccaaaaagccaacaagaaaaattatgatcaacaagtttttattacataatactcttgatattccaaacaattcagcactttgtaaaaaaaaaaagaaaaaagagaaaaccggatcatggtaagtttgctatattaacatatcacgaagaaaactggaaacctattgatctatggaattgacatcttcgcatggatgctccacgcagcacgcttgcttccgtctggtgagtgatcatctttcggccagggctggaatatttggcctttctctcctttggctttgtcacccaaaaaacacgacctcagtggtgtcagctttgaacatgctaatctgcctggcaccaccccattttagagactgtcacttggaggccctgaatgctccttccattcctcacatgcaggctgctccatggtgctggatggattagagttaaggggtcagcagggaatcgtgttactctttggcatctggcattttaaacaccattcaccacgtccattctgcgcagggtccttcccttctggtgcgccttcatcttccatggacattctataagctgggtgtggtgtgagttcagctgtctactctttgacagagattgtaaaatctgaccaaattccccaccagtgccaaggtttaagtccacaagcaactgtttgcaccagaagatcattactttttcagtagcaaacccattcaatgttaggagttactttcaatttttatttagaaagcaccaatctgtgaaaaatacaccaatagtagttgctcctcttcattaattagcatcttttccaagcaactgttaaatgtgaaagatcagatacaaatcatgctactttgtcaactttatgtatattaaaaactttacccaactttgaaatataatcaatacatctttgctaaataaacaaattccatatactttatattaatcatgccaaactgctgtgaaagtgtgacttactgcctcttccacaaaaagaccactcattctgtttctctgaagagcaagccattacagaatgatagaatgcttttatatcacaaaggctggcagggtatagctcatatctgcaattccctttccagggaaagaacagctgcaaagcagctgacaaagcagccctgaacatttctacattccaggatacagacaggcatgaagtgcctgttgaaactattcattagagaacccagggcctagagtgaaatggtcaaggttcaaggactgaggtgtgtaactgacacaggtccctcaatggggcactggtgcatgtgatcacgtgtttgtctgtataaaaagcctctgtggcagttatttagttaaggccttgaaatctgaaactttatcctaacacttttcatgcctggattttgtctgaatgtgttctcatgagcacaagttcttggtttcaatttttaaaaatgttagtactctgtatttagagagatgtcttcacataaattttaatgacgtttatcttaataagaaccaggctacacttttttatttggaaggagtataagggaaaataaaaagttatagacaattcaatagtttcagaaatcaaaagcacttctaagaattgatgagataatcaataagcaaaagcaaataatttcactttgcatttctcaaagaagctcaagacatttgctttcagagataatgaggctctctctggtgatttccaaaaatactaaaagaagcattgttagattttaaaaggtgatgtgcagcagattgatttacagtggcaaaatcagcatgtttcagaaatagtcacctggtcaaaattattagtccaattaatggaacaaactataatccactaaataaaatatattccaaagaaggcaaagaaaatacaggtcctgtatgttatgacaaaggggctctcggtctgtctcgtttacagctgcacggcagccctagacagggctgggagacacagaacaagtgtctgttcgtttaaggctagctgatcttaagcattcttcattccctgctactataggcattagagccatttatttcaaaaagtctcaaaaatgctctagaagtcaacatcaaaagaatcctagaccaaaccccaggcaaaagtgcacagcaatttccttccctagtaaacagaggggcatgggcccctttttagttcttccaccttcctttaggaagcagcactgaaaagagtccaggcacacatggagtgtgccacgtcctcaggtcttgaaaatgatttgaaaaccttacttctcaaatgacagcctaaagacatagattatatatttcattttgtttctggttaagtaaagtgtccaaatctcattttagagctgaatgatgagtgatacccacaaagtcatgggcaaaatttgcaatttttcgaattcccttatttagccatctcataaggagttgcatacacaatccccctcctactaagggtattccttgctaccatcaaccacactccttttagggattaatatattcacacggttctgattctctcaaaaggtaatgaatgagaaaatgctgagcaaatgagattgttttttaccagtgtgcagctcttcctagtacaaatgaaatgttttttcttattttttgagcacctactctgtggcaggccctcctgtaggctctggggataatacaagttagtagtaaaaactggtgagcaataaggtggggatgtgggatagggctgccagggtgggagcagggtttgaatgctgataaacatgcccctgcccagggctctcattggctctgtctccatggtgtgatcatccttccctagcaatgggaagaatcacatccatggagccccatccaggtttccaggaagcacagaatagtccaagggttattctaatgggcacaaatgcttaaatagatgttaggtttctcctacctggggaacttactctggatatatttcattttaaatatccaaatacatcctgcttcaaaaagacaacttggcccaaagatttctaaggctgttacaataactgtttttctttcctcggaccacatcacagtgcctgagattcttccttgtactatgggattaaagcgtcaaccgtcctggcatttattaacatgttacctttttctgcataattctcagctcgtcactcaagttgttattcaccttcattagctgctgtatcttggcctcagaagccactagagcgtttttgacctccataaattcctgtacagtgactggtccatctgataaatctgaatctaggctctaaaaataaattgggaaaacgttcacaatctgagatgacgagaacattaaagactaacagctcaagaatttcaaattctgaccaagccagctgaattgcaaagttagtcaaaccaaatcaaggcctctgagagtaatgcaaaactaaaacataaaagtagggtcactatactatttaaaaaatttgaaagtcagtattttctaatagaacaggcagtgaggctacacatctatgctgacaatgactgtctaaggaggtctgtcctgtcttgtaagcctttctctcgttcactcttgttttgtttttattcattctttcattaattcattcattccaacattttcattgaacattaggcagtgttctaggtgcttgggatatattagaaaagagacaaagattcctgcttccatggtgtttatattccaacagcatgagagagtatatatattgcatgattgagggtgatgagtgctgtgggaaaagataagacagagcagggtagggggctgcatgttaagcggggagctggggtaagcctgtgagtgggtgagaggtgagcagagccccaggaggtgaggggatgagtcacatgaatctggaggaagaacattccagcctgcagtggagctcagctagagggagcaggtgtgtgggatggactgggcaggaggccaggcggttgacagagggcctggtcacagagggtcttggaatgacctcggctctcactgagtgaaccaggtggcttccgggaagtctgcgcaggggtgtcccctgcatctgctaatgacgccatctttctcacagtcatgtgggccgaagaactccaaacaaatcttctataaatctgtctccccacttcaaccttccgacttattgccaagacttttctattctaccttcctattcatccattctcaaatgattgccaagcccctctgtgggtgtgtcctgggggtcagcagagggtgcacagcctggggtcctgctgccctctcccccagctcacactctggtgccgaggtctctcccacccgcaccatcctagcatgggtccttaggtggcctgcatcagctccagtatggatctctccctccactctctaacccaccagaagagtcctccccagacatggcatcctgggctctgcactgcctgtgaggcccactctcttccgtcgggtgtcatacccctcctgctgcagcttcgagtcccaacctttttaggctgtccctatgcatgaccagcttccccttagatgccctggtttcactttctttctgactcctccacatgccccaatcccaagcgtcccttgaggcgcatcttaagagctgtcctatgacacagccccacctgatgctcccagccatagattctctctctgctcactccctcagcctgtgtgtgcttcgtatgacacacatcactttgtgccttctccgcagttctctctctcctaggcaatgagagcctcacaggaaagggacgaggcctcattcaggagagtaatatccagagaagtcactcagtaaacacttgttgaatgaataaaacacaccaatcactcctcacaagttttataaagtctcaactgcagcagggctgtgatgcagggacaaggatccctattttaaaaccatttaaccttgtttcacctttgcttggcctgagctagtaacaaacccaacctcactgcacagcagctttggcagggctagccctcagctgatgcgtgcttgcccttccatgggacgcatggcctctcaccttctgccggtttgttttgcttgcagtggtttccaaatctgtgtcttcgtctgatgccacgctgtcatagtcgggctgatcgttgtcttgactctcaacgctgtgctggttattgatggttttcagtatgagctccacattgtctatcaataaaagcaaacaactttacttcaggcttaaaacattgcttttcttccaaaaaactacggagaggattttttggtttagccatttaaaggacttaaagggctgaatgctgtgctcttgcctgtaatcccagcattctaggaggccaaggaggagaactgcttgaggccaggagtttgagacctacctaggcaacacaatgagactccatccctacacaataatttaaaaattatccaggcctggtgtcacaggcctgtagtcccagctactagctactcaggaggctaagacaggaggattgcttgagcccaggagattgaggctgcagtgaaccatgactgcaccactgtactccagcctgggcatcagagtgaggccctgtctctaagagcaaaaacaaagacaaaaacaaaatgaacaaggactgaaaaaaaatgacagaaatggcaacgttatattcacaccaatacagagataacagaaaaagttttcaaccaggtggacagctacataagagactccagcattcctctcatctacctgccaaatatgggcaaattaaacagatggcttaggaaggaactgctcagataaagaaggcaggttcccaagtttctagagatagagcctagctccaggtcatgaagataaggctgtaggtaatggaagataaactgtaattctatgaatacctataacatatttacaaggtaatgtcactcaaaacagaaagcaaattgttaaactggagccagaacctaggcactcaaacaatagaagcactgggccgggcgcggtggctcacgcctgtaatcccagcactttgggaggccgaggcgggcggatcacgaggtcaggagatcgaaaccatcctggttaacatggtgaaaccccgcctctactaaaaatacaaaaagttagccgggtgtggtggcgggcgcctatagccccagctactcgggaggctgaggcaggagaatggcatgaacccgcttgcagtgagccaagatcatgccactgcactccaacctgggcgacagagcaagactccgtctcaaaaaaaaaaaaaagaatagaaacattggcatttagtcaattacctgcatctcagcgagagaaagagataaaggagaatgaatcaaacaaatacacatgtgcatgttacagggagtgtctatcccatagggagcagggattattctagaggatctaatacactttgaacaaaagatttcacaaactacccaagtctctctgatttctttcaggcaactcaaactctgacttctaatattgtttcccagagatgttgaggaaacaatggatggatgatatctgggtgatgaatggtggttatttaaaaagactaggtcctagctgggcgcaggggctcacatccgtaatcccagcactttgggaggctgaggcagatggatcacttgaggtcacgagttcgagaccagcctggccaacatggcaaaaccccatccctactaaaaatacaaaaattagctgggcgtggtggtgcacatctgtaatcccagctacttgggaggctgaggcaggagaatcgcttgaacctagaaggtggaggttgcagtgagccaagactatgccactgcactccagcatggatgacagcgagactctgtctcaaaaaaaaaaaaaataataataataataaaggatagatcctattttaactgtttaaatattttaaaacacataaatataattacagaatagtcaatatattcaatttagaaactaatgaacaagtaagataatcacttatagccattgttatttgttgatctatttctaggtttttctccgagcacttatagccacacacagtcaattcttgttatgcttggtagttatgttcttttctttttttgagacagagtctcactctgttgcccaggctggagtgcagtggcgcgatcttggctcactgcaaactccgcctcccggtttcacgccattctcctgcctcagcctcctgagtagctaagactacaagcgcccgccaccacacccagctaatttttttgtatttttttagtagagacggggtttcaccgtgttagccaggaaggtctcgatcttctgacctcgtgatctgcccacctcggcctcccaaagtgctgggattacaggtgtgagccaccgcacccagcctcttggtagttatgttctaaaaagttgctgtgacttggccaatattagatcagtgcttctggggttatcaaccaatcaatatataaccttgttctacgtgtgtttctgtttaaagataccttatttaatacatagtattgattcattaacattgaactcatggccaacggcactataaatcatgcctgaatgatgcttatttaacacacatttctccgtagggcacatcacagccttcttgcacttagaaacactagacagcacttcaggactatgcttgggggccactttttttctttttttattgagacagggtctcgctatgtcacccaggctggagtgcactggcataatcatagctcactatagcttctaactcttgggctcaagtgatcctcctgcctcagcctcctgagtatgtaggactacagacacatgccaacacacctagaaaatttttaaattttttggtaaagatggggccttgctatgttgttcaggtgtgcactttttttttttttgagatggagtctcactctgtcatccaggctggagtgcagtggcacgatctcagctcactgcatcctccacctcctgggttcaagtgattctcctgcctcagcctcctgagtaactgggattacaggcacgcgtcaccatgcctggctaatttttcttgtatttttagtagagacagagtttcaccatgttggtcaggctggtctcgaactcctgacctcgtgatcagcccacctcagcctcccaaagtgctaggattacaggcgtgagccactgcgtctggccaaggagacacttttgagatagggtcacccatgctagggtgcagacgtgatcatggctcactgcagcctcaatctcctgggcactcaattgatcctgggcggtagggggccattttaaaacagtgaaatgaccaatgaaaagcacacaaatatgactaacatggcactaaatagaccacagacacttgtttatagcatgagtgcagaaacaagaagtcaaggagtctcctccctgttcaatctcagctggaaacatgtgcttttggtgactcaatttttttctctgctctgtacatttcttacaatgaccttgaaaatgctgtattaattttgaggtcacaaattttagcaagtagatgaatttgtaaatatgggatgtgcacatgaggatcaattgtgtatttatatttacatgtggtatactcacttgtacacacatatttacataaatatgttttccttacaaaactggggttatacaaaaccttttaaaaactttattatttggccaggtatggtggctcatgcctgtaatcccagcactttgggaggctgaggtgggcagatcgcttaaggctgggaattcgagaatagcctggccaacatggagaaaccccgtctctactaaaaaatacaaaaattagctgggtgtggtggtgcacacctgtaatcccagctactcaggaggctaaggcacaagaatcacttgagcctgggtggcagaggttgcagtgagccaagatcgcgccactgcactccagcctgggcgacagagtgagactcgtctcaaaaaaaaaaaaacaaaacaaaatcaaactttattactttgtctcatataattactactatagtataaatgtttcttccctccaaatctcatgttgaaatgtgatcctcagtgttggaggggaggactaaagggaggtgtttgggtcatgggggtggatcctttatgaactgatcaatgccctccctttgtagtgagttctcgctctattagttcctgctaggacctggttattgaaaagagcctggcacctccctcctcgctctcttgcttcctctctcaccgtgtgatctctgcacatgtagcaccccttcaccttccatgagtggaagcagcctgaggttctcaccagatgcccaatcctccagtcagcagaatcattagccaaataaaccttttttctttacgaactacccagtctcaggtattcttttatagccacacaaaagggactaagacaattacatattcttttaaaaaaagataagtatgtatttttttttttttttgagacggagtcttgctctgtcgcccaggctagagtgcagtggtgcgatcttggctcactgcaagctccacctcccgggttcacgccattctcctgcctcagcctcccgagtagctgggaccacaggcgtctgccaccatgcccagctaattttttatatttttagtagagacaggatttcaccgtgttagccaggatggtctcgatctcctgaactcgtgatccgcctgccttggcctcccaaagtgcagcatgtactattttaaaatgtgactaattgttcctctttattacttagttgcttctaatgtttgtgttgttctacatataacatctctgatgatttcccttcagttaatacctaagagtggaattatcaaatcaaagagcaggtattttttaagactttgttttttaagttaaaaatttttttttttttgaaaaggagtattgctctgtcactcaggctggagtgcagtggcacaatcttggctcactgcaagctctgcctcccaggttcacgccattctcctgcctcagcctcctgagtagctgggactataggtacccaccaccatgcctggctaattttttgtagttttagtagagacggggtttcaccatgttagccaagatggtctcaatctcctgacctcgtgatctgcccacctcagcctcccaaagtgctgggattacaggtgtgagccaccgtgcctggcccccaatttttttttttgagacagagtctcactctgttgctcaggttagagtgcagtggtgtgatctcggctcactacaacctctgtctcccaggttcacgcaattctcctgcctcagtctcctgagtagctgggattatacgcgcgtaccaccacgcccagctaatttttttgtatttttagtagagatgggtttcaccatgttggccaggctgatctcaaactcctgacctcaaatgatctgtccgcctcagcctctcaaagtgctgggattacaggcgtaaggcaccacgcccaggccattttaagactttaaacttatccaaagactcttgtcactgtgccttcaccaaaatttaataaaccttttcagaacttccttattcctggttgaacagataaaatcaaattcctgaacaggaaagaagaatgaatgagttgttgtcagttaatgattactgtctttggggaatgtgatactgactgaaaacttaatttttatggtacatatttcttttgcttaaatgacttacaatgaaaaacgtctaatttctataattagaaaaaaccaatatggatacagtaatagggctggagaggaaggacattcctaagcatgcagacaggacctgggctactgaactagactcaacagggcactggtgaaacagatgctcagagctctccttataattgtatatcacagtaattctcactgaagacatttaaagtttatggcaacaaattttaattatgttgaactcagttttgtaggtaagcaacagcagatattatgcagtttcaatcaggaagagtttttcttttccgtttttttttttttttgaaacagagtcttgctctgtcactcaggctggagtgcagtggtgcaatctcggctcactgcaacctccgcctcccaggttcaagtgattctcctgcctcagcctcctgggtagctgggattacaggcgcccgccaccatgccttgctaatttttgtatttttagtagagaggtggtttcaccatgttggccaggctggtctcgaactcctgacgttaggtgatccacctgcctcggcctcccaaagtgctggtattacaggtgtgagccaccacgcccggccaagaagagtttattttcttatgtcctttaacaagatctaagccagagttttgggttaatttcaggatgcaattttacagggtaggttaagtgtcccaaaacaaaacagaaatcatatataagataaatatgtgtagcagttaataactctgaaatattgttaattcaccagggctcagacaggtaaactatttatcacaatatactaccaataaaacttacagtgggtggggctgaggggagggaacctagaggacaggtcaataggtgcagcaaaccaccatggcacacgtatacctacgtaacaagcctgcacattctgcacaggtatcccggaacttaaagtaaaaaaacaaacaaaaaaccaaaaacctatagaactgtcatgttgatgactgctttaattagtttataactttaacacctgagtcaaatttagagggccaaaaaatgcaagtgtttggaggtttgagcagttaccttttgaacccgagagagaactgccctgctgtctcctcttggcgtcactgagaatgtcaatgaccagcgtggcaaactcatgggcgttgaaccgagctaacttctgtctgccctaaaggtgggaaaataattggaaatatttcccagtgtaaaaatatatacataaatagtcacataaaactagtcagactattgacagacttctgcaaatactttcttctggcatgatcaaagtacaattaatcccagccataatcaaaccaagttaatgcttgttttccatatgaacagtttaaaaccatttatataagagaatttcataacaaatgttatggcatttctcacatatgcattgttctcacaatgcaggtctattttggtaagcaaaaataaaatgggtctactgaatgcttttcttctattaatgcttcagtttggaagtagacccagtaataataaattaattttgaggggaatttttaaattttaagtttaggccgggtgcagtggctcacgcctgtaatcccagaaccttgggaggctgaggcgggaggatcacttgaggtcaggactttgtacaaaaattagccaggcatggtggcgggtgcctgtaatcctagctacttggggaggctgaggcaagagaatcgcttgggtccgggaggtggaggttgcagtgagctgagatggtgccactgcactctagcctggacaacagagcaagactccgtctcaaaagaaaaaaaaaatttaagttaaacaaaatcatagtctagatattccctatccttatatatagctgctaattataaagactaaaacaccttcataattcattcaacatttctcctcttgatggatgtgttagctgtttttaatgctctattgtatacaatggtgctttgatgaaaatcacgtgcataaatctatttttattttattagagcatattctcaaatgagaaattcccatgtaaaaggatgtacttaattttgaggcttctgaaactggtaaacaaattgcttttctaacatctacagcaatttaaagttctatctgttgcaagagaaagctcagcttaccacatccttaccagtttggagtatcctttattatatattttattaatttgactgataaaacttgcactaatgcttttaagttgctttcttagattactgacaaggttaaacatttcttcacatttgtaagccatttatatttcttctgtgaattgtttcatattctttcccagtcatttatttatagtctattgtttttcttatcaatttgggggttgtgtgtgtatatatgtataaaggatattaaattttaatcaatcaaaacatttagaatagttttcctgggaaaaatgaaacatgacatcagccattccccaactactattcctttccaaactgagccacttgcctgatttcgtgttgatgagtactcaggattgaccggaagaaaggggacgaccgttgtctcggttaccagggcgctgtggttttgcgtggcaagccagactagtcagaggaaagagccagagacaaacctcatcacgcctgtgtgccactgctcctgggaggcacagctcacgcactacgaggggaaacacactctgaagccaacacacgcaaaggcaaacgtcgacactcgcaccatcaggacagcagaaattggactagtaaaacactgagcctggcagcttttcactgcccactgataacagaagcttattagataaagccacgtcaagtcacctgcatccgtctctcgcctgtcaacttcatcgtacacatccatggcaagttcttcaaacaaatgattacttagctgaaaataaaaaatatcaggaacacaagggacaatgattaatgccaggaggacaagagggaactgcgacttagtcacccttttattgcctacgtcttatccaatgccagtgcttggtacatacccactgttaaacagacataacattttcaaaatcgtacagggcctctagaaatgtctgccaaccacagcaatttcactactttatgacacagacagagctgctgctattaaggagctaagaggcatctaaagtgcatcatctcagaagtaggttccagttctctactcttcttgtgatatcatcctgtaagcctccttttctgcacttaaaagtgcttatcagttccccaaagtataagggaacctataaccttgcaaaaacagccaggctcagtggtgcacacctataatcccagcactttgggagactgaggcaggtggattgcttaagcccaggagttcgagaccagcctgggcaacatggtgaaaccctgcctctacagaaaatacaaaaactagctgggcgtggtggtgcacacttgtagtgccaactactcaggaggctgaggcaggaggatcacttcagcccaggatatcaaggctgcagtgagccaagatcacaccactgcactccaggctgggtgacagagtgagaccctatctcaaaaaagaaaaaagaaaagcaaaagacatgctgttttgagaggataaaatgtgcccttgcacaaaaacgtgactcagacctcagctgagtttctttgctctctttctcagtagcagtcctactgcttcagtctccagaaggaagcttcctaccaaagcacagcctgactcttcagcacacaacaaccacctcacagcctgcagtgcctccctgggcacatggaggataattgaggtcttcctggcccagatgaggttaagcctcttctggggtggctccgcctctctctgcactttctgcctcatgcaacaccttgacacgtggtagttgtgactcttaaactgtctgacatctgctttgggagggcagatgctgaatctgttatattccctattgggttccttacatccacacatggtacctcacactttaaaagtggccagaaaagaggcactggctggccagaagggatttaatgcagcaatttaaaatgctggctacaggctgggtgtggtggctcatgcctataatcccaacactttgggaggcagaggcaggaagatcactcacttgagcctgggagttcaaggctgcagtgagccacgatggcaccactgcacgccagcctgggtgacggagtgagaccttgtctcgaaaaaaaaagaaaaaacaagtgctggttacagagacctcataggaacatgttaaaatgggtaccatatattactgagtgaaaaaagcaggttataaacgtctacaattatgattaagttccagttttaaaaaaagatatgcatataaaacaagaactgaaagaaatgtaccaaaatattgagcctgactccattaagagtatagcaatgaggatggtcccctttctctattttccaaatcttcccaaatgtggtcgcactataattaaaaacaaacccagagagcctgttgctagacaagatgttgaaggattgggagcttgactttgcttcataaatatctagtttcttcctccatgggactacaagctaatgttattattactagcaacaactacaatggccaacgctgattatgggcttatatcccaggcactgtgctaacagtatcatatttcacttataacacctctatgaaaacaggaactactattgtcccatttttaagacaagaaaactgaggcagagaagatagtagcttgcctaaagtcacaaagctagtgacagacctgagatccaagtttacatctttgaaaatgctaacatttactcattcaaggaatacattagcctttgttatatttctctcagttcttcatcaggagggagggaaggaaaagagaaaggaaagaaaggatgaagggaggaagagagggaggacaggaggaagatactggaggataaacactgacctggcgctgataagatggtcacctatgagaaggagaccacagggtgagggtcaacaagtaatggggcagcccactctgagcagttctggccggcagcccctgcaggatccttatctccctcttctatgagaggatgccaaggcacagggaggctaggaagcttggcagggctgagatatgtactgaccagtctgactcagagctgcagctctggagagctatactagactctgttccaggtctttacttcatgcctgccacgtgctagagatattacaagcataatctcagctttcatgcagcttccagtgaagcaaatgtaggatagtctaagaaaacgtgggtttttatctaggtttgaattatttataataaaatttacttacagattgtgagtaattaaaaggaaatcacacaatatttagtgctatctgactccaaagcttatcatcttgatcatcttagtttacaacttccttaaggcaataaaacacacagacacacaaaactgtagatacagaacacagagacaccaaacaaattgcataaaacacatttatttcataatacagttaaatactagtaaggataaattcatttaatgtaatatttaatactgagtattatatgaagttttagtaaagggtcttctgtgaaaacagaaatgaggagaaagtcataaatgagggaagctgcaatgtcagagtcaggctttgggaaagccgctacctacactggtcagatttcaggtccttgaatcagagagatggaagctgggaaaggcaaacgctgtaggcaaagcaggattcctggaagaggacttgaatgtgcagctcatggcctcagagggtgttaatctaaagacacacacacacacacacacacacacacacacacacacacacacacacacacacacggaaccagatgggaagcagggcaatctctgaaaggtgagagctgaatgatgcccttacaggttacaaaaagaagttaagaatcttggttctgatccaaagagcaatgggaacagctgaggagtatactttggtggttaaagtggagagaagtgccccggtgaggcttcatgtgagagaactagacaaagagaagtcaatcccagagaagtagatttcccagggccttgaggccttgggcccttaggcctttcctaaggctgaggtgggcagtctggaagaaagacacaggctaaagggaggttgtggcacagagccggcaaactctgagcacgcacatgggccaagaccaccagcttttaacagcagaaatttaaaaagcactgatgaatggcatgggatgggaaagaggtttacaatatggctggatccaaatggcagccagtgaatctatgggactcgccaccatttcagcatcagcatttaccagctctagaaccctacatggctaagtcaccccaagaacgcgtgccctacttactcatgacactgagaggaactagggaactctcctgaggagaacaactgcctaatgccaaaggtgccatctgcacttgttacatgatagagaaaaatgagattatctgaagcagaaccaatgaactgaatatactgaacttaatagtccttgtggtcatcactgctgtatactcaacagtctgcttctagtttaacaaataaaagtatgaaataaagtcatcagacgcaataggtaacctgcattcagagtaggtatcagcagggtgcactgattctcatactagagaaaaccagtacagagaaatactcacagattgaagtttcttcttagcagcttttgccaattcagacaaatccaggctgctaagaaaacatacaaagctaataagcaaataaataaagccagacttgtgaactctgtaaagtttaagacacccaagagataaaaatattaattacagttcatggaccatgttagaaccaagcattctacagcccagtagagtcagtgaggagctctaaacagaacaatctggtgaaagtaactccttctgaaataccacaatcatgtaagtgttaaagaggaaaaaaaaatcgtccaccaactaaacgacaaaagctattgccaggttaccttccaggcccttatgtgaggagtcacaatttttgaagtattaaaaaaaaagcatgatataagaaaatatgtcgggctcgatggctcccgcctataatcccagcacgttgggaggccgaggtgggaggatcacaaggtcagggttgtttttttttttttttttttgagatggagtctcactctgtcacccaggctggagtgcagtggcgcaatctcagctcactgcaatctctgccaccagggtttaagcaattctcctgcctcagcctccagagtagctgggattacaggcacacgccactgtgcctggctaatttttgtatttttagtagagacagggtttcaccatcttggccaggctggtctcgaactcctgacctcgtgatccacccgcctcggcctctcaaagtgctgggattacaggtgtgagccactgccctggcgaggtcaggggtttgagaccagcctggccaacatggtgaaaccccatctctactaaaattacaaaaaattagcctggtgtggtggcacacacccatagtcccagcaactcgggaggcggagacaggagaattgcttgaacctgggaggtggaggttgccctaagcctagactgcaccattgcactccagtctgggcgacagagcaagactctgtctcaaaaaaaaaaaaaaaaaaaaagaaagaaaagaaaatacaaggccagatatagttgctcatagggaggccagggcaggtggattgcttgagtcccggagtttgcaaccagcctgggtaacagagcaagaccctgtctctaccaaagcaaaaaaaaacaaaacaaaacaaaacaaaaagggaagatgtaaaagatcaggatggcaagattatatctggaatagcagttagtcatttcataaactcttgacagtttccgtgcaaaggtaacttgcaaaacaagggtttaaggatcattcctgtagcaatgaactcatctgctcttatagaccaggggtcagaaaaattatggccttctttttgttcagttgagctaggaatggtttttacgttttaaaatgtttgggggcaaaaagaaaaaacaatatttcataacgtgaaaactatttgaaattcaaatttcagtgtccagaaataaaatttcactggaatagacacacccattcatttatagagtgtccacagatgctttcatctacaacagtagagttaagctgttgcgaaagcggccatattacccacaaagtctaaaatatttattaattggcccttgagaagaaaagtctgccaacccctgtcatagataatgtaatctcctataatacagaagtattctgtaaataaataaatacaaaatactgtcacaactggctaaaacagtgacaatatcactggtttcaattttcctattagtaaaattgctacttgtgctctttgaaacttaagttttatatagtggtttacttacagccgtcttatttccaaatggtatagccataaaagagaaaaatgtatgggctttgttaaacacaaaatataatatacttaaacataatacaaccaaggaaatattagcgatagacaaaactaactggtatttcaatgagcttacctgtctgccatttgaggtattataaagtgctgtccatttttgtgatctgaaacagaaaccaagtcaaagttttgttcatagaaatgttgataagatctgtaaaggaacatcaccattatttcctcaaactaagttttgcgattagtatttgtgcataatgacgagtcatgttgctagactagctaaaaattcctgaagacccagctagtagtaaggctcatagccttgtttttttctggtacaaaggtccaggcatcatttagcagaaacctatgctcaccccaatcacgacgattagtttgccctcagtgtaactgacgatctttggccatggaaagtgtgctgagggagctgaatcagctcacagcaggtgtccatcagcccacggtgtgggacagtggatgagctctaggtcttgctcaaatgaatctattagtataaaacagctagggctgggacaggtggcctttgcagatccagacagggactccatctgcaaggaagcttactgactcagccctaatctagctcctggagaacactgatccatgtgccaatgaataacgccactatcagcactcctatgtaggtttttctttaacataagtctatctttcttctgggtaaagacccaggagtagaaatgctgggttatatggtaaatgtatgtttaacttggtaagaaactgccagaccttttcccttgagtagcgctatcactttgttttccaaacagcaatgtgagagttacagttgcttcctgtctttcccagcacctgtactttcagtttttgtttttaaaagtttaatcattctaataggtatgctgtggcatctcattgtgctaatgactaatcatgccacgcttgtcttcatgtgatttttttttttgccatcccatatcttgtctttgcccagtttttattgggttgttttcttactgttgagttttaattttaattaattaacttatttatttatttgagacagagtttcactcttgttgcccaggctggagtgcaatggcgcaatctcggctcaccgcaacctccgcctcctgggttcaagcgattcttctgcctcagcttcctgagtagctgggattacaggcatgcgccaccacgcccaactaattttgttttttcagtaaagatggggtttctccacgttggtcaggctggtcttgaactcctgacctcaggtgatctgcctgcgtcggcctcccaaagtgctgggattacaggtgtgagccactgtgcccagcttatttatttattttgagtcagggtctcactctgccccccatggctggagtgcagtggcgtggatctcggctcactggcaacctccacctcctgggttcaagcgattctcatgcctcagccacctgagtagccaggactacaggcgtgcactgctacacccggctaatttttttatatttttagtagaaacagggtttcgccacattgcctaggctggtctcaaactcctgggctcaggtaatccacctgcctaagcctcccaacgtgctgagattacaggcgtgagccaccgtgctcggcctgagtttttaaaattctttgaatattctaaatatgagtaatttgctggatatgtgatttccaaatacctgtatttttctcccagtctgttgctggtcttttcactttcttaactagttttctcagaacaaaacttttccttttttttttttttttttttttgagatggagttttgttcttgttgcccaggctagagtgcaatggtgcaatattggctcattgcaacctctgcctcccgggttcaagcaattctcctgcctcagcctcccaagtagctgggattacaggcatgcaccaccatgcctggctaactttttgtatttagtagagatgcagtttcaccatgttagtcaggttggtcttgaacttcagacctctggtgatccacctgccttggcctcccaaagtgctgggattacaggtgtgagccactgcacctggccaaaaattttcaattttgatgaagtataatttatcaatattttcttttatgcattgagttttggtgttatatttaagaggtttctttttcccccttgcagaggcaatgtcttgctctgtcacccaggctggagtacagtggcatagtcatagctcactgcagcctcgacttcctgggctcaagtgatcctcctacttcggcctcccaaagtactaggattacaggcgtgagccaccatactcagctgatagctaaaagctttcatccaagatcacaaagattttctcttatgttttctttttttttttgagacgcggtctcactctgtcgcccaggctggagtgcagtggtgtgatctcggttcgctataacctccgcttcctggattcaagcgattctcctgccttagcctcctgagtagctgggactacaggcattcaccaccatgcctggctaatttttgtatttttagtagagacggggtttcactatgttggccaggctagcctcaaactcctgacctcaggtgatccacccgccttgacctcccagagtgctggcattacaggcatgagccaccgtgcccggacctcttacattttcttctagaagttttacagtgtcaggttttacatttagatctatgatcctttctagtttcggggtaaggtgtgaggtttaggttgaagttcactttcctgcacatggatgtccggttgtcccaatgcattaaaaagaatatcctggggcgggtgcagtggctcatgcctgtaatcccagcactttgggaggccgatgcgggcagttcacgaggtcaggcgaccaacaccatcctgactaacacggtgaaaccccatctctactaaaaatacaaaaaattacctgggtgtggtagagtgcgcctgtagtcccagctgctcgggaggctgaggcagaagaatcacttgaacccgggaggccgaggttgcagtgagccaagatcccaccactgcactccagcctgggtgacagagcaagactccgtcttaaaaaaacagaaaacaacaacaacaacaaaaaactatccttcctccaccactgaactgattacctttgcacttttgacaaaaatcaattgaacatatttgtgtggatctatctctggattctctatactgtttcaatggtctatatgtctatctcttcatagatatcacagtcttgagaactgtacagcttcatagcaattctgaaaaattgggtgctgtacttccttccacattattcttctgcaaaattgtctgggctactctagttccttcacccttccatttgaatttttaaattattattattatttttggaaatgaggtctcactctgttgccaaggctagagtgcagtggcacgatcatggctcactgcagcctcaacctcctgggctcaggtgatcttcccacatcagcctcctgagtaggtgagaccacaggcatgcaccatcacacatggctaatttattatttgtagagatgaggtctcaccatgctgcccaggatagtctcaaactcctgggctcaagtagtcctcccgccgtggcctcccaaagtgctgggattacaggcgtaagccactatacctggcctccatttgaattttaaaatcagcatgtctatgtctaataaaaaatcctcaattgaagtaaatttatacatttattaacttgtggagaattgacatgttattgagtcttcatatccataagcacagtacatctctccacttattcaggtcttcattgatttctttcatcagcagtttttggcatatagatactacatgtattgtgtatttcattagatttatacctaagtatttaatttggagctttttaatttttttgagacagagtcccactctgtcgctcaggctggagtgcagtggcaagatctcaggctcactgcaacctctacctcacaggttcaagcgattctcctaactcagcctcccgaatagctgggactacaggcgcccaccaccatgcccagctaatttttgtatttttagtagagacagggcttccccatgttaaccaggctggtatcgaactcgacctcaggtgacccacccccttctgcctcccaaagtgctgggattataggtgtgagccactgtgcccagccaatttggagcttttattactggtattgcttttctagattcagtttccaattgctcactgctagtctaaagaaatgtgatggatttttggcagggtgcggtggctcacacctgtaatcccagcactttgggaggccaaggtgggtggatcacctgaggtcaggagttccagagcagcctggccaacatggcgaaaccctgtctctactgaaaatacaaaaaattagccaggcatggtggggggcacctgtaatctcagctacatgggaggctgaggcaggagaattgcttgaacccgggaggcggaggttgcagtgagccgagatcacaccactgcactccagcctgggtgacagagcaagactatctcaaaaaaaagggaaaaaaaaatatatatatatatatggatttttggctgttgaccttgtattcttgcaatcttgtttaactcaaggttctggaaacctttttgtaggttccttgtgattttctacatagaaatcatctcatttgaatggggacagtttgatttcttccttttcaatctgtatgccttttatttatttttcttgcctcttggcactggttaggatttccagtgtgatgtagaagagaaatggtaagagtggacaccctagtctttctcccaatttgaaagcaaacacagtctttcatcattaaatagatactgtttatcagatcaaggaagtctcatctattcctagtttgctaagagtttttttaaaacatgaatggatgttgaagtttgttgaatgcttcttctgcatcaactgatatgattacatagtttttcgtttttactgttaacttgatagattacattaactgatttttttttttttttgagacacagtctcgctctgtcgcccaggcaggtgagcaatggcgcaatctcagctcactgcaacctctgcttcccgggttctaagtgattctcctgcctcagcctcccaagtagctacatgcatgcaccaccatgcccagttaattttgtatttttagtagagacggggtttcaccatgttggccaggctggtctcaaactcccgacctcaggtgatccacccaccttggcctcccaaagtgttgggattacaggcgtgagccactgcacctggcctgattttcaaatattaaatcagtcttgcctatctggaaatcccacttggttatgttgcatttttctctatttttttttgagacagggtctcactctgtcacccagactagagtacagtggtgcgaacacagctcactgtagccttgacctcctgggctcaagcaatcctctcacctcagcctccagagtaactgggactacaggcacgtgccatcaggctaggctgatttttttgttgttgcagttttgtagatggggtcttgctatgttgcccaggctggtcgcaaactcttggcctcaaacaatcctcctacttcggcctttcaaagtgttgtgattaccactgtgagccactatgcctggtctgtattactattattattattgttattattagagatggagtctgactctgtcacccaggctggagtgcagttgcacaatctcagctcactgcaacctctgcctcccaggtttaagcgattttcctgcctcagcctcccaagtagctgggataacaggcgcccaccatcatgcccagctaatttttgtatttttagtagagacggagtttcaccatgttggccaggctggtctctaactccccacctcaaatgatctatctgcctcagcctcccaaagtgctgggattacaggcatgagccatcgcgcccggtctgctttgtatttttttttaattatccttccatgtctgtggggtttatagtgacaactccatctgtacactctcctttttgtcagtattgccagacatttatgagttttactaatccttctgaaaaaccagctttggtttcattgatttttcgctactgtttccttctttcagtttcattgatttttcgctactgtttccttctttcagtttcattgatttctgctctttactatttgctgccttctgtttggttcaggtttattttgctctttttttttttaaagtttcttaagggaggagcttatattaataatttgaggctaggcgcggtgtctcacgcctgtaatcccagcactttgggaggctgaggcaggcagatcatttgaggtggggagttagagaccagcctggccaacatggtaaaactccatctctactaaaaatacaaaaatgtgccaggcatggtgctgcatgcctataatcccagttcctcaggaggctgaggcaggagaatcacttgaacctgggagggggaggttgcagtgagccaagatcacatcactgcactccagcctgggtgacagagcaagacaccatctcaaaaaataatgatgagaatgatttgagacctttcttcttttctaaggtaagaatttaatactataaagtttcctctaagcattgctttggctgcatcccagaaattctgatatgctgcattttcattttcattcagtggaaaatattttttcccttaagacttcctcttagatcgatggattagttagaagtgtgttgttcagggccgggcacggtggctcacacctgtaatctcagcactgtgggaggctaaggtgggtggatcacctgaggccaggagttggagaccagcctggtcaacatggtgaaaccccatctctactaaaaatacaaaaattagctgggtgtggtagcacgtgcctgtaatcccagtactagggaggctgagacaggagaattgcttgaacccaggaggcagaggttgcagcgagccaagattgcgccactgcactccagcctgggcaacagcgcgaggctctgtttccaaaaaaaagcagcatgttgttcaacttccaagcacttgggtattctccagttttatttgtattacctatctgtagcttaatactattatggtctgaaaatatactttatagaattttaattcttttagattagctaaggtttgtcttatgacccaggatatggtctatctgggtgtatgttcaatatgtacttgaaaagaatgtgtattctaatgttgtcaggtagaagagtctataaacatcaactagatctagttgggttttggtctggtttagttctatatccttactgattttctatctactagttctatctattactaaaagatgagtgtagagtctccaacaataattgtagatttgaccttctctccttttagttctatcaaagtttgcttcatgtattttgaaggtctgttgctggatgtgtacacatttagaactattatgccttcttgatgaattgactcatttatgataatattatgtccctctctatccgtgctaatattccctcctctgaagtctactttgtctgatattaatatagccaccctagctttcttttcctgagcctttacatggtatatctttttatacttttggtttttaacttattacctatattgttatatttaaaatgggtttcttgtagacagtatatattaggccttatggttttttgtttatttcttgaggcagggtcttgctctgttgcccaggctggagagcagtggcatgatcagcactcactgcagacttgacctcctgagctcaagtgatcctcccacctcagcccctcctgagtagctgagactatgggcatgcaccaccatgcctggctgctttctataaaattttttgtagtgaaaggatcttgctctgttgcttgggctggtctcaaactcctatgcttaagcgattaggagaattgcttcaggctccctgaagtgttgggattacaggtgtgagccatagctcccagccccttttgttttttaatccattctgagaatctctgcttttcattgatgtgtttgggtcattaacatttaatgtaactattgatatgtacggacttaagtctataatgttattatttattttctatttggtccttagttttttgttctccccctcctcttttgaatattttgaatcaaaatatcttttgatgatttgagtaatttttaatactccattttcatttacctctagcatttttgatcacatatctttgtagtctttttttttttttttttttagatggagtctcactctatcacccaggctggagtgcagtggcatgatctcggctcactgcaacctctgcctcccgggttcaagcaattctcctgcctcaccctcccaagtagctaggactacaggcacgtaccaccatgcctagctaatttttgtatttttagaagagacagggtttcaccatgttggccaggatggtctcaatctcttgacctcatgatctgcccacctcagcctcccaaagtgctgggattacaggcactacaccgtgcctggcttgtagtcttctttcagtggttatggtagaaattactatacacacacacacacacaaacacacacacacacaacttttcacagtctacttagaaatcctattttacatttccagtagaaggtagaaatcttaccattatattttttaccctatccccttttatattatagttgtcaaatatattacactgatatatgctgaaaaccctactagataatttttttttttttttttttgagacggagtctcactctgtcgcccaggttggagtgcagtggtgcaatctcagctcactacaagctccgcctcccgggttcacgccatcctcctgcctcagcctcccgagtagctgggactacaggcgcccaccaccacgcccggctaattttttgtatttgtagtagagacggggtttcatcgtgttagccaggatggttttgatctcctgacctcgtgatctgcccacctcggcctcccaaagtgctgggattacgggcgtgagccaccgcgcctggcgttttcttttctttttttttttttttgagatggagtctccctgtcgcccaggcaggagtgcagtggcacgatctcggctcactgtaacctttgcctcctaggttcaagtggttctcctgcctcagcctcctgagtagctgggtttacaggcatgtaccaccatgcccggttaatttttgtagttttagtagagacagggtttcaccatgttggtcaggctggtctcaaactcctgatgtcaggtgatccgcctgcctcggcctgccaaagtgctgggattacaggcttgagctactgcacctggctgacaatgttacagctttaagatatgtatgacaatttcaactttttgtttgtttcttgagacagggtcttactctgccacatctttaacatttctgttgtttttctttcattcctaaagttccaagattccctctggcatcatttcccttccacccaaagaactttctctagcatttctgttaaagtaaagaataattcttttttttcctgttagaatgtccttattttgccttcattccaaagttattttcattggatatagagttctgggttcacagctcttttcttttagcactttaaaagtattgtttctaccatcacaaagaagatgagaaaaaataataataataaaaaaggagcagtggctcatgcctgtaatcgggaggcccaggtgggtggattacttgagctcaggaattcaagaccagcctgggcaacatggtgaaaccccatctctacaaaaaatacaaaagttatctgggcacagtggcacacacctgtagtcccagctactgtggatgctgaggtgggaggatcacttgagctcaagaggttgaggtttcagtgagtcgagatcacgccactgcactccagcctaggcgatggagtgagaccctgtctcaaaataataataataataaaagtattattctggctgggtgaggtggctcatgcctgcagtcccagccctttgggaagccgaggtgggcggatcacgaggtcgggagttcgagaccaacctggccaacatggtgaaaccccatctctactaaatatgcaaaaattagccgggcatggtggcaggcacgtgtaatcccagctactcaggaggctgaggcaagagaatcgcttgaacctgggaggcggaggtttcagtgagccaagattgcaccactgcactccagcctgggcaacagagagatactccatctcaaacaaacaaagtattatttcatttccttctcatctctatggtttctgataagaaatccacaatcattcaaatcactgtttttctatatatgttatgtgtcactttttcctggctgctttcaagatgttttcttcaactttagttttcaacagtttgattttgatgtgtctcaactgtggatttgagtttatcttctttggaattttctaagtttcttgaatctgtaagtttatgtctttcaccaaatttagaggttttttttttttttttttttttttgagacggagtttcgctctgttgcccaggttggagtgcagtggctcaatctggactcactgcaacctctacctcccaggttcaagtgattcttgtgcctcagctacctgagtagctgggattacaggtgcgcaccaacatgcccggctactttttgtatctttagtagagatggggtttcaccatgttggccaggctggtctcaaactcccaacctcaaatgatctgcccgcctcagcctcccaaagtgctgggattacaggtgtgagccattgagcctgtcccaaatttagagggtttttttggccaatatttcttcaaatacgttttctgcacacaccactctttctcatctcttattgggaatccaacgacataaatgtcagacattttagtattttcccacaggtccctgagactctgttcagtcttttcttcctactcttttttcctctctgttgcttaaaccagataatttctagtgatctgttttcaattcattgactttctttgtcatctctattcttctattaagcccatccagtaagttttaaatttttagtgtttgtatttttcagttctaatattcctatttggttctcttctgtatcttctatttctctgatgggactttctatattcctgtttgtttcaagaatgtttgcttttacttcttatagcatggtcttactagctgctttaaaatctttgtctgataacgccaacatttgtgtcatcttggggttggcatctgttggctgccttccctggcaagtacatgagaattactcagatgtcaagtcattatggatgatatcctagacactgtgaatgttttgttatgagactctgggccttctttaaactttatgcaaaaatgttcatatttttgtcttagcaggcaactgaccaggtgaggttctgcctcctgggcagatggtgagagaatagagagaaaaagacaagcaatcaggatcccccctcatccccttgctcagagatttaggaacctgtgctgccactgctgctgctgctattgcagccacaggcttgcctaggggctggatgggagagatcagaaaaaggaaggaggaggaggaaaaaaccccaggggaatccccttcctctctgtcctgtagaagtcccatttcctgctctttaaccagaaaaaggctttttttttttttttttttttgagatggagtctcattctgtcacccaggctggagtgcagtggcgcaatcttggctcactgcaacctctgcctcctgggttcaagcaattctgcctcagcctcccgagtagctgggactataggcgcctgccaccatgcccagctaatttttttgtatttttagtagagacagggtttcaccatgttggccaggatgatctggatctcctgacctcatgatccgcccacctcagcctcccaaagtgctgggattacaggcgtgagccaccgcaccccgcagaaaaaggcttttttgcactcattatgtacctccaggtttcaggctgtcattgaagtcctatcagaagtaagacaaacaggacactcaccaccagctgatgacacttttgagttccctaatctaccaaccaggatttacttttcagagtctttagctagctactccaagcatttggtccaggtctgttagttctattttgcaggagacacggtggggtgtgcttactccatctcacccagaactgaaactataccagaggctcttaactctatcatacaaccaggatggagaatcactgcatacatgtatgtgaatgttgtacatcaggggttggccaatattttctttaaagggccaaatagtaaatattttaggctttgtggccatctggcctgttgcaacgacttaacctattcaactctgctgttgttatgtgaaagcagccatacacaaggtataaataattgggcgcggctttcttgcaataaaactttattcatttattttttagagagttgggggtcttgctttgtcactgcacccaggctggagtgcagtggcacaatcatagctcactgccaccctgaattcctgggctcaagtcccagtctcccaagtacgtgggactacaggcgcacaccaccatgcctggctgattttttaaaaaacttttttgtggagacggagtctcacccctcttgcccaggctactttcgaattcctaggtgcaagcagtctttctgcctcggcctcccaaagtgctaggattacagacatgacccgttgcacccggcagaagctttatttatttatttatttatttttatttatttattttgagacagagtctgactctgtcacctaggctgaagtgcagtggcacgatacaaaactttgtttaataaaacaagtaactggctagatttgggctacaaaccatggtttgctgacccctgttccctatcacaaatagccaagttggctttggcaaagtttacttctggactttttttccattccttaagaagaatttttcaaataactacaaaggttattgctttgctcctacattcctagtcccaccatgttcaagaactgtggtacccattcaattttgctttgattattcagtctgattcttgaaatagtcatttctctagagctattaaaaatgaaaaatctaaggagttttgtccaactttatatcttttacatgtaactgacaattctgtagttatcctttcaaattaaaagccatatgtatagctttctcagtgatatgttacagcagaggaggtaataacaaatagtgtcccaacttgtttttctagaaccttcccaactggagatgtgaaacggtcattctccatccactcacctggtttcctgccacagagatagaaggctagtctgtccgttagctcatactgtatttccacgaggcgctctgccagctcatggtgccctccttgcctaccaagagaaaacaaagtaccatttatattgctcactattcactgactttaaaatggagtacaaagacgtctcctgagacacctgagcagtttatcacacaagacttttgagaatcatcaaccttcttgtggtaggtagatttctgaagtctactttgcatcccacttttataaactgttttcaccatctgaactatcgcctttcctttattaaggccaaaatagaatatttaataagaaattcaaagacttatgagagggaaggatacagaatgacttaatttaatgaggtaaaaaaatgaaattaatcaatggtttacggtagaagttctcaaaaattaactagcgcatttctagaaatataccatgtgcaggccccacccttggaaattctgaatcaatggggacaggatggggccaggggccaatatgttgaagaaggtccttcccctaggtgatgctgatgcagccagtctgactctggataagagtctagtaaccacttcaaaggcttcaaatcagtgagagacacgccaacctaacgcacagctcacgcctgcagctacttctgcctccttatcttcaatttgcacaacagaaaatattaagtttacctttcaacatccatgaaataaatacttaggctgcttagaatcctttcagcaacaaggatacaaattatattgagattattatatgcaaggtacaagtgcgaaaattccaaggtaagtgataataagtatcatttacccagggctctcgtccaagatcaagtatattttgtggtttttgtccttaaaagtaatggcaaaaactgcaattacttttgcaccaacctgatagtttcagccagcttctctccccaccattcaaggcactcacaacacccttcaacctaccacacagctttgatttgtgagaggcacatcttattttcattttttagtatctgtgaaatcaggaaatgtcctacaattgatgatacaccataatttaattggctgaactcttttcttttttagtgctctgtgaaataatgaagcaccatgcaatactgtactcctgctgttattcccagacccactctgttctttccagtcaggtctcctgctgtgctgaacacactttgtccctccctgcctcctgatcttgactcctgcctttcctcttacctggaatgcttcagctctcccttcacacattcaaatccaacccattcttcaagaccagctgaagaaatttcttaaatgatttggaccacaatgaagaaaccctatatatgctttttaagaccaattatctattttggcaatgaatcccatatggtcttgcctccttgaactctttcaggcatttatgaatcatcttttccaagagagtaaattctgggaaggcagagttttgttattcacccattttatcctctgtggaacagagtattgtgcttcacagttaataaaagtactttggaaaaagaaggaaagatgactgatctttggccatttaaatgatattcaagactaacctatagatttatttttcaaggactttattaataaagaaaaatttaaataattttacagtgagcacttttttttttttttttttttgagacagagtcttgccctgttacccagattggagtgcagtggcatggtctcggctcacagcaacctctgcctcccaggtttaagtgattctcctgcctcagcctcccgggtagcgggattacaggtgcctgccaccatgcccagccaatttttttttttgtatttttagtagagacagggtttcagcatgctggccaggctgatctcgaacttctggcctcaagtaacccacccgccttggaccctcaaagtgctgggattacaggtgtgagccaccatgcctggcctagagtgagcacttagatgtctactacccaaaccttacaattaactttttactatacttgtttaatcacatatctatgtatatatttgcttttaagttcaagaaataactaagagtattaaaaaacagaagagtacattctgtaattcttgatacttgatttggaatctgactacagctcaaacatcactgtgttataaaggatcaagtaaaagactggaagcttagcacactggttcatgattctagccttcctcaactttgccaggctgagcttatatgcatttgaaatgtcttcatctgtaaaataaaataacgtacatctttaaaggggttcaatatcaacatatacaacttagctacttaacaaggaatcacacccaacaaaaaaatcccagagagaagtagcgagaatctaggtctcttaccttgcataatcaacgggagttttcccactagaatcctgtgtgcctgggtctgctccatatactgccaataattcagcctgtaaaatctgccctgctttggaggcaacatggagtggggtgtttcctttttcctaagaatcattaataaaaagtaggcaaaagagcacattaaataaaggctacatgaacacaactcacttagtttcaatatctgaagcaattcatgttttcttacaggatgaaagaagttggcttgtgctcctaaagataacagtctcaaacaggtttcaagattccctgttctcacgctcgaatggagttgctgaaaaacgcagaaacaaaaaaggaatcgtggttagaggtgtaaagaatgatgtcctagggcagctgatagaccattttaatatatgttacatcagtaacgcataatctttatttgtctcggtaaagtgcatggaccagtctctcc

SEQ ID NO: 570 - DNA, 75735 bp, Homo sapiens
gcgtcaagatggcggcggggaggtaggcagagcaggacgccgctgctgccgccgccaccgccgcctccgctccagtcgcctctggtccttcaaactcacacctcccgggaggagctgtgctggcgccgggtcccgcggggaaagtaagtccttcccttggcccttttctccttccacactccccctcccggacagcctcccactcccaccctcggggggccgtgcggggccaggctggggggacagccacctcgccccggcttggggcctccctcgccgcttgccgctcctcgcggccgcgcgctccggggccctcgggggcatgttcccgacggcggctccgttgtactcgcttcctctgttcgtcagcgccgggccccgctgtcgccgctcgtggggctttcgggctccgggagccccgctgtcccgggccggaggcacccctcttggaccgcggggcagggtctgtgcacgccggctccgctgggttcgcccctttggcttccgcctcacaacccgggggctgcgggtccgggacccgcggggaaagtaaggaccggatccttcccaagtcctctttcgtgccccagcattgctcccggctctgggcgagggagggaggcaggcgacgcggtcgtccttcctaaatctgaaccccacagcgcggtctcgtacatgccccgctcttggggcggtggggaagccgcgggggacacgtgcaggctcccttcacgcctctccaggcgactcgcttagttctgcctcggcgggcgagctcacctcccagaccctaagaattacccatggaggggaacggcagttggggatttgcttactttgagagcgtttggcataacgagcatccagagttccccaaagcagtggataccggtggtttcccagaagtggtttggggtcggtttaaccgctgaggagatttggatgttcctaaacccttctgattgtttctttcctgaccctggcatccagctcctccccttcccacccctgctttgtgcttctgtttggttaatgtttgcggaccactaacttgatcctcgcacagagaagctctttttatgtgcgtgctcggtttactgtgggaggcttttgttttggggagtcgctggttgagaaacgtgggaaaagaacgggccagaaaatgagagacaaataaagcaacgtttttatccattgaattgcgcagccaattgtaagtgcacccggaagtttgtactgaacacgtgttgagggaaggttataaactggtcccctttgacctttgaaagttggctattatcattttatgttgagttaaatgtttcatatattctagacagccagaattagggatggaatatggtttctaaagagtcatccagaagggtgcagagaactgtcatccggagtgccctagcaggaattgacttaacactttcagataattctgcgagctgacagtacagagggattctattttccaccatattttctagcaatcagaattgattttcataagcgtagggaaagctatcatcgttgcacagaagatagcagaatttcctactggtgacttgagtgggacattaattttgcaagcaagggaacattttctctcatcttttaaagaagttgtttccaaaatttttccgatgggagacgactttactttttttctctggcttctgctttttatcttccattccaacttattccatataattgcgtttggaatatttatgctatttttaaatttttgagacagggtcccactctgttgctcaagctgaagtgcagtgacgtggtcatagctcactgcagcttgaactcctgggctcaagcgatcgtcccacttcagcctccggagtagctgggactacagatgtgcaccactacagcagctaatttttttttttttaatttttttgttgagaggcgggggtctcaccatgttgggaggcagctactggcctcaagcaatcttctggcctccgcttcccgaagtggtgggattacaggcatgagccattgtgcctggccccttcagaatcttttttttttttttttttttttttgaggcggagtcttgctgtgttgcccaggctggagtgtagtggtatgaactcggctcactgcaacctctgccttcagggttcaaacaattctcctgcctcagtctccctagtagctgggattgcaggcatgtgccaccacacctggctaatttttttttatgtagttggcagaaaggggtttcaccatgtcggccaggctggtctcacactagtgacctcaagtgatccactcacctctgtctcccggagtgctggaattacagccgtgagccaccgcccttggcccccccgtcagaatcctttttttttttttttttttttttttttttttttgagacggagtctcgctcagtggcccaggctggagtgcagtggcacgatctctgctcactgcaagctccgcctcccgggttcacgccattctcctgcctcagcctcccaagtagctgggattacaggtgcccgctgccacgcccggctaattttttgtacttttagtagagacggggtttcaccatgttagccaggatagtctcgatctcctgacctcgtgatccgcttgcctcggcctcccaaagtgctgggattgcaggcgtgagccaccacgcccaacagaatcttttttttttgaggtggagtctcgctctctcgcccaggctggagtgcggtgtcataaccttggctcactgcattcctctgcctcctgggttaaaacggttattctgcctcagcctcccaaatagctgggactacaggcgcgtgccaccatgcccggctaattttcgtatttttagtagacacggggtttcaccatattggccaggctggtctcaaactcctgacctggtgatccgcctgcctcggcctcccaaagtgctgggattacaggcgtgagccaccgcgcctggcctcagaatcttaaataaatcttcactttagttgctgaaggggagacactgagttagtggcctactattcattcattcattcattgaatgcggttatatgtcaggcaattttgtattttttttttttttttagactgtcttgctctgtcaccaggctggagtgcagtggggtgatctgagctcactgcaacctcccgctccttggttcaagtgattctcctgcctcagcctcctgagtagctgggattacaggtacacgccaccacgcccagctaatttttgtacttttatttatttatttaaatattttttgagatggagttttgctcttgttgcccaggctggagtgcaatggcgcgatctcggcccactgcaacctccccctcccgggttcaagtcattttcctgcctcagcctcccgagtagctgggattacaagcatgagccaccacgtctggttaactttgtatttttagtagagacggggtttctgcatgttgatcaggctgttcttgaactcccgacctgagatgatccacccacctccgcctcccaaagtactgggattacaggcgtgagccaccatgcccagccttctttctattttttatttttttgagacggagtctcactttgttgcccaggctggagtgcagtggtgtgatctctgctcactgcaacctccacctcccaggttcaagcaattctcctgccttagcctcccaagtagctgggattacaggcatgtgccaccacgcccagctaatttttgtatttttagcagagacgaggttttaccattttgaccaggattgtttcaatctcttgatctcgtgatccgcctgcctcggccttccaaagtgctgggattataggcgtgagccactgtgcccggccaatttttgcatttttaatagggatggggcttcaccatgttggccaggatggtctcgatctcctgacctcgtgatctgcctgccttggcgtcccaaaatgctgggattacacgtgtgagccactgtgcccaacctgtaggttttaagtgccttactgaaagtactgttgaaaaaggggcagcatgcagattcattttatgctttaaaaagtggtttgtctcggccaagcttggtggtgcacgcctgtaatcccagcactttgagggggccgaggctggtggatcacgaggtgaggagatccataccatcctggctaacacgatgaaacccctgtctactaaaaatacaaaaaattagctgggcgtggtgatccgcacctataatcccagctactctggaggcttaggcaggagaatcgcttgaacctgggaggcagaggttgcagtgagccgagattgcgccactgcactccagctttggcgacacagcgagactctgtctcaaaagaaaaaagtggtttccctcagagtttagctacagatatgtttaggcatttcttagcatctaaattgagcttcgatttgtgacttgccacctgtgaagatggagaacactcagggctagtcctactgagtaacctcacattccatgaggctctgtgggttcccatgctttgcctttctaaagttggtgtaaagatacatttttttttttttttgagatggtgtttcactcttgtcaccgaggctggagtgcaatggtgcaaccttggctcacctgcaagctccgcctcccagattcaagcgattctcctgcctcagcctcccaagtagctgggattaacaggcgcccaccaccatacctggctaatttttttgtgtgtttttagtagatacagggtttcatcacgttggccaggctggtctcgaactcctgacctcaggtgaccaaccggcttggcctcccaaactgctgggattacaggcttgagctaccatgcctggccaaagataatttttaagagtaattactttagcattaaataccaattaataactatctaaaatgatgtaatcctaaagtttttgcagttgtctttgtttttatatgctgattgacagatgcaatttgttgtggcttgaactcaccaagtgttaagacaaccttagggataccactgaaatttccttaagtggaaaggatgggctcttaaagatcaggaattctcttttatgaataagatatggtatgaaacctatcaaattaacttatttattgggaggcaatatatagatcagagtcatgcttttcaaatatttttattgcatcccacagtaagaaatgcggtttacattgtgacctagtatacatatacccatacaactatatatatatcttttttttttttttgagacggagtctccctctgttgcccagtctggagtgcacgagtgcgatcttggcaacctccacctcctgggttcaagtgattctcccacctcagcatctcaagtaactgggattacaagtgtgtgccaccacgcccagctaccttttttgtgtatttagtagagacatatatgtatatgttggccagtgtatatgttggccaggctggtctcgaactcctggcttcaagtgatctcatcttggcctcccaaagtgctgggattacaggagtgagccaccgcactcagcctatactgagctattttaaaatgctgatacagtaggctgggtgcggtggctcactcctgtaatcccagcactttgggaggctgaggcgggctgatcacgaggtcgggagatggagaccatcctggctagcacggtgaaaccctgtctgtactaaaaatacaaaaaaattagctgagtatggtggtgggcgcctataatcccagctactggggaggctgaggcaggagaatcacttgaacccgggaggcagagcttccagtgagccaagatctcgcctctgccctccatcctgggtgacagagcaagagtccatctcaaaacaaaacaaaacctgatacaccaaattgatttgacaccctgctaatgtgttgtcatcagtagtttgaaaagtactggaacagggttgggagtacaggatcttggagtgatgtggtgtcagaccttctgaatttgtaattctattccaagctccctttgttgtatttcatttttcttcttctttttttttttttttttttttttttgagacggagtcttgctgtgttgccctggctggagtgcagtggcgcgatcttggctcactgcaagctctgcctcctgggttcacgccattctcctgcctcagcctcctgagtagctgggactacaggcgcctgccaccgcgcccggctaatttttttcgtatttttagtagagacggggtttcactgtggtctctatctcctgacctcatgatccacctgcctcggcctcccaaagtgctgggattataggcatgagccaccgcgcctggcccgtatttcatttttctaagccttggtttataaattgtgacaaagggataatgggtagcatttgatactcatgggttatcttgaaggttaaaagaaaaaaacacacccatatatgggttgagcatccctaatctgaagattcaaaatctgaaatgttcaaaatctgaaactttcagcactgacatgatgccacaagtgggaaattccactcttgacctcacgtgagtgatcacagtccaaaatgcagtcaaaactttgtttcatgcacattttaaggtactgtataaaactatcttcaggctatgtgtatctggtgtatatgaaacataagtgtattttgtgtttagacttgggtccagtctctaagatatctcattatgtatgtacaggtattccaaaatccaaaaaaccctgagtcacttctggttccaagtttcagatacgggaaactcagcctgtagtgagaatcaagacaattgaccatctgaatttgactagtgataatcaagaaagttgtttaattccccccaactcaattatttgtgtattgcttttgtaaaggacttttgtggctttgtatataatttgcacattcctttgtaaatatcttcttcctacaggttttgcagtgggggttactttaccaagcaaggtcctatgaagggtaggtgttgaaaagtacagattgcattctttgttgttgttgttttgtttgtttctgagatggagtctcctctttcgccaggttggagtgcagtggcacgacctcggctcactgtaacctccactttccgggttcaagctattctcctgtctcagcctcccgagtagctgggactacaggcacccgccaccaggcacccgccaccatgcccagctaatttttgtatttttcgtagagatggggtttcatcatgttggccaggatggtctcaatctcttgaccttgtgatccgcctgcctcagcctaccaaagtgctagaattacaggcgtgagccaccatgcctgactgtttgttgttttgagacggagtcccactctgtcgcccaggctggagtgcagtggtgcagtctcggctcactgcaaccttcaccccctgggttccggtgttctcctgtctcagcctctggagtagctgggattacaggcacgccaccatgcccggctaatttttgtgtttttagtagagatggtgtttcactatgttgaccaggctggtcaggtctcgaactcctgacctcaagtgatctgcctgcctcggcctcccagagtgctggaattacaggcatgagccaccatgctcagcccagattacattcttttagataaaggaaattcttgtaaactaacttctttgtaactgctgtttctttctcctgatgttcttaagtgtctactgcacacagtagacacttaatatttgttgatgaactgtatctctaactggatcattatcttaaaattcttaaactaaatgtcagtcatatcacagctgcataaaagcacagataaagctgaatctcgaatcagacatgcttagcactctaaggagaaaaaaatcctttttgttattagctaaggtgaagatatttgctaagtgatagtatccgtgcacatttaaaaatgtccaccagtttattctaaatttagtaactgattggtcaagttggatgtgtagcagtaacactttaagataaaaagggactagtattttatataattgatatgtgcagggcacggtggctcacgcctgtaatcccaacactgtgggaggccgaggcggatggatcaattgaggtcaggagtttgagaacagccttgccaacatggtaaaaccccgtgtctactaaaaatacaaaaaaattagctgggtgtgggggcacgcgcctgtaataccagctactctggagtctgaggcaggagaatcgcttgaacccaggggggcggattcaaggttgcagtgagctgagatcgtgccattgcactccagcttgggtgacagaacaagactccatcgcaaaagaacaaacaaacccaaagactagtatgaaagttaattatttaatggattgctaacaaagtttgtattctggggaataaagtgctgaatcagtgatatgggagtaaacatcttttttggatgaaatactaacatatatataaatgatagtagctagctagtagctaacatttactccaggtagtatcacatttacttcacacagtaatcctatgaaggaagttctatttgtattattttaagatgaggaaactgagtcagagaagttctcacttgaccatatcatactactagtgggcaatgcagccagtatttgaacctaggtattttgtccgactccatgatctcctcagccactgtggtgtgctactgctattgtggacatgtccctggtgtctgctcagagctgtagagattggttttaggtctcagcaagaggaaccttgtcccccttggtaactttctgtgttggtattctgaatgggaactatatccttccattcttctggttggctattgtttctcagtattctcttcctgccaaaactagctcttagtttttctctactgctgtgtctttgtgtcttacttatcatagaagttttcataggcgtactgttttgaaataggtcatgttttcaaatgctttcgtttatttttcatttttttgggacagggtctcactctgtcacccagcctggaatgcagtgccatgaacatgcctcactgcagcttcgacctgctaggctcaagggatcctcctgcctcagccttccaagtagctgggaccacaggtgcatgtcactgcacccagctaattttttgaggtttgtttttattttttgttggagatggagtctcggtctgtcgcccaggctggagtgcagtgctgcgatcttggctcactgcaacctccgcctcccgggttcacgcgattctcctgcctcagcctcctgagaagctgggattacaggcgcccgccaccacacctggctattctttgtatttttagaggagacggtttcaccacgttggccaggatggtctcaaacttgtgacctcaggggagccaccgtgcccagcgtttttttatttttattattttttattttattgttaagaaacagggtctcagctgggcatggtggcttatgcctgcaatcccagcactttgggaggcccaggcgggcggatcacgaggtcagtagatcgagaccatcctggccaacatgatgaaaccctgtctctactaaaaatacaaaaattagctgggtgtggtggcacgggcctgtagtttcagccacctgggaggctgaggcaggagaattgcttgaacttgggaggtggagggtgcagtgagctgagatcgcgccactgcactccagcctgggcgacagagcaagactctgcctcaaaaaaaaagaaaaagaaacagggtctccctttgttgcccaggctggtttcaaacttctggactgaagtgatcctccttccttagcctcccaaaatgctgggattataggtgtgagtcaccgcacccagctttcaaatgtatttatgataaaaattgaactcttttttttgtccattgtttgagagagagaccttccgtggttagtaacttgggtttgtcagactgctccatggtaaatgtcatctgaggtctatgaattcctttgtagacacactaacacagttctcttgtacctaacagtatttagcatttatatggtgctttgtgacttaaaagtgaaaatgtttttcctcctatgaacaggtcttatttgtaaaatgaggaggagattggctaatacaagtttttaagggctctctcagtttgagcaccaaaattctgtgagtctataatagtttctgaatagaaatataattacatactaagggttttgcctaatggagttagagaatgggatagatgttctctctctgtcccctttccctccttcaccctgcaaaaaaagaacaaatagagaatttgtgcccgtttggctgagaaatgatccctagtattccatttatgtataagatatatattaggattaaaatctctttcattagtagcttgtaaaagacagtgtcttttacagacgttgttattcccaggtcattcatcagattagagggtcttaaattgttacttattttaattgaacagtaaaaattgtccatatggtgtataacatgttttggtatatacaagtatacattgtggaatggctaagtcaaattgtgattcctatgagtgagttctaagctggtcaccgataatgttatttataaccgttgctctctttcttacatgaacatcaaaaagtttctcagtaaaatttttttgtacttaaatgctcattgttaggaaaacatttcagaaagctctcatgaactgaataatagtttgcagtgaatatgcatttcattgattaatggcatctctacacttttgaatattattagatagggcttggtgtatagctcatggactgatggatcctgtggcctgcaggggctctgtggtctgtagttttggaagtcactggattaaaacaatgtacttctgtttcaaatgtaaataaatcatttccagtatttattttaaagagatgacattttgatagtctccagagttctattaatctgggtcaagattatctgtagccagtgggccaagaccctattttagtcttaacgaagtattttatggattgaaaatgttaaaagcattgatttagagctctaggtacttgttcgtattatgcagtaggataatttgtaaaagtatggtcaaatgtgtctatattagaaaaattagttaacttggtcttttttttgaatcaaaagtcatcaggcaaacaactttatttgaaatctatattgggacatttctcctgttaactctgtcattcatttccttcatgttatttatatcttgctgtctaatactttattccccctccaattttaatctcaatctggcgtttattttgaaataaaataatgaaacatcgtagtttaccaacatcaactttatctactcattggaaagaaaacttcgtggattttgggagtttgaactatctagtttctaatcttctaccacttcctgcgtgagtgaacttcggtagatgatttaagttttctgaccctcagtttcagctcttaaattatattacctatctcactcagggttgttttgggcttgagtatggtaatgtttatgaagaatttaacacggtgctaggcttgtttccttccttcctcactccctgcccaaaatggttttcttcctcaggttgcttttcctttttctggaaaattatggagaaatctcctttgggaggctgggcgcggtggtgcacgcctctaatcctagcactttgggaagccgaggcggacggattgcctgagcccaggagtttgagaccagcctgggcaatacggtgaaaccccatctctactaaaatacaaaaaattagctgggcatggtggcgggcggctgtagtcccagctactcgggaggctgaggcaggagaatttcttgaacctggaaggcggaggttgcggtgagccgagatcgcgccactgcactccagcctgggtgacagagctagactccgtctccaaaaaatctcctttggggtgtctgtttttcctcccactcttctacacagtggtctgccctctttcattctgggtatctggttttcaccttagactcactcatgtttccattagaacatctgtctaaatgatacacaaacgtaggtgacatagacgcagtagaggatttctttgttaaatgctttcatctgaaacagttcttacatgctagaagtcatgctcaggccgggcacagtggctcacggcctgtaatcccagcactttgggaggccaaggtgggtggttcacctgaggtcaggagttcgagaccagcctggccaacattgtgaaaccctgtctctactaaatacaaaaattaaccaggtgtgttggtgggcgctacttgggagggtgaggcaggagcatcagcccgggaggcagtggttgcagtgagccgagaccgcgccattgtactccaccttgggcaacaagagcgaaactgcgtagtcatgctgatcgtactcttggctaatgccatttttgtaggacatcatgaaacactgacacttaattttatcacagtctgagaacaaatggactagctgaaaattagtatatttatgtaacatgaaattagttttctgagaagagtacagatttttcataagtatgtttgtatatgtaaattggttatttcagggaaattaatgagaaaagttaaaatttagaaagctctttttcccccctataaaatgggtaaaaatccatggcagcagaatagtttggcccctgagattatagttggaaaaacttccaaactaaaatctgtctacttgctttaaattggctttagccccccaccccggcaaactccatagaactcatcctttaggtcttctgggctcggtgtttattttttattttctcttggcctgactctaaccattcatcagctcatactttttctctgacgtgcttcatattctcgcttccattctgagtttgtatttaagctaaatgtgatggatttagctccctaagtatcttggattccatttccccttctttctctctgccccatgcagttataatacatctctctcctggtcagctatgtcagtttcccaagatgtcattctgctcctggtcttctgctccctcttagtttgtttccacattgctgttgagtaatccttctatttttttctatctttactgagttgagttgggggtcttactctgtaacccaggctggagtgcagttgtgcaatcacagctccctgcagtctccaactcctgggcttaagccatcctcccaagtagctgggactacaggcgtgcaccaccacacttggctaattaaaaaaatttttttgtagatacggggtctctaggcaggtcttgaactgctggcctcaagctaacctcttgcacctccactttggtgctgggattacagacttgagccacagtgcccagacttgtaatctttctaaatcacaaatctgccgtgtcaggtagtcctcaatcggaaaacttgttagtaatccctgtttcccacaagagcaagtgaactctccagcatggtgtacagggctgtaggtgataccttcacctcttgccgtttcctgcctgagccccatacttctgttctgagcttccatacccttgttgaattaactccagaggttttctttttctttttttttttttttgagatggagtctcgctctgtcacccaggctggagtgcagtggcacaatcttggctcactgcaacctccacctcttggttcaagtggtttttcctgcctcagcctccagagaagctgggattacaggcacccgccaccacatgtggctaatttttgtatttttagtagaggcaaggtttcaccattttggccgggctggtctcaaacttctgaacttaggtgatccacctggctttgcttcctggcgtgctgggattacaggcatctggcctccagccatagtttttaaagtgtgtcaaattctttcatacctctatgttttgaatgcatagtcgagaggatccttgtccacctgatgattccctgatgctctgctgcattgtcatctttataacatctctgcttccacaaagttcattatttccttctctgttcccgtagccttttgtagatgcatacttgtgctatgatttatgtacttctctatcctttctattttagagtgagcttgggatccaagactatttctcttttatcctctttgtctgagacatggcaggttcttcattaatactgaatgaatgggtctaatagagattgttggattgtttatatttagaggggagttaatatttgtcactttttgttttttatgttaatatttaatatttccctttaaagatggtggagccagggcaagatttactgcttgctgctttgagtgagagtggaattagtccgaatgacctctttgatattgatggtggagatgcagggcttgcaactccaatgcctaccccgtcagttcagcaggtaagagttttccaaagcctctctttcttagtgatttccgcttacagtatttttttttaagatagtctcactctgtggcccaggctggggtgcagtggtgcagtcatggcttactgaagcctcaacctcccaggctcaaaccatccttctgcctcagccccccaagtagctgggactataggcacgtgccaccacatcccgctaattttttgtcttttttgtagagacagggtttgccatgttgcccaggctggtcttgaactcctgagctcaagcgattgccaacctcggcctcccagagtgttgggattacaggtgcgagccaagcttggcccaattttaaatatacatgtgaagccttaattttaaatacatgtgttaatttttttttttttctgagacggagtcttgctctgtcacccaggctggagtgcagtggcgcaatctcagctcactgcaacctctgcctcctgggttcacaattctcttgcctcagcctcctgagtagttgggattacaggcatgggccacgacgcctggctaatttttatatttttagtagagatggggtttcaccatgttgttcaggctggtctcgaactcctgaccttgtgatctgcctgcctcagcctcccaaagtgctggggttataggcgtgagccactgtgcccggccaaatgttatttttatgttgagtattcattttgatttatgaggcagaaaataataatgaaaaccaaaacattattttctgctttgatgttattataaacgtatagatagtgtaagagatgtttagtgttcttgtgggagtatctttaatttccttaatagttgtttaattatttagggatattcttctgtgatttcattatatacattctctgaaagcaaaaacgtaagattctggctgggcatagtgtctcatgccagtaatcccagcacttagggaggctgaggctgaaggattgcttgagcccaggagtttgagaccagcctgggcaacgtagcaagaccttgtctctacaaaaagttaaataaaattaggtggccgtggttgtgtgcacttgatgtcccagctacccaggaggctgaggtgggaggatcgcttgagctcaggagtttgaggctgttgtgaattgttatcgtgccactgcactttagcctgggtgacagagcaagaccttgtttctgaaaaataaaaaaatagactggtccgagtgcagtgttgtttacaggtaattgatcacagccagttacagatttctttgtttctcctctactccgactgcttcacctgactagccttaaaaaaaaaaaaaaaaagactaaaaaaaatttttttttcttgagacagagtctcactctgtcacccaggctggagtgcagtggcacgatcttggctcactgcaacctccacctctcaggttcaagcagttctcccacctcagcctcccgagtagctgggattacagggggccgccgccaagcccagctaatgtttttatttatttagttatttgttttatttatttgttttttttgagaccgagtctcgctctgtcacccagtccagagtgcagtggtgcaatctccactcactgcaacctccgcctcccaggttcacgccattctcctgcctcagcttcccaagtagctgggactacaggcgcccaccaccacactcggtgaattttttgtatttttagtagagacagggtttcaccacattagccaggatggtctcgatctcctgaccttgtgatcctcctgccttggcctcccaaagtgctgggattacaggcgtgagccactgcgcctggccaagcccagctaattttttgtgttttagtagagatggggtttcaccatgttggacaggctggtctcaaactcctgacctcatgatccgcccacctcggcctcccaaagtgctgggattacaggcatgagccaccactcccggcctacaaaaatgttttaaaaaaggaattgttagtaccgttttgtggagatcttgtgcttgcaaagattattacattataaatctgctgttagtgatttaacgtcagtttgaatgttaaacttgatattttttaataaatgcaaaccttgtccttgaaacagaatttactgctgtccttttattttttgtctgatgttgttttctctccagtcagtgccacttagtgcattagaactaggtttggagaccgaagcagcagttcctgttaaacaagaaccagagactgtacctactccagcactattaaatgtgagggtaagaatgatttagattcgtcgttacttctaaaatagtttagaagtgtagtgagaaaacatggccgggtgtggtgattcgcacctgtagtctcagcactttgagaggctgaggtaggaggattgcttgagccgaggaattcaagaccagcttgagcaaaatggcaggaccccatctctataaaagaagaaatgggctgggcacagtggctcatgcctgtaatcctggcactttgggaggccaaggtgggtggatcacttgaggtcaggagttcaagaccagcctggccaacatggtgaaactccatctctatctctactaaaaatacaaaaattagcttggtgtggtggtgcacgcctatagtcatagctacttgggaggctgaggcaggagaatctcttgaacccaggaagtggaggaggttgcagtgagcagagaccaagccactgcactccagcctgggcgacagagtgagacttcatctcaaaaaacataaaaaaagaggccaggcacagtggctcacgcctgtaatcccaacacttttggaggccagggagggtggatcacgaggtcaggagatcgagaccatcctggttaacatggtgaaaccccgtctctactaaaaatacaaaaaattagccgggtgtggtggcgggcgcctgtagtcccagctactcgggaggctgaggcaggagaatggcatgtacccgggaggtagaacttgcagtgagccgagatgggaccgctgcactccagcctgggtgacagagcgagactctgtctcaacaacaacaacaacaaaaaagcataattaataaaaaataaaaaactttttagtgtgaaatagttttctctctctagttctgctttttgccgctttcccaatatcctacccttacctcctactttgcgacacatttctttcattcttgtttctttttttttttttttgagacggagactcgctttgtcgcccaggctggagtgcagtggcaccatctcggctcgctgcaacctctgcctcctgggttcaagcaattcttctgccttaaccttccaagcagctgggactataggcgcccaccaccatgcctggctaatttttgtatctttagtagagacagggttttaccatgttggccatgctagtcttgagctcctgacctcaggtaatgtgcccatctcagcgtcccaaagtgctgggattacagatgtgagccaccgctcccagccccacaaagatatttttaaaaacagatttgtacgtgaagatatataacacggtcattgatgacaagtcaaaatattgaaaaaagttgtaaatagtagactttattatttttattcttttattttttattttttgagatggagtctcgctctgtcgcccaggttggagtgcagtggcgcgatctcggcgcactgcaacctccgcctcctgtgttcaggccattctcctgcctcagcctcccgagtagctgggactataggcatccgccaccacgcccggctaattttttgtatttttagtagagacggggtttcaccgtgttagccaggatggtctcgatctcctgacctcgtgatccgcccgcctcagcctcccaaagtgctgggattacaagtgtgagccaccgcgcccggccaatagtagactctttattaaagactcattattaaaggagtagtggagaaatagcaaatagtgttgaggaggaaaaaagtgaaaatgtcatcaatcaaggcattagaaactttctgttactagtcttttggggagattggggtgggaggggtcttgctattttgccaaggctggtcttaaaatcaagtgaacctcctgtgtcaccctcccaattagctggaaatgcaggtgcacaccactgtgcctggcttagtcctgttattttcggtttgtgtgggatagttccattttatgcttgccatccctgacagttatagaaagggttatattacaactataccttcttttcgtcaaagttgtccgtttaacttggtaatttgtagctaatcaaatcagaaatgaagtactaatatttaggcaaggctgggcacagtggctcacgcctgtagtcccagcactttgggaggctgaggtgggagaatggcatgagcccaggagtttgagaccaacctgagcaacatagggagactcttatctctaaaaaaaatttgccgggcatggtggtgtgcacctgtagtcccagctacttcagaggttgaggtacaagaatcacttgagcccagttgggcaaggctgcagtgagctatgatcgcacttcagcctgcatgacagaatgagactgcttcaaagaaaaaaaaaaagcaataataaaagtgcattttagatttttagttgtccttccaggtttgtggatataagcttcattagagaatgaagcatttttcagtggtgtgttttttgttttctatctagcagcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctagtaagtctgttttcaatagtatcaactttctctctctggtaagctatgtcagcatgtttttttaaacgatttgcttgggtttttaaagaactggccataaaagggtgttatatgcattattttgcgtacttacagtctttaacacaattcaagggaagcaaaagtttagatgccttgggtaggttgtttagctttgaaatgtgatttctaggatcatcaggtagctacgttagcaacatgaaatcttaccagttttatatattataggtagtcagttaacatttttcttaatcctttacaaatcctttacaaatagctgtttacttgtgactcatctgtggatcttgtttgaaagcagaatctgattctcagtagagcccacaattctacatttcttttttctttttttgagacggattttcagtctgtcacccagactggagtgcagtggtgcgatctctgctcactgcagcttccgtctcctggattcaagtgattctcctgcctcagcctcccgagtagctggaattagaggtgcttgccaccacacctagctaatttttgtatttttaatagagacggggtttcactgtgttggccaggctggtctcgaactcctgagctcaggcagtctgcccaccttagcctcccaaagtgttgttgggattacaggcgtgagtaccatgcccggcctgcttgtgtttttatgaaatagagggctaagagcattctaaaagaatgggcgataagtgtttataggaagatgtagaactttgtcttaagtgacagatgtcattaaaattttcagatcatctggtttttatgtttgggtccataccactgtgtccttgtggctgtagttttttgtcttttggttttcgttttttggttctcctctcaaggtcattgtcctgaactgactgcaacctggcagtgagatgcaagttgggaaatcattttagctgtcttaggactgataccattttctgccgtggagtgcagcactgtgaccctgacctggctgaggtgcagggcagtttctggaatcactcgcaagggacttggggatggtcgacagttggtggaagatgcttctcgttacggtctttggatttaatgaggaagcctgcttcttatatgagtggctttctgagcattgtactcctcacatcagcatatgccatcataacttaaaggagtggatgtatgccattgtgagggaagaatttagagaacacaacagaaaacgggatagatttggagctgactgaacaagatatctagtacagtaaattctcccacatttaaggtagtgatttttaaaagacaaatgcagacatttatcaggctgcacagcaagactatccatgtatggaagcctgagaaactgtcaagctaggtcaggactaagaaacaaagatgggccggacgcggtggctcatgcctgtaatcccagcacgtttggagcccaaggtgggtggatcacgaggtcaggagttcaagaccagcctggccaagatggtgaaactccacctctactaaaaatatgaaaattagctgggcatgatgatgggcacctgtaattccagctacttgggaggctgaggcagggaattgcttgaacccaggaggcagaggttgcagtcagctgagatggcgccactgcactccagcctgggcgacagagcaagactccatctcaaaaaaaaaaaaaaaaaaagatggtaagtgaatgctgaagacaagcaaagttttttgttgtaggagatggtcctctttttactgaaggggaaaaacattgaaaatatgaaactgcagaaagcaaggtgttgcatgttctacttcttatctgtgtggttgttgcccctttgggttctaacctgtcacaatttctctggtcttaaaactaggagctgatcactggctctttcacagttaaaataaacaaaccatgcccccaaatatcatctctgttctagtttccttgtttagttaatactttatttttattttttatttttttgtgagacgaagtctcattccatcgcccaggctggagtgcaatggcgcgacctcggcttcctgcaacccctgccacttgaattcaagtgattctcctgcttcagcctcccaaatagctgggattacaggcatgagccaccaagcctggctatttttagtagagacagggtttcaccatgttggccatgctgatcttgaactcctgacctcaagtgatcagcccacctcggcctcccaaagttctgggattacaggcgtgagcacctggcctgttaatactttaattagttgtactcgttttggagtctaagtgatagtcctcccaaatactcttcatcttttgctagaatagatgaaatgctgatcagctctcctgatgttagcactctcttccctaaaggcagtgatttccgcacctctatctcaagaattccaggtactgtgaggacttcagggattcttggaggctgaaggctggttccaggggttctggactggatacctcccacccctattcagtcaagtagctctgctgattgataagtggattctgagattttattgctatatttaaaagagtttgaaaaccagtggtatagaagaaagtgttcattgtttagatctttactctgggagcaggaggaagtaaggagttcccaaattgatttttcttcttctagaaataattattttgccttgaaaattagtaagtaccaccagatcacatgaaattgattctgtttgggtgataaccccaggttttgggtttttttgttttttttcttttttgagagtcttgatctgtcgcccaggctggagtgcagtggcgcgatctcggctcattgcaggctctgcctcctgttttcatgccattctcctgcctcagcctccctagtagctgggactacaggcgcccgccaccacgcccagctaatttttttttgtatttttttaaattttaattaattaattaattaatttttttgagacagagttttactcttgttgcccaggctggagttcaatgatgcaatctcagctcactgcagcctccgcctcccgggttcaagcagttctctgcctcagcctcccaagtagctgggattatgagcatgcgccaccatgcccggctaattttgtatttttagtagagactgggcctcctcggcctcccaaagtgctgggattacaggcgtgagccactgcgccggccttgtttatttttaatgagtcaaatgaagtgtctcaaagtaatgctggcttttgggtatctttctgataaataattttcaagcttcccttgcacacgttccttttgagttgttttctaaagttaattctttacttccataaagacacatgggtttacatgttttcatgcctgtgcttaatttaaattagtaatagaggccaggtgcggtggctcacgcctgtaatcccagcactttgggatgccaaagtgggcagatcacctgaggttgggagttcaagaccagcctgaccaacatggagaaactccgtttttacttaaaaaaaaaattacaaaattaggcaggcatggtggcgcattcctgtaatcccagctacttgggggtctgaggcaggagaatcgcttgaactcgggaggaggaggttgcagtcagctgagattgcgccaacgcactccatcctgggcaacaagagtgaaactccaaaaataaataaataaaaataaattagttataggcagattgacattctttggtttttgaaatatgtaaacttctgggttttttatttttatttttttagacaaagtcttgttctgtcacccaggctgaagtgcagtggtgcaatctcggctcatttcaacctccacctcccaggttcaagcaattctctgcctcagtctcccgagtagctgggattacaggtgcccgccaccacgcccagcttgtttctgtatttttagtagagatgcggtttcacaatcttggccaggctggtcttgaactcctgaccttgtaattcacccgccttggtgtcccaaaaatgctgggattacaggtgtgagccaccgcagcagccttaaacttctggatttttaaataatgggaaaataagttcagaattttcttctaaatgtaatttgactttttcctcctcagctgatgtaagcaatggtacagtaaagaaagagtcttctaataaagaaggagctagaatgtggataaacgacatgaagatgaggagtttttccccaaccatggtgagtttcaaataactgtgtctttatttttgtgtagtatgagagtgtactcaactaaaagtgttctatatggaacaaccctcagaaagctgtttttgggttgggaagaagctatacaggcgtgggaactaatggatatgcttaaacctcgctggagtaatatagatactaaccagggtggttaaaacttgcagattgatggagtgtggcactaacatgcagtactgatatcttactgttaaaaatctcatctgagcagaaaaaaagacaatgtggggttaacgaaaagtatttgataactgtgttcattttaggaccgaacttgaatagaaagctcataatgcattgacagatcatataatgatctggttatgagtgattcttttttttttttttttttttttttgagacagagtcttactcttatcgcccaggctggagtgcagtggtgctatcttggctcactgtaacctccacctcccaggttcaagtgattctcccacctcagcctctcaagtagctgggattacaggcatgtgccaccatgcttggctaatttttgtatttttagtagaaatggggtttcaccatgttggccaggatggtctcgaactcctgacctcaggtaatctgcccgcctcagcctccgaaagtgctgagattacaggcgtgagccactgcacccggcctggttagaattcttaacattttgaaaatgctgtatgctttggatcaattgattccatacatttatttaataaattctccatgtataacattgttaatatgtagtaggtttctacaagaagtatatttattacatgattctaccttcagtaagcaaaatttgacaaccatctggattaagtagtaataatgaaaagtacatcaaatggtatgcaatgtgctactcacaataaaggttaggaatttggaggaagaggtgaccttcctgaactctagtggcctggtggactttatggagagggaataatggagcttgggttttgagtatgacgagactttgaggtgggatattaggaagggagctaaaggattaatgggcacagaggggaggtagtgagtatgtgcttcggtgaaaataagccaggaagcttagcttgtagaaagaagtgggaatagtaggtctgggctccatggagggtcctgaattgaggtttttattgttgttgttgtttttgagatggagtcttgctctgttgaccaggctggagtgtagtggtgcaatcttggctcactgcaatctccgcctcccaggttcgagcgattcttctgcctcagcttcctgagtaggtgggattacaggtgcccaccaccagccctggctaatttttgtgtttttagtagagacggggttttaccacattggccaggctggtctcgaatacctgacctcaagtgatccctccagctcggcctcccaaagtgctgggaggccaaggtgccctgtgctgaattgagtttgaaggactttggacttagtctagcaccattgagccagtagacatggagggacctgttagtgattcaggagaagttggggtgcagactgagtaaaggggtagggaagacagattcgggatgagtaggagtaggcaaaagagagaggttggaaagttggttaacctaagggggaagtaagaaggggtactagagaccttgcagaggggattgaaaaacggagaggggaaaggaaaaaaagagatgactgtacataacgataccaaaagaattttgggacttggttctagaatatggaattggagacagtgcagcaaactgtagctgaggttttgaatgggaaccaggagaacaatagtgctactggcggtacccagtttacttagtgattgtctaccaacagcacttggaaggtgatttttggaaactaagaatgcatatttcttcaagaaatgttttatgtggttctcacatttccatttcagtccattatataccaaaagttttttattggcttagcagttaagtaacatctcagagagactgcaaactgatagcccatcaaccaaactagtcggggaggggggggggggcgtgtgtgtgtgtgtgtgtcggggtgtgtgtgtgtgtgtgtttagacggtgtcttgctgtcacccaggctggagggcagtggtgcaatctcagctcactgcaacttctgcctcccaggttcaagtgattcttctgcctcagcctcctgagcagctgggattacaggcgccccccaccaccaccaccacacccagataatttttgtttcttttattttgtttatttattttgagatggagtctcgctctgtcacaggctggagtgcattggtgcagtcttggctcactgcaacctccccttcccgggctcaagcaattctcttcctcagcctcccaagtagctgggattacaggcgcccgccactacgccctgctaattttcttttgtattttttaatagagatggggtttcactaccttggccaggctggtcttgaactcctgacctcgtgattcacccgcctcggcctcccaaagtgctgggatttcaggcgtgagccactgtgcctggcctgtattttttagtagagacggggttttgccatgttggccaggctggtcttgaactcctgacctcaggtgatccgcccacccctgcttgcccaagtgctgggattacaggcgtgagccaccatgcctggctgacaaatgtattttgtttggccttcatggtattttgaagaattttgaatttgtttgctgacatatacaaatcctgatttcccggttattttgaaaaatgggagtacctgacaaccccaggcccacgttccccatctaggaagatttgcccagcgttgtgtagtgaacatctacatggtatgttgggcaaacatttcccaggtaccgtggtctccctcacccgagttatctctttgacctaaatttgatgtcagttgctatctcacatgcacctggcttcaaggtattacttgtttgttccctggatatagtggtccttcagtattaccaacttatccttcagttattcaattatcatcaattttatgatgattttaaaaaactataggtaggagaataaaggatggagggagaaaggaggctgcttatcttaacatagaatacatttttattttataagcgaggacagggttagacggtgggggtggagaggacccagaatttaggtaatttgcctaaattaaaaaacagactacacaattaaataacagcagaattgggattcaaatctattcatttggccagtcctgttttgtctcgaatttccgaaattgagttttattttagcataatttctgagaacattccaagtttttagattttatctaaagactccataggttaatgttgattggatggttatgtcccacttcttttccttttcacgtttgttatctatttgcaaccatattctgctctagattctgaggtaaatgaaaaaagagcctgtccttcacttttaatgctgtctcgatcttgccttaatttgccttaacctgtaggtttttgttgtcctcttcccttggcatactgagtttcacaacagtttctttatattcttccctgaacaagtgcatgctaataaacagttgcctaatgattgtactggtagtgaaaagtggcttattccggatcttcctttattcctttaagatcctgtagaggaagaaaagggaagcataaccgtggtgaccattcacttggtttgccgaggacagtctgggtttacttctgttttctcagtgtaatcctcaatagctccccaactcaaatgtgccagggtttggaaaataaattatatggccatcttatatatgatcacgattgcatctgtggagacacagaagtctgaagtaaatttttctgttcttcataagggcctctaaaataaactccagtcttctggggttttggttttaggatatgcgggaaagcaggcaaatagaagtgaactgagaagaaggtggaatgtgagactgagaggccttgcttgtggtgatgcagggtcctttggggccaatccacctttgctagggttcactccagttttgcactaggaagagccagacacactgcttgctctttctcctggaactagaatgaaggcgaagtctgagtgcagagagagttctgggcatcaaggaggggtgataggcagtattgaaggggaaagtagcttgacacgatggtggccggaaggacgtggagtcttgtgacccatttgtgggtaagagacagagtaggacctcattgtctgtgctcattattggagaagcaggaaagccacgaagtgtggcccagattttagggagtattgaggtggcgcgtcatgtttccatgatggaaatttgtaggtgttcctacaagagagtttttctgtgtgttggctgggcgtctggtccctggatttgggattgattgtgctctttctgtgttgcagaaggttcctgttgtaaaagaagatgatgaaccagaggaagaagatgaagaagaaatgggtcatgcagaaacctatgcagaatacatgccaataaaatgtatgtcttcgggatttgtcagatatttacatcaaagttttcctgtggtttctttggttctttttgttttgtttttttccatataaatttagaatcttgctttaggtcaaagtcttttaaaaccaaaactaaagaagcttggattttattttaattttgttcataggagtagtgattataaaaatcaaaggtaattgtaaagatatataaagctaagatatttaatacaacttgtctaaaattgtaaaaacattgaaattataaaaataattgtgctatttgaattccatagtttttgtttctcccttttgtataacatggttctttttttagcagccactgtatgaagtcgaaaattaggtttttaatatttgcataaaattttcactttttcattacaggaaacaaatctatgtctagaatttgtctttcatgtagtcttggtttctataaaaaaccactaataataccatttgaattgaactacaattctctttttatcaactactgatagactcaagattccatccttttctgctcacctacaatgaattttagaagtcctatctgaaattctgtttttcttattccaataatcattttgcaaaaggattgaaagagtttatggccctttaaaccagaggacagcaaactaaatctggaccactcgcttttttatagtaaataaggttttattggaacatagacatgtttattggtttacttattatctatggctgcgttgacactacagcagcaatgttaagtagttgtacaagagacaggatggcctaaaacggcaaaatcattctctgaccctttacagaaaaagcttccagatcattattttaatgtattcatgttgtacattttggggacttggttgttaaattttatagccaagttgtctttcgaatacttttcaaagtaaaatatgttctttttaagacggggtctggctctttactcagtctggagtgcagtggcatgctcttgcctcactgcaacctccacctcccaggatccctcctggattctagcaattctcgtgcttcagcctcttgagtagctaggattacaggtgtgcaccatcatgcctggctgatttttgtatttttagtagagatggggtttcaccgtgttggccaggctggtctcgaatgcctgacctcaggagatccacccaccttggcctcccagctgctgagattacaggcgtgagccaccatgcccagccaggcagtggcgcaatcttagctcactgcagccttagcctacaaggctcaagcaatcctcctgtctcagactcctgaatagctcggaccacaggtcccaccaccatgcccagctaatttttggattttaattgtagagatgagggtctcactatattgccaaggctggtcttgaactcttggcctcaaatgatactcctgctttggcctcccaaagtgctgagattacaagcatgaaccttcatgcctagcctcaaaataaaattgtattgcaaacttttgttttactgaatgaatgcttgaagtaactgaactccttaatctggcattatgttctgttactactagagaacctgctgttatgaaccaagtggtgtttttttagatcttttttttatcagcaaatctctattttattttatttattatttaattttatttatttattttttgagacagagtctcactgcatcactcaggctggagtgcagtggcacagtctcggctccctgcaacctccgtctcctgggttcaagcaattctcgttcctcagcctcctgagtagctggaattacaggcgcgtgccaacatgcccagctaatttttgtatttttagtagagacagggatttgctgtgttggccaggctggtcttgaacgcctgacctcaagtgatccctccaccttggccccccaaagtgctgggattacaggcgtgagccacccacctggcccaaatctctgttttaaccatatgtagttgataaatcattttagtcaaatatagatagtactttgtcatcagttactttttatggaagctcagagtgaatactttttaattatttttctatgttataagaaaaacattgaaatatcttataatgaaactggaaatgttattacttagaataattaaaataaaatgtttttacatttttgtttagtaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccaggtaagcaataatatttcataatacaataattattttatcctattctatataacagagttgtttcaatctaaaggtaacttttccttgtatgaaaaccttgtaaatgtaatatttatgaaagtttaatgtgttggaaaattaaattttagaagtgtagcagagatacagatagtgcatttccagtggaaatggcaaatgttataacttgcttggaatttactgggaatatttattaaaattaaaaatatgtatatcgaccaggcacagtggctcatgtctgcaatcccaacagtttgggaggctgaggtgggtggattgcttgagcccaggagttcgcgaccagtctgggtaacatggtgaaacatcatgtctacgaaaaatacaaaaaattagctgagtgtagtggcacgcacctgtagtcccagtttctcgggaagctgaggtaggggaatcacctcagcccaggaagtcgaggctgcaataagctgtgatcttgtcactccaccctgggtgatgggaacgagaccctgtctcaaaaaaaaaaaattatatatatgtatatgtgtgtgtatatatacccattcctaggagtgtgttccctggaactgttagataagaacatatgcagaatgatatttgttgtaccttttgtccctccagctggaaaagatttgagcatccacattattggggggtaattgcataaactgtgatattattggacagtggggtgttgtgtgggcttttaaaatgatgtgaggtagagttaagcagttgtcttgaaatgatttcagtcatattccatatctgtaaaataagtaatgaccaaaatagccatttatcctccatattttgtgtgatataaaacttttaatttggctgggcatggtggctcacgcctgtaatcccagcactttttttttttttttgagatggagtctcactgtgtcgtccaggctggagtgcaatggtgcgatcttggctcactggaacctccgcctcccaggttcatgccattcttctgcctcagcctcccgagtagctgggactacaggcacccaccgccacgcccggctaattttttctgtttttagtggagatggggttttaccgtgttagccaggatggtctcgatctcctgacctcatgatccacccatctcggcctcccaaagtgctgggattacaggtgtgagccaccgtgcccggcccaatcccagtactttgggaggctgaggcaggcgggtcaccctgaggtcaggagttagagaccagcctggccaacgtggtgaaaccctgtctctaccaaaaatacaaaaattagccaggcatggtggtacacacctctagtgccatctacttgggaagctaagtcaggagaatcacttgaacccaggaggtggaggttgcagtgagctgagattgtgccactgcactccagcctggacgacagagtgagactctgtctgaaaaaaactaaaaaaccactggccgggcactttgggaggctgaagctggcggatcacctgaggttgggagttcgagaccagcctggccaacatggtgaaaccctgtctctactaaaaatacaaaaactagctgtgcgtggtggcacatgcctgtaatcctagctactcgggaggctgaggcaggagaatcacttgaactcaggaggcggaggttgcggtgagccgagattgtgccattgcactctagcctgggcaacaagagcaaaactgtctcaaaaacaaaacaaaacaaaaacaaacaaaaacctgtttgattctgcaggtgttgataaggggtatggcgggctcctcactaatttgttaactttcattacctggtgcatggaagagtagcaggagataatatacagtaaatatgtagaaagtattcacattgagctgggcgcggtgactcgtgcctgtaatctcagcactttgggaggccaaggcgggtgcatcatgaggtcaggagatcgagaccatcctggtcaacgtggtgaaaccctgtctactaaaaatacaaaaaattagctgggcgtggtggtgcatacctgtaatcccagctactcgggaggctgaagcaggagaatagcttgaacaggaattcagaggttgcagtgagccgagattgtgccactgcacttcagcctggcaacagagcgagaccccgtttcaaaaaaagaaaaaaaagaaagtatccacattaaagccaaaactataaaatttggctgggtgcagtgcctcacacctgtaatcccagcactttgggaggctgaggcgggcggatcacgaggtcaggagatcgagatcatcctggctaacatggtgaaacccgtttctactaaaaatagaaaaaattagccaggcgtggtggcgggcgcctgtagtcccacctactcaggaggctgaggaaggagaatggtgtgaacccgggaggcagagattgcagtgagccaagatcgcgccactgcactccaacctgggcgacagagcgagactccgtctcaaaaaaaaatccaaaactctatgaaatttatgtaaaaataaagtcacaaaatacatatacaaaacaaaaaacataacatattcctactcctaaaacagtgtatgaaagattgatcaccaaaatatctgaaggattatattaattaccagccttttgtttttcagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtaagtgtttaaaaactggctgtgggccaggcgcagcggatcacgaggttaggagatcgagaccatcctggctaacacagtgaaactccgtctctactaaaagtacaaaaaatcagccggtcgtcatggtgggttcctgtagtcccagctactcaggaggctgaggcaggagaatggcgtgaaccctggaggcatagcttgcagtgagccgacattgttcctctgcactccagcctgggtgacagagtgcgactccgtctcaatggaaggttttgttagtaattactttagcatgtggggatgggatccgccttccccatctagacaggatctttgtcacccaggctggagtgctgtggcatattcatggctcactgcagcctctacctcaggggctcaagcagttctgcctcagcctcttgagtagctgggactacaggcatgcactaccatgcttggctaattttttgtagatacgggctcttcttgtgttgctcaggctggtctcgaactcctgggctcaagcagtcctcctgccttaggctcccaaagtgctaggattatgggtgtgagccactgcactcagtgggatggtgttttaatgagtaagtgtattttctttttctttttttttttttttttaagtgtcaagacctggctttattaattttattcctgaattctagaatgatataatttgtatttaatttgtgctttttaatattttggcaggtttagtgtttcaaatgacttaaagtatgatgctgaaagagatttaagggatattggagcaaaaaacattttggttcattcgttaaataaggtatgaaatctttttattcagttggtcattcaataaatattgactcatctgtgagatgacaataataatagctatgtatataaggggacactttttggaaaactttgatgttactccacagaaagcatagtgagtgctagccactattgttggtttgtggattcctatatgctaaacactgacaggcagtagccactcatcacatgtggctattgaacagtgtaagtgaccagtccaaattgagatgtgctctcaagtgtacagtgcacaccagttgattctctcaattttcagtgttatttttatctttcttttatagtttatatgccataagggtgcagtttagacaggtggcataccttgcactataggtcaccaaatcatatgcgatgtagatagttatggcttgggcagactggtttcagtatttgtacagctaatggacttgagttactcatacctctgctcacatgaaaacaattctgtaagctgaaagacaatgtgtgccagtgtgttttagaatgttaaggttcagttagcaaatctttattgacttactatgcatgcaccaattgttggtgctataaggttaaaatagactgatagggttcctggaagggcctccctagtagccctttgaaaataagtaactgcacctctacttcccatgtgagtcctaagttgaattcagtgttgccctaaacagtggcttgttagggtgggttttactgggtggatttgtagctataaagtactgtgtcttgaatgactgtatacaattcagaactaaaaggatgtaagtggcatctagaattttttttttaaatttcagagtagtattagaaaggcacattaacaattactcataattcttatgtatcagaaattaatcacagtgttttgcatatagtaagtgcacaataaatgtttgtaaattgtgactttttattcttatagggaagtttgtctggtttttaatgtttttttttgtgatgataaaagtttttaagactttgaaaactggatttaaaaaaaaaaaaaaaagatctcagctctgttgcccaggctgaagtgcagtggcacaatctcggctcactgcaacctccatctcccaggctcaagcagttctcccacctcagcccctgtggtagctgggactgcagacacgcaccacgatgcctggctaatttttgtattttttgtagggatggggtttcactatgttggccaggctggtcttggaactcctgagctcaagcgatccacccaccttgacctcccaaagtgttgggattacaggtgtgagccactgtgtcctaccaaaaactggatttttgtactataaagttgtgtgtttgtgttgtgtacatttatacaaataaatttgcgtctctgtacttttatgttttctgaagcctgtcatgggcctaacaagagttcctgcttgtgaatgtttagttgggatgaatgttgcagagagaaaggtatactaattaactaaattcttttcttttcttttttagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtggtatcctttatggcaaatatttttctattttttaacgacaagaaaattataaaagggtagacctttgggaaacaggaatcttgagattaaacgagttgctggagtgaaaactttaatgattacctagagtccaaagggattggaaagttgattcggttttttacctgtcagataggagaccaatgtttaatctcctggtttagaaaaatgttaatagatatgaggaatactgaatactgtattccccttttgaggattaacattgcatatttacatagcagaatacccgagaagactaagtgaaagaaaactgttagaacttagtggtcccaaacttgttcacagtatatcttttaactgtcctgcatgaggaacatcactttttgaaatgctgattaagttggttaccaatcatgcttctacttttacaagttaccagataacaacttcttgctgcagtgggttcttttctctgttttaatttagaggcaaattgctggtttaaattccaaattcagtgaatgtctttgaggctagagagggaggaggatgtaactggggaaaggcccataggacttcctttgtatttgcagtcatgaaataggcaatcagaaggcctcagggaaataaaagttaactcttcttgaaagactggagattcttacttaatactaatgtgatacattccttaactcattccatttagatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgagtatttatttatttaaaaatatatattgtaggttattttttcaactataatatatttcatttgtgggattttcaggtgcttctgaaccacgcaacatggcctatatgaaccgtcttggcatatggggtgagggtactccatttagagaattcagtgattttattcaagcagtagaacggaggtaatgcagtttacggtatatactcttctcagtagcaatctaagaagtgtgttattcctaaagcccattctctgtatgttaaaattctactgtattggtaattactgtatgttttaattttattcagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctggtgaggaatttttcttaattcctagtgtttatttaatgtatctgataatgtttctgttagttttggcgattgcgatgcctcctgcccatgggaatgtatttctactataaaacaacagatgaagccaggcacggtgtctcatgcctcagcactttgggaggctgaggcgagcaggtcacctgaggtcaagagttcaagaccagcctggcctacatgttgaaacctcatctctactaaaaatacgaaaaaaaattagctgggcatggtggtgtgcgcctgtagtgccagctacttggggaggctgaggcaggagaatcgcttgaacccaggaggcggaggttgctgtgagccaagatggtgccagtgcactccagcttgggtaacagagggatactccatcgcaaaacaaaaacaaaaacaaaaaacaaaaacaaacagatgagttaccagatgataggctgtttaaccaatgtgtttttttttgtttttgtttttaattgaagcagggtcttactctgtcacccagactggagtacagtggtgtgatcttggcttactgcaacctctacctcccaggttcaaggagtcctccagactctgcctcctgagtatcagggactgcaggcgcatgtcaatgtgcctggctgatttttgtattttttggtagagatgaggttttacagtgttgcccagcctgatctggaactcctgggctcaagcaatccacctgcctcagcctcccaaagtgctgggattacaggcatcagccactgcgcctggcctaaccaatgttcttatatttcagattgtccatgttttcattttgttaaggtaattcataagttatagccatttatttcagttgcatagttcttaaaatcacattattttctaaaatgactgcattaggtaataagaaacttgagacaactgtgtgagtatcctgagaaatagattcccaagttactaaagatgatttattaaattaatattaaatggtcttgcacttaacattgttttgatttaattggtatttttaaataactagactcaaagatgaagtgtctgaaatgttgattatgtatcttcagtgggtcatcgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaagtaagtagaagaactcattaagagattgtttgggggttatgttgtttagtctttgtgggtgctgaggttttctgcttgtaaaatctggttttcctaaaggatagtaaaacttctaaaaaatacatttcttaaaattataaaagcaatgcctgcttagagaatttagagagttcagaaaagtataacaaagtaaacatcactataattggtcatccatagctggtagcactggtaacatatggatgtgtattgcgttaaggttttttcttttcggtgaatatttatctacttaaagcataagatactataaactgtacaagggcaggggcttcactcatgcttactactgtctgtaatcctatctcctgcctaaatttttgacaaataacctgtctcaaatatgtagaagaaataagtaaaacaaatttgtgttttataataatgaggacattcttgtttgaaatctttgtttagctaaatgtttaaaatatgtcttggtaagaagccacaaacattattattcataattaacatgttttcttttttctccagtgtgttgtaattggtctgcagtctacaggagaagctagaacattagaagctttggaagagggcgggggagaattgaatgattttgtttcaactgccaagtaatgtttttgttcttttaatgtttttgtttctttttgagttcttccttaccttagttccaatgtgggcatttcctggagacaaaacttttgtttcacctgcatcatctttaagttttcttgatctgagttttctgcttttctgtaacagtgtatctattggaaaacaataacagaaatctcataatcctaaaatgttaagcattttgctaatattacacagagtatgtgaactaacagaagggctagactttgtttatcttgtacatcttggaaatctgtgacagcttggcttagattcagttttagtgtactgtatttgaaattaccgttatccacaggaacagtaactatagtttgtcctaatataacgaagtctactttataagttggctgagcatggtggctcacagctgtaatctcagcactttgggaggccaacatgggcacatcacttgaggtcagtagtttgagaccagcctggccaaaatggtgaaaccccatctcaactaaaaataaaaaaaattagttgggcatggtggcacacgtcctgtagtcccacctacctgggaggctgaggcaggagaatccattgaacccgtgaggtggaggttgcagtgagccaagatcgcaccactccactccactcccctctgggcggcagagtgagaccctgtctcaaaaaaaaataaaataaaataaagtctactttaaaagttgaaaataagcatgagatcttcagaaatagattttaaaatgttttaggcattgtttttagtttgcctaacctccacattcaaactctggtagtaaactgagcaaaataaacttgctgctctactattttgtgcctcgggatgcattcagatgctcctttcaaaagcaatacatggggctcacgcctgtaatccaggcactttgggaggctgagtctggtggatcacgagagctcaggagtttgagaccagcctggccaacacggtgaaacctcgtctctactaaaaatacaaaaactagccaggcgtggtggcgggcacctgtaatcccagctactggagaggctgaggcaggagaattgcttgaacccaggcggcggaggttgcagtgagctgagatggcaccattgcactccagcctgggtgacagagagactcggtctcaaaaaaaaaaaaaaaaagaaaaaagcaagacatacacctgctaatctatatttttctgtacataattgcctagaactaccgtgtccagaatggcagccgcttgtcacatgtggctattgagcagttgaaatgactggtccatattgagatgttattatatgtgtactgagccaggtttcaaagactccttaagagaaaataacataaaacatatgtgttgacatggtatattgagttaaaatgtattattaaaattagttccaccagttttatttattttttacttttttaatttaagctaccagaaaatacaataattgtgtatgtggtttggcttgcattcttattatttagttggacagctttgggctagaaaattaaaatttatttgagctcgtttatcagtattttgtaaaactgaacaaagtatatttcaatatatttaataatactttacatataattattttgtcaactgaagcagtaattgtcactgtttctctcctacagaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgagcactttaaaaaagaaaaaataggccaggtgcggtggctcacacctgtaatcccagcactttgggaggctgaggtgggcagatcacgaggtcaggagatcgagaccatcctggctaacacggtgaaaccccatctctactgaaaatacaaaaaattagccgggcatcgtggtgggcacctatagtcccagctactcgggaggctgaggcaggagaatgtcgtgaacccaggaggcagagcttgcagtgagccgagatagcgctgctgcactccagcctggatgacagagcgagactctgtctcaaaaaagaaaaagaaaaaagaaaatagttgacgttgaaaatactgttgaaattaaaacataagcattttaaagtggctatattttgggaatgaactgccttccatgaattcacaaatggttccaaattttcactgtcacttgtacaattttgaatgcacaagttatccccgttttaaattaggaattgagcaattcactggtggttggcagtgtgttaagcacttggctatatacattctaccatataacctggcagaggtccatacgaaattaggtcttatttttccaattttatagacagagatcattgaagcacagaaagatttaaagattaaagagttttcctagtttcacagagatagttaatgatgcatgggaactaaaacctgtgtctttgtattgtcagacctgttctttaatatatagacagctgggtgtttcagtagttttctttaaaagagccttttctttttttttcttttttttttttgagacagggtctccgtctccgtcacccaggctggagtgcagtggtaccatcttggctcactgcaacctctgcctcctgggttcaaggagctgggattacaggcatgcaccaccacgccctgctaatttttgtatttttagtagagatggggtttcaccatgttggccaggctggtctcaaactcctgagcttaagcaatgcacccacctaggcctcccaaagtgctgggattacaggtgtgagccatctcgcccagccctgttttggttttagaagttgacttctcgccgggcacagtggctcacgcctgtaatcccagctttttgggagttgaaacaggcggatcacctgaggtcaggagttcgagaccagcctggccaacatggcgaaaccccttctctactaaaaattaaaaacttagccaggactggcggcaggggcgccttataatcccagctataagggaggctgaggcattagaatcacttgaactcgggaggcagaggttgcagtgagccaagattatgccactgcactttagcctgggagacagagtagacactgtctggggaaaaaaaaaaaatatctggtcatggttgcatgtgcctgtagtcccaggtacttgggaggctgaggtgggaggatcacatgagccagggaagtcgaggctgcagtgagctatgattgtgccactgcactccagcctgggcaacagtgaggccctgtctccaaaaataaaaaggttttataaattgattttctattgattttctaagtattccatgtctataaacctgtaattattaggcctcttctcaaatctgatacacagtcaaattgtgactatgccagaggttctgcttttactctgttgtcctgaatatgttttgaaacttgtgcacttgaaggcagtcttgacttagtacttttgtatccaatttcttcttcagaataaatgtttataaccttattttttatgggagtccaaaaggttagtgctggtttgtgaattctgtttgttttttgacttaacctaaatacttttcctctgcacttttcatttgaattaattcatgaactaaatgtgatgtactggatcttaagaaacattgaatttgggctgactctcttgtttgtggcggagggtaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatggtaagttcagtatattaaatatacacgaaagcatataatatttcagtatatttgaaaatgggatatgaaaccttttcttctgtacagtacaaatgatcacacagattataatctttgcttggtggaaagctccaggcttatctaccttctggaagtttgagcctcatatatgtgagaagataacctcaattttgtgcagttatttttaacttgaaaacatggatttgtaccccatggtgtatggatgaaccaatgtaggtggtgataagttatcagttaacaatataaaaaatttcatccaggcgcggtggctcatgcctgtaatcccagcaatttgggaggctaaggtgggtggatcacctgaggctgggagttcgagatcagcctgaccaacgtggaaaaaccccatctctactaaaaatacaaaattagccaggtgtggtggcacatacctgtaatcccagctactcaggaggctgaggcaggagaatcgcttgaacccaggaggtggagattgcagtaagctgagattgcgccattgcactccagcctgggctacaacagcgaaacattgtctcaaaaaaataaaatttcaaaggttgtttcctttgaagattctgtacttgttttaacaaatgatttgacatgtatctttccttaacactcagatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccaggtatccatacagaaacttcctttttgaaatactgttttaaacaaaaatatttaaactttgtactaacttttagcaaatgttctttatctagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgaggtaaataggcctgtatctcttggtgacatttttgccatttgaacccctgtaaaatgagttgtattttgactgtcttcacataataatctaaatttcttagatcatagaattcttgttctactttagttgccatcctacatccaatgaactgctgcctgcagtatctgagtgtctgtcccaagccactggtcctagttactgcacttatcacgcatcttttgtgatcgtggccatgtgtcaaggtttttccagggactctgttgcagtgttctgtatccttcagtgtgtggtgcagcacagcctgtgctcttatctcccaagtgtcttcaaggaaagaggcactgagtccatccaccgcagtcagataccttcattgtaatgacattgtttggcttctcagatgactggccgcaagggacgggttgtgagcaatgatgatggaagcatatcttatgagtcaagatctgaacttgatgtgcctgtggaaatactaaacatcacagaaaaacaacgatttatggatggagataaggtatgttttactgagatgcttctcagtgaaaagaacaatgcctgtatatttagattaagctttagaagagtctttttccttttaatataagtcatgtccattgagtattgtcattctgtattttttagtaattgtacatactgaatattgtacgtgtttttattattttatcattgaatatagtaagtattggctgggtgcagtggctcaggcctgtaattccagcactttgggaggccaaggtgggcagatcacttgagctctggagtttgagaccagcctgggcagcatggtgaaaccccgtctctactgaaaatacaaaaatttagctgggtgtggtagtgcatgcctgtagtcccagctgctcagaaggcagaggtgggaggatagcttaaccctgggctatgcaggttgcagtgagccgagatcgcaccactacactccagcctgtgcaacagagctattacacaaatttttttagtaattgcctttactcactgaatattttgcatgtttttattattttatcattgaatataataagtattgtgtgtaatgcatagaatcagatatggctcttgagtgctttggaggcttttgaaatatttaatcatgatataaaaatactgtgttttctccaggcgtggtggctcacgcctgtaatcccagcactttgggaggccgagatgggcagatcatgaggtcaggagttcaagaccaggctggcaaacatggtggtgaaaccccatctctactaaaaatacaaaaattggtcgggtgtggtggcatgtgcctgtagtcccagctactcaggaggctgagggaggagaatagctggaacctgggaggcaggggttgcagtgagccaagactgcaccattgcatttccacctgggcagcagagtgagactgtctcaaaaaaaaaaaaaaaacgttcccttagttcatcttggtgttgtgacatctaatgtcattccgattttgagactaaaatatttatgtgtgtccatattactagtaattttggtttcactgtttattttattgctatgtcatgttatattaagacgatttactgtaaatggcttacagattacattcccatatccaaccattgtagagattttgggtgcctccagagactctttttttttttttttttgagacagagtcttactctgttgcccaggctggagtgcagtgcagtggcatgatctcaactcactgctaccttcacctcctgggtccaagtgattcttgtgcctcagcctcccgagtagctgggactacaggcacgcgccaccacgcctggctaatttttgtattttttgatagagacaggtttcaccatattgacctggctggtcttgaactccatgcctcaagtggtgtacccacctctgcctcccaaaatgctgggattataggcgtgagctactgtgctggcccagagactctttctgtagactttgtttgagaaggaccgtcactttgtcccccaggctggatctcagctcactgccacctccacctcccgggttcaagcagttctctgcctcagcctcctgagtagctgggaatataggcacacaccaccacacctggctaatttttgaatttttagtagagacaaggtttcgtcatgtttgccaggctggtcttgaactcctgacctcaaatgatccgtctgcctcggcctctcaaagtactaggattacaagagtttgagaccagcctgggcaacataatgggaccctgccctgtacagggaaaatagtcacatgatggcacatgcccacagtcccagctactgaggaggctgaggtgaaaggatcacttgagcttgagaggtgaaaactgtagagagctatgattgcaccactgcactccagcttgtgtgacagagtgagaccctgtctcaaaaaatatatatatacaaaaagataatgttacgtattttcaagattgtaggtacaggtattagttattttatataattgcttcatgaatctaggcccatatgcattaggaattacattagttggaattagttttggttgttaaataacagaaaatacaaagtctgttaagtgttgacttcaataagatagattatttctctcatggacacatttgggtaggtggagcagggcttgtatgccctcttgaagtccaggcatcttccgtgttgttcattaaattatgtgggcctccatttccaagttacctttgtattccaagatacctgttccagactcttgtcagtacctctacattttacctaacagagaggagacaaggggatgagaagggcatgtcgcctacttttaaggacatttcctgtgcatcatacattttacctacaccttgctggctggagaatgttcacacttagccgtaagggagactgggaaataaaactggaagtcttcattattgagaaagaaggagagaataggcagtctgctgaaggacttcatttaaggcactggcctgcttgttcttatgcaaaagtgactttatttttcttatatttgacacagaatattgctatcatctcagaagctgccagctcgggtatttcattacaagcagataggagagctaaaaatcaaaggcgaagagttcatatgactttagaattaccttggagcgctgatagagcaattcaacagttcggtaagttcctacaaactggatttcacttaatggatagctaggaatcattggggtaaatttgcgcataccaaaacctaggtttaggccgggcacagaggctcacgcctgtaattccaacatttcgggaggccactgtgggaggataacttgagtccgggagtttgagaccagcctggtcaacgcagtgagaccctttctccaccaaaagaaaagaaaaacagctgagagcagtggctcgtgcctgtaatcccagcactttgggaggctgaggtgggtgcatcacttgaggtaatagtttgagaccagcctggtcaacatggtgaaacccagcctctactaaaaatacaaaaattaactgggtgtgttggcacacacctgtaatcccagctacttagggtgctgagacgggagaattgcttgaacctgggaggcgcaggctgcagtgagctgagatcacgctattgcactccagcctgggcaacatagggagattccatctcaaaaaaaaaaaaaaaaagaagaagaaaagaaaaacttgctgggtgtggtggcgtgtgcctgtagtcccagctactcaggaggctgaggtaggaggattacttgagtccaggagttcaaggttgcagtgagatatgatttcaccactgcactccagcctgggtgacagagcgtgaccttgtctcaaaaaacaaaaacaggctgggcgcagcggctcacgcctgtaatcccagcactttggcaggctgaggtgggtggatcacctgaggtcgggagttcaagaccaggatgaccaacatggagaaaccctgtctgtactaaaaatacaaaattagccgggcgtggtggtgcatgcctgtaatcctggctactcaggaggcagaggtaggagaatcgcttgaacccgggaggcggaggttgcagtgagccaagatcacaccattgcactctacctttggcaacaagagcgaaactctaacaacaacaaaaaaatcctgtttaatgtcttatatcttatctcgaaatctcagatcttgcatttaaggagtgttatatatatactttatagtatatgatgcattgtggattcattttttgcttgtttacaagttgtaaaaaatatatatgtggtgggaatttgtggggttccaagaacagggttcctcaaggagtgtccttataaaacttaaggatgtattaggtccatatcagagaagctgctacttctatatgtgtttccaacctcagtagcttcaccaaaggcccatagctcctccctccatcttcatgttcttgtgaccaatgatttgaaaaacaattttgggaaaatccagagtaattgtgcatcagtaacatgtggttaagcaaaattggggtagcaatgctaatacttctgtcattgagcagttttatgtgtgttatggtaattttacattatctgtaatttttattgtttagtggtttcccaataccagtttagtgttaaatgctaggaatacatctcagaatattctctgtccagcgaacacaatcaatgatctttaaaacaaaatttcgttgcaggacgtactcatagatcaaaccaagttactgctcctgagtatgtctttctgatatctgaactggcaggagaacaaagatttgcatctattgttgctaaaagacttgagagtttggtgagttttggagttgtgtggctgtgtgtaaatgatgatctattgtacctgttttctggtaaaaggttacctgtgccttgattgaaatttttgtttttaacagggggcacttacacatggtgatagaagggcaacagaatctagagatctgagcaggttcaactttgataataaggtacatttcaattttcagtatctctgaaaacttgtgatagtgtatggtgtctttcgggaacacaaaaggaaagtagttactgtctaaaacaaaactgcctctcctatgcatttgctttaaaatcatggcttcctataagacagaatttcacatgtatgttagatcgcatgttaagtatcagtacagcaatgtagttgtctttattccttttggaaaacaagaataaatgagactgaattaactgtgagttctcagaagcaaaggaagttaatttttctcatgttttttatgtgtagagacatgaactaggcagtataaaatatatataaaggccaggcgctgtggctcatgtctgtaatcccagcactttgggaggccaaggcaggtggatcacttgaggtcaggagttcgagaccagcctggccaacgtggtgcaaccacatctgtactaaaaaaaaaaaaaaaatacaaaaattaggccgggatcagttgctcacacctataatcccagaatataggaggccaaggcaggtgggtcacctgaggtcaggaattcgagaccagcctgaccaacatagtgaaatcccatctctacaaaaattagatgggcgtggtggcatgcatctgtagtcccagctacttggaaggcggaggttgcagtgagccgagatcatgccactgcactccagcctgggcaatagggcaagactctgtctcaaaaaattatacaaaaattagttgggcgtggctgggcacagtggctcacgcctgtaatccagcactttgggagaccgaggtgggtggatcacgaggtcatgagatcgagaccatcctggccaacatggtgaaaccctgtctctactaaaaatagaaaaattagctgggcgtggtggtgtgcgcctgtagtcctagctacttgggaggctgaggcaggaaaatcacttcaacctgggatgcagaggttgcagtgagccgagtttacaccactgcactccagcctgtcaacagagcaagactccgtctcaaagaaaaaaaaaatttagttgggcatggtggcgggcacctataatcccagctacttgggaggctgaggcaggagaaccgcttgaacccaggaggcggaggtttcagtgagtagagatcgtgccattacattccagcctgggcgatgagcaaaactctgtctccaaaaaaagaaaaaataaataaatacatataaagataattgagaattgcttttttgaatctttggtacaataagtttgtgggttttttggggttttgttgagagggagttttttgctcttgtcgcccaggctggagcacaatgacgccatctcggctcactacaacctccgcctcctaggttcaagcaattctcctgcctcagccttccaagtagctgggattacaggtgtctgccaccacacccagctaattttttgtagtagagatggggtttcaccatgttggtcaggttggtcttgaactcccaacctcgggtgatccacccacctcgacctcccaaagtgctgggattacaggcatgagccaccgcacccagccagtagtttttatagtatttaggtggtcatgtgattgaagagtatccaaatgctgaaactggttaaaggttttgatttttttttgcagtatggaagaaatgctttagaaattgtcatgaaatccattgtaaacttggattctcctatggtatcaccacctccagactatcctggagaattttttaaaggtaacttctacaaatattcataacaatgacaatgattattgacaaagatgtactcaaacctgttgtaatgtttgctgttatattagtttttttctttggacataaattgtataaaactttgaaattaatggttactaggacacataattatcttgtattaaacagatttattaaagcaaattttattcaaatgaaagtgctcttactgttgatatggtgaaagcatgtttgtctaataagagatttaatagaggaaagttgttttagtacattgagtaaaatcactttgccaaatagccttttttaaaaattatttatttatttatttattttattttttttaagaccgagtcttttttaaaaattatttatttatttatttatttatttatttatttatttatttatttatttattttaagaccgagtcttgctctgtcgccaggctggagtgcagtggcatgatctcggctcactgcaacctctgccaacaggttcaagccattctcctgcctcagcctcctgagtagctgagattacaggcacatgccaccacacccagctaatttttgtatttttagtagacacggcgttgcaccatgttggccaggatggtctcgatctcctgacttcatgatctgcccgctttagcctcccaaagtgctggaattaacaggcatgagctaccgtgcccagccccaaatagcttttaaaattcaatttaattttaaagttgaaaaagtacctaggtaaataatctgtgaggattgattggttggggtgggaggtttggatgaaacaaaattggccatgaattcacagttgtttaaactgggtgatggatacatgtggctcatagcttagccttttttctttcgtgtatttggaaatgtcctttttttttttttcgagacggggtctcgtgctgtcacctgggctggagtgcaatggtgtgatcttggctcagtgcaacctccgccaccaggttcaaagggttctcctccctgaacctcccgagtagctgggattacaggtgcccgccaccatacctggctaatttttgtgttttcaatagagatggggtttcgccatgttgaccaggctggtcttgaaatcctggccgcatgtgatcctcccacctcaacctcccatagtgctgggattacagatgtgagccaaggcacccagatggagttagcatttttcactaggaagtccttttggtagattagcacatactgatatgtgttgttaacagttcatattgacataccagttagaggtgttcatcattactctcggctttcaacaaaagcagtaaagtcttaaccctacaccttcactccttttgacatcaggagtgtcagaaacaactccctggtctgggcacagtggctcatgcccgtaatcccagcactttgggaggctgaggtgtgaggattgcttgagcctaggaggtggaggctgtagtgagctgtgatggcaccactgcattccagactggtgagagagaccctgtctcagaaaaaaaaaaaaaagattccttgatttacttctaacttcttaaaattacaggttatggctaggcgcagtggctcacacctgtaatttcagcactttgggaggccaaggcaggtggatcatttaagctcaggagatcaagaccagcctgggcaacatggagaaaccccctctctaaaaaaattacaaaaaaaaattagccaggcacggtggtgcacgcctgtagttccagctgctcgggaagctgaggtgggaggatcccttgagcctgggaggcggaggttgcagtgaaccaagatgatgccattgcactccagcctgggcaacgtagtcagactctgtcgcaaaaatatatatatatatatatatatatatatagatagatagatagatagatagatagataggttacttgtttattataagtaatgacagtaatcttgcagctgggcgcagtggctcacacctgtaatctcagcactttgggaggccgagccgggtggatctccggaggttaggagtttgagaccagcctggccaacatggcgaaaccccgactctactaaaaatatgaaacttagcctgtagtcccagctactcaggagactgaggcaggagaattgcttgaacccgtgaggcagaggttgcagtgagctgagatcgcgcactgcgctccagcctgggtgacagagtgagactccgtctcaaaaaaaaagaaaagaatcttaacatgtataatgaagagagttaatacagtccccttaaccctccttccattctcaccttcttaggtcacagatgacagagtgaacaagggcagttctctccacattttctccatgtttatataaatatcaaggtgtttttttaaaatggcatgatactacttacaacatacttttctcacttagtggtacattgtagacatcccttgtaatttatgagtcagaattgatcctgttcttacagatgttcgacaaggactgataggcgttggcctgataaatgtagaagatcgctcgggaattcttactctcgataaaggtactactattagctttgtgtgggcatataactgttgctatagtattaaagtccattatgatatatgcttttgagctgaaggggaagcttcatgttcttaaaacattctgggtggttttggctgctgtggggtatgtgtaaaagatccatgcatagagaagcagttttcagcactggctgctgatatgatcagctctcaagcttttaaaaattactgaagtctgctgggcacggtggctcacgcctgtaatcccagcaccttgggaggctgaggtgggtagatcacaaggtcaggagtttgcaaccagcctggccaatatgatgaaaccccatctctactaaaaatacaaaaattagccgggcctggtggcgggtgcctgtagtcccagctactcgggaggctaaggcaagagaattacttgaacccgcgaggcagaggttgcagtgagccgagattgcaccactgcactccaacttcggcgacaatagagcaagactccgtctaaaaaaataaaaaaaaattggtcgggcgcggtggctcacgcctgtaatcccatcactttgggaggctgaggcaggcgtatcacaaggtcaggagtccaagaccatcatggccaagatggtggaaccctgtctctactaaaaatacaaaaattatccaggcatagtggcgggcgcctgtaatcccagctactcaggaggctgaggcaggagaactgcttgaatctggcagggggaggttgcagtgagccaagattgcatgactgcactccagcctgggcaacagcagagcaagactccgtctcaagaaacaaaacaaaacgaaaaattactgaagtcgggtggagctcagacatcggtagttttccaaagctcccagacattctaatagtgccactacagttgagaattcagtgttggagaactaactttcttatgtactgaattgtgttcatactttccataagtgaggctgaagatgcaaaaattcaatttgacaaacctcttttgagcgtgtcctgcagtggtgctaattgctagagagagaaatgggcagattacagccttgttgtgaggacagtgtaagagttaagaaggaagacttttagaagagaaagtgggacttgaactaagcctagatgaataaaaaatttttaattatcatttgcatgaaaacgtttatcttttgtcattacagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttaggtaagtagggaaaatttcccccccacaatgtccccagggaaaatgtggagtggagaaattctttaaacgtgtgtacctgataaaaatgttctttttacatttacatgtttctttttcttgttcaagatcttggttctggagatgaaaaagtgcggaaaagtgatgttaaaaagtttctgactccaggatattcaacctctggccacgtagaattatacacagtaagtttagaaaatgttgtgaagtatcgtcttcccatgagatgcatttacagaaatgagtttaaatttcgttgtttctcttacagattagtgtagagaggggaatgtcatgggaggaagctaccaagatttgggctgagctgacaggaccagacgatggcttttacttgtcattgcaagtacgacttttcctttaaattctattcagatatataatactttttaatggccagcattgtaattgtctcttcactttgtacctgtttcccagttgtgtttagctttgtctattttggtaatttatcattgtaattgtgtgtttgtccatttgtgttatgtttttacttaatgcattttaaaggatgttattaggtgtgggtttagaattgttacattttcttctttttttttctttctgagacagagtttcgctctttgttgcccaggctggagtgcaatggcacgatctcagctcacctcatcctctgcctcccgagtagctgagattacaagcatgtgccactaggcctggctgacatgtatttttagtagagacggggtttcttcactttggtcaggctgttctcaaactcccgacctcaggtgacctgcctgcctcggccttccaaagtgctgggattagaggcgtgagccactgtgcccagcctaatttttttatttttagtagaggtgaagtttcaccatgttggccaggctggtctcgaactcctgacctcaggtgatctgcctgccttgtcctcccaaaggaattatagatgtgagccaccacacctggctgaattaacttttttttgagattgagtcttgctgtgttacccaggctggagtgcagtggtgcgatctcggctcactgcaagctccacctcccgggttcatgccattctctttgcctcagcctcccgagagtagcagggactacaggcgcctgccaccacgcctggctaattttttttgtatttttagtagagacagggtttcaccgtgttagccaagatggtctcgatctcctgacctcgtgatctgcccgccttggcctcccaaagtgctgggattacaggcttgagccactgcacctggccaacattttcttaaattaagcatttttcataagacagagacttactttagtcttaataatgctttatatctttaagactcatttttcagttagtaaaatagctacattctttcagttatgatttgtctctgtggacagaactaaggggtgtgtgtgcgcacacatctatacatgtatgtgtagatactcaacagtatgtagatattcagcagtatcttgagtttcatatttacttactcagatccaagacaacagaaattttatttcgccagttctctaagatatttggggttgtgttgtttcgttttgttttgttttttgaggcagtttcaatctgtcgcccaggctggagtgcagtggcacgatcttggcttactgcaacctccgcctcccaggttcaagcgattctcctgccacagcctcccgagtagctgggactacaggcacgcaccaccacgcctggctaaatttcttatttttagtagagacagggtttcactgtgttagccaggatggcctcgatctcctgacctcaggtgatccgcctgccttggcctcccaaagtgctgggattacaggcatgagccaccgcgcctggcatgtggctaattttttaatttttcttttgtagagatggtgtctcactatgttgaccaggctggtttgaaactcttggcctcaagtgatcctcccacctctgcctcccaaagtgctgggattacaggtgtgaaccacgctgcctggccccttcgttcttttttacaaggctgagtaatatttcattggttgtatataacatattttgctttctgtttacaaatatttatggagtgactgcaagtaagacctggttcttgctcatatgaagtacctacatgtatgatgatggcacaggcaggatgaagtcataaatgatctagggcaggagttgctaaactttttctatgaaggtctgatatgtatggttttgtaggccatatgtggtctatattgcatgtcctctgtgttttccttccttcctttctcttttttttcccaccttccttcattccttcttaatcttacttcagtttaggagtgccaagctagatttattccacaggcctaagctgctgatccttgacctagagaaaagctctcaaaggatctggctcctagttgagttggggttttttggtttggttttgttttttgtaatgggatctcgctcgctctgtcacccaggctgataagcagtggcgtgcgtgatcatggctcactgcagcttcaacctcctgggctcagacaatcctcccacctcagcctcttaagtagctgggaccacaggtacactccaccacatttggcttttttttttttttttttttttaatgcagttgatgtctcactgtgttgtccaggctggtctcaaactcctaggcttaaatgatcctcccacctcggcctcccaaagtgctggattacagttgtgagctactgtgccttgctggttttggggtttttgaaatactgattgaactgtaggttgatttgcatgtcattataagaaacagtacagataaacatcttgcatacttttatcagttaccccagtggtaatattttttaaaactgtagtgtaatatcacaaccaagatgttgatattggtagaattcaagtattttactcggctatcccccatagatgcaattttgattggtccacataaggtgttggttattttcaggacagtctcgaactcctcctgggcttgatccatcctctcaccttgtccacctgaatagctgggattacaggcatgcaccactgcacctggctcttggttattatttttaaattgaaattattgccagaatatcaccgttggtagattgtgatgaaagtcctgatccccagcttctcttaggttgaaggatgtgataatactggtccttcattctctgtgtggcaacaggtggctgggcgtgaggagtggtggtcctagagacctcattcctggtcttcgtttgcctttgaacctccactgcattaggccaccatacttttcagtgtgtgtagcctgtgctgccattgggaaaacaatgtcagaatcactttccactgttctgtgatgatgtataattaacctgacactgtcaagacagagcccattgttaagtgtcttaaacactatcctctaagtataggtttggatatttcctgtcagctgataaataattttaaatataatcttcaccttaaccattgttttatgactttacagtaattatataaacaatgtttcaattcgttggaaaaagtaagagaccaagggtctttaatatccatgaagaggaaagtaaaatattgtgtttttcattataagaatgaatataaaaagttaatagccccgcaaacaatgatttattgtgtagagggctgggaaaatggttttactttgaaacttttctttttccttccgttttgctccagaaatgattgtttagaagctgttcagtctttataaagaagaaatgaattttccagttgtttttccttgagttaaatggagttttaagagtaactccttcctcttaaagtttttctcataaatccaactttaaaaagttaaaaataggccaggcgtggtggctcacgtctgtaatcctagcactttgggaggccggggcgggtggatcacctgaggtcaggagtttgagaccagcctggccaacatggagaaaccccatctctactaaaaatacaaaattagccaggcatggtggtgagtacctgtagtcccagctactcgggaggctgaggcaggagaatcgccttgaacctgggaggcggagcttgcagtgagccgagatcgcgcccttgtgctccaggctggtgacagagcaagactgtctcaaaaacaaaaaaaaaagttaaaaatacatacctaaattccaacatttctctaatgcttccctttcttccatttttacctccatatgtgtggacaatttgttcaacatttttgctttctgctgccatagcagctttgatgtttacagaacactttatcatgtgatctctcactttgcccttcaaaaccctgtgacatcgggaaaggcagtactgacggagtagacaagtgcagaggactggggccatccaaggccttatcttggaggggcttgaattctattgttaacttgaaaggagagtaacatttctttttccattttactgagaaatgtttaaaaacatacagcagagcttaaagaattttctctgaagacccctaatgcctactgcctggattccactgttaacattttattacacttggtttttcttacctctctgaggctgcttgactgggattccaggtacaggaaataaaagaagcaaaatgatctgtgttggacatttgtgcattaaagctaattccacgtagttttctgaagataactttggtctttaaccttcatctttagccagaattaaggtccaataactgcctcttgggtgtgactgtgttagtcttttaaacaagcattttcggtcctttttgaagttaccgtgtacttacttagtgttatagtctcaaatgattatgtttgctgacgtgatggtacagaaacatgtcttaaagtgtgtattataaaatctttatattttgtcattttctttaaacagataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtattttttcatttgtacattatattatataggaatacttactttgggccaggcaatgtggctcacacctgtaatctcagcactttgggaggccgaggtgggcagatcacctgaggtcaggagttcgagaccagcctgaccaacatggagaaaccccgtctctactaaaaatgcaaaatattatcccaggatggtgatgcatacctgtaattccagccacttgggaggccgaggtaggagaatcacttgaacccgggaggcggaggttgcagtgagccaagatcacgctattgctctccagcccgggcaacaagcgcgaaacttcgtctcaaaaaaaagaatacttactttagctgggcacagtggctcacgcctgtaatcttagtactttgggaggccaaggcggttggatcacctgaggtcaggagtttgagaccagcctggcccatatggcgaaacctcatctctactaaagatagaaaagatagccaggcgtagtgttgcatgcctgtaatcccagttactcaggaggctgaggcaggagaatcactttaacctgtgaagtggaggaggcttgcagtaagccgagattgcaccactgcactccagccagggagacagagcaagactccgtctcaaaaaaaaaaaaaaaaaaaaaagaatacttattttataatatattgaaattgtttaagatagcttttctaggtatgaaattatattttctttttctttctttctttttttttaaatgaggtctcactgtgttgcagaggctgagctggtctggaactcatgggctcaagtgattgtccacttctgcctcccaaagtgctagaattaacaggtgtcagccaccgcacccagcctggtttaaggaaagtgtcaacttttgttatgctaatatcacagtcttaatgttaccagccttaagaaacttctaaggttctgttacccaggctgggagtgtagtggcgcgatcttggctcactgtaacctccgcctcccgggttcaagtgattctcatgcctcagcttcccaagtagctgggattataggcatgtgccacacacctggctagtttttttttgtatgtttagtagagacggaatttcaccatgttagccaggctggtcttgaactcctggccttaagtgatccacccgcctcagcctcccaaagtgctgggattataggcatgagccaccgtgcccagcctaaaatgattatttgaaacagcttatctcttcagtaaaggaagcttccagtgctaatcacaaaagttagaatgtttaaagcccttctcactacctcttagttttattgtgaggatgcctctatgtttatattttgcaatgatttatagaaaatgttaagcgaccacttttcctaacatttactattaggttttattttattaatattaccttatattattatttgtagccattctgatttgaaaacaattatagttaagtagttatttgaaaaatgtattacataagaggaaccagcatgacagagcttttcaaatggcgttcagattcagttaatagcaagggttaggctttttgtgtagagattattttaaattggctacctctagaattacagaccagactaggtaaccagtttatttaaagcaatactgttttcaatgaaattcttctcatttttacaggtcgtctcagatgatgccctgatgcactggttagatcagtataattcatctgcagatacttgtactcatgcttattggttagtattttcgtgtttcctaccaaattttccaaaatttaattgagatttaaatacaccttcactctttatcagtatgtcctcatgaattaactaacagattaagtattgtcaggcgtggtgtgttccatcaggaatatttactggacagttgtagactagaaactgtttagtttatgtacctccttactcttcactgatgctttcttatttccagccaactgttgtctggcagcatgaccttaacagttatccttcatattagaacttgctttttcacggctgggtgtggtggctcacgcctgtaatcccagcactttgggaggctgaggtgggcggatcacctgaggtcaggagttcaagaccatcctggccaacatggtgaaaccccatctctactaaaaatacaaaacaattagccggtgtgatggcaggcacctgtaatcccagctacttgggaggctgaggcaggagaatcgcttgaacccggaaggtggaagttgcagtgagtcaaaattgcgccattgcactccagcctgggggacagagcgagactccattaaaaaaaaaaaacaaaaaaaaaaacaataaggccaggtgtggtggcttacgcctgtaatcccagcactttgggaggccaaggcaggtggataatctaaggtcgggagttcgagaccagcctgaccaacatggagaaaccctctctactaaaaaaaaaattagctgggtgtggtggcgcatgcctgtaatctcagctattcaggaggccgaggcagaattgtttgaacccgggaggcggaggttgtggtgagccgagattgcaccactgcactccagcctgggcaacaagagcaaaaactgtctcttaaaaaaaaaaacaaaccactttttcgccctccttctgtcactctcccttcatgtttttttgtttggttggttattttaaagagacagtctccctatatcacctaggctggagtacagtgcagcaatcatagctcactgcagcctcaaactcctcccatctcagcctcctgagtagctgggctcttttctttcttcctctcttttttaaaaaagctttactggtgtcccagatctagggaatgtctaagaaaccagggagattcccaaagttaatagcacagcacatgcaaacttttgttgttgagtcttggagctcttcctgctgtgccccctcaccccttggcttacagtgttcactttgtgacctcgtatactcttatactctgcaaatcatagttttcttctcattgttctctccctcattaagtagttaatgctcttacagtatctggcccacttcatgaaaaggaatatgagatgtaaatgaattttagcttgaggggctttttgtttgttttgattgtttgggctgttctgcaggtagataagttggctttgatgtgagtagtgcttttggttttcattatgagagtaaattagtgccactgaaaattagaaaaaatctgtaagataaaatgttttaaaaggtaggctggctaggcaccattggcttgctggtagtaccagcactttgagaggtcgagatggatcacatgagtccaggaattcaagaccagcctggccaacatggtgaaaccacgtctctactaaaaataaaaaaattagcagggcatggtggcagacgcctgtaatcccagctacttgggaggctgaggcatgagaatcgcttgagcctgtgaggcaaaagttgcggtgagctgagatcgtggcactgcacccctgtctggatgacagcaagacgtggtctaaaaaaaaaagttttaaaagttaacctactaacttgggttttttttttgtttttttttgttttttttttgagatggtgtccttgctctgtcacccaggctggagtgcagtggcacgatctcagctcactgcaacctccatctcccaggttcaagcagttctcctgcctcagcctcccgagtagctaggactacagtgcctgccaccatgcgcagctaatttttgtatttttagtagagacagggttttaccatgttggccaagctggtctcgaactcctgactttgtgatctgcccaccacggcctcccaaagtgctgggattacaggcataagccaccgcgccttgcccctacaaacatttcttttttttgagatggagtctcgctctgtcacccaggctggagtgcagtggtgtgatctcggctcactgcaagctccacctcccaggttcacggcattcttctgcctcagcctcctgagtagctgggactacaggcacccgccaaccacgcccggctaattttttgtatttttagtagagacggggtttcaccgtgttagccatgatggtcttgatctcctgacctcgtgatccgcctgcctctgcctcccagagtgctgggattacaggcttgagccactgcgcctggcctaaacattttctaaaacatttcctctggggacagtgcagtggctcctagcactttgggagatcaagatgagaggattgcttgaggccgggagtttgagaccaacctcctcaacacagcaagactccatctctacaaaaaattaacttaaaaaacaacaaacatttgctttgagttatagcaagaaaagtgtcctatatacctacatttaacactgtattagattcgtcttgagttagtactaaccagaagggcatctttattgatgaatattctgaagataattttaaccagaaaacattgatggtatttctcctttttctcatttcttcttaaatttacatgtagcctctcgctcccctcccacccctttccatctctctagattgctgagtccttcccactaatgtgatttagaaccagtgtatcagtagtttcataatatagaaataactggcaggatcttcccccctccttcttttcttttcacaggtattgcttgttttttcatggcaggatctctcaggatcttttttcttttttaaacagagggcttgagtgcaatggcaccatcttggctcactgcaccttctgcctcccaggttcaagcgattctcgtgcctcaaccacctgagtagctgggattacaggcatgcgccaacacacttggcttttttgttttttttttttttttttgaagacagagtcttgctgtgtcgcccatgccagagtgtagtggcctgatcttggctcactgcaagctccgcctctgaggtttacgccattcttctgcctcagcctcccgagtagctgggactacaggtgcccgccaccacaccctgcaaattttttgtatttttagtagagacggggtttcaccatgttagccaggatgctctggatctcctgacctcatgatctgcctgcttcggcctcccaaagtgctgagattacaggcgtgagccatcgtgcccagccagttttttgttttgttttgtttcgttttttttgagacagagtctcactctgttgcccaggctggagtgcagtggcacgatctcggctcactgcaagctccgcctcctgggttcacgccattctcctgcctcagcttcccgagtagctgggactacaggtgcctgccaccactcctggctaattttttgtatttttaatagagacagggtttcaccgtgttagccaggatggtctcagtctcctgactttgtgatcagccggccttgtcctcccaaagtgctgggattacaggcgtgagccaccgcacccagcccatacctggctaatttttgtattttcagtagaaatgaggtttctccacgttggccaggctgatctcaaactcctggtctcaagctgtctgcatgcctcagcctcccaaagtgctggggttacaggcatgagccaccatacctaattattttaaactttttgtagagatagagcctcgccatgttgcacaggctggtctcaaactcctgaactcgaacaatactccctcctcagcctcccaaagagctgtgattacaggcatgagccaccctgcccggctagcaagatcattttataaagtagcaatattgcagtaaaataatggatattaaaatgactaaaatgcttcaacagatagcaaacacaataaattcaaccctttttattgggaggcaggcccctgaaaaaatcgtggttttaaaaatcagcctgataccttaaattggaaatgctaacccaatgggccaacagaattataatctaagaaatagtaaaggcaaatactgctgaaacattgtttatttgaaatttgaggccaagagcggtggctcacgcctgtaatcccggccctttgggaagccaagggtggatcacctgaggtcaggagtttaagaccagcctgcccaacatggcaaaacaccgtctctactaaaaatacaaaacaacaacaacaacaaaaaaaagtcccagttactcgggaggctgaggcaggagaatcacttgaccctgggaggcagaggttgcaatgagccgagatcgcaccactgcgctccagtctgggcaacaagagcaaaactccatctcaacaaaaaaaaaagaaaagaaaagaaatttgagttgaccttgtaaatcttttagaaacgtgtctgtgtgcatatatagacactcatatgtatttctttcccatttttcttaggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtgagtctaatttttgttttggtttgagttgcaggaaaaaatcggatccgacttttttctcattgctaatatcttagctttattccacatgcatctaacatctcttccagtagtgggtatgggacccgttttatatttcttacaaggttgaacagaagttaagccttcaaacagacattgttggttctggttgaagttatgatgtggtcatctctttgatgctgctctcagctgctcttgctctccttctctactcttggtggctgtgcaggctccctggtgtgtagacagttcagcctcttgcccaggagttctccattgagctaacttaagactctggaattcaaaagccactgtgcacagagaatggcttggtgtcctgcagggagcaagggtagactaggccagctattctcaccgtgtgctcaactacaggtgtccaggaagcagggcagcaactggactctgtttgcttatcttggtttcgcttacagcagccttcctctaccacggattgcatatcgggagttcatgggccaaagtcagtctatggaattttttttttttttttttttttggacaccagtattttgggatgttgtaggttttcatttgaattaatgaatttttttttttttttttttttttgagactgagtctcactgtgtcgcccaggctggagtgcagtggcgtgctcccggctcactgcaacctccgcctcccgagtagctgggattacaggcatgcaccaccacacctggctaatttttatatttttttagtggagatgggttttcaccatgttggccaggctagtctcaaactcctgacctcaagtgatccgcccacctcagcttcccaaagtgctgggattataggcgtgagccaccgagcccagcctcatttgaattaattgccaacatttaaaaatcaagaggtttcatataaaagtctagatttccagtttcaaaagcagcccatcagctgggcatggtagttcaccttgtaatcccagcattttgggaggctgaggcaggaggattgctggagtccaggagtttgagaccagcctaggcaacacagtgagaccttgtctctatttaaaaaaaaaacaaatagggccgggcacggtggctcacacctataatcccagcactttgggaggccgaggcaggtggatcatgaagtcaagagatcgagatcatcctggccaacatcgtgaaaccctgtctctactaaaaatacaaaaattaaccaggcgtggtggcaggtgcctgtagtctcagctacttgggaggctgaggcaggagaatcacttcaacccgggaggcggaggttgcaatgagccaagattgtgccactgcactccagcctggcgacagagcaatactccatctcagaaaaaaaaaacaaaaaaaaaaacacatatatatatgcatgcaatttatctggaacattgagccttcaatcctacatgcaggacttaaagttcccttaaccagcacccagagagtatcctttccagtttgctagtatctgctcttctaagttaacctgtttcggttagcatttgaatttgcaacttctgttctgtagtcttttggtgcattaaaagataatacatagaataatagatattcttaacctcctgttaaaaagagaataatagatattcttgacttcctattcctccaacaagatagcattacactaaacacatgcatatgcttgggtatttgtgggaaatgctgtggaagaatcagactacatctcaatggccatttcatttattaggtagtcgtttaatttttgtgtgaacttcttgtccattacgcttaatattatgcctcatttggaatctgctgtgaagctgtacagtgtggtttcttctggacacaacttgataaattcttgttactaattacaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttctttttttttttttttttttttttttttgcttccacaggttgcactattgaaaaatcgagattgtataaacctggtaaaaagctgcaagatgccaaaatcttgtagatgtcaaataaaaagttattatactaacaagaagtggactcttgtttaggccctcactggtgaccttcagaagtagtctgtgacggggactcagcagaatttgtgtgttgtctcagcattccaggtagccttatagtttggcttaaaacttatccctaaaatgtaagatggcattgagggaaagggtataatgatagtacttctgaatgttttttaagttgaattgtttgtaaacttcttgcagaattgggtgagatgtgtgttaaaactgacaaacctggctgaaagcttagggcgttcatcctcttgtgtctcctttagcctgagtttggttatgtcaagcttaccgtaagttttcttaggatttatttattcttggtgcctaaaagaataaattgaaagtactttctgttctttggcacattttgcccagcggatgcaacttctatcctcagtccagttcatatatctcaggcagtgatccattttgtatcagccagtttcccttgttagggccgctagacccggctggcagccaagagcagcactctccccaccttcagcagaacttctcagctcatgtgtgtgtttttaaaagcagtaggcagcttccatcagcaatggaagtgtcccccactccagtggtggaggtgcagtcgctggacctgaggaagtggggaagcattacaaaccctcctgcagtaagaatggcagagttgggaaggatcttctctcgcaggctgttggcccaactcctcttttctgtgtatgagggcatcttagttttttatggcgttttcaaagcagcatatgaggattcttagcatgcagctaagtgacaacccccatggcctatgatgtaatgtttgctctggactagccatcttgataaataggagtgtatgtatcttaggttctttgtagaacagctatttttttttctcattaaaaaggcctctgaaagccctctcaaaatggacctcacaaaggcaaccagtgtgaatggatgggagctggggtgctgcatgcccaggctggtcatggtgtgtgcagcacccagagagttgcacccaccccttcttcaggtggacatccgacctttacactgtggtcttgcaaaaatcagcgagttagtttggccgccctgtgaagcttcagcattcaaggtcctcttctgttaaaacccaactcgtagccgggcgtggtggctcactcctataatcccagcacttcgggaggccaaggcaggtgcatcacttgaggccaggagttcgagaccagcctggtccacatggcaaaaccccatctgtaccaaaaaatacaaaaaatttgccgctgacttctgtaaaataggtccattcattgcaggatctaaatgccacacctgaattcagaggccttgtttaattaaccccatgtccactttgcctctgcaatgcctttttctttttagcaatatggctctgagcacaaagatttggttggaaatcatgttcgtgttttcagagtttacagcgtcaattgtactgaaaaccacttccagagtctaaagcagctcagatgttatctctgggggaattagtgttcccctcatttagcaacctccataccacaaggtctctgtctgtagttactgggattatccagatacactatcaatgatacaaattcataggagtattaatgcatttctttaaacacaacttgattaagaagcaaatatgttaagcagttttctttttctgctgctaaattacagttagacacttcagtatcttctctttacatgtgtatataaattagtaagaacctgcatccaaagcaatgtagtgtgtgtatgtatctatatatatttattctaactcagcacttcagaagcctttttgagttacaacaatattttagtttgcctcatctgtagaggtaaaatttctatattaccaagctccagaggaatatgatattttacaggcacaattttctggctgtagtccctggggcattcatttgctggcctccatgggatgctgttagaacaattgttagccggcaagagaagaaaggctaccaggacagcatttataattgtagaatgggagccttcttccctctcccctccactttcattttagcatgagataaaaaaatagattggaaatgattgttgcatctcacttcatggaagtaggggcagaagttccctctggatccttttcttgacaagcagtcaagaggaaggtccccatacacatgtacctgtgtgatacttggtagtttctaagaatggtgctacataagcgttgctgttaggctgggatcctattaatgaacgtttgattagttcaggcctcccaatggcaaaggcagacaccgtggagatggacatttactgactccccttctgtgtggcttcggtctccctggctaacaccacacctgtgcgtactgcgctcggcccactttgctgcagaaacgtagcaagcgtttcatgtcagggctacagctgagagcaaaaactgcaaaaaaaaaaaaaaatgtctcattgaatgccagttgtctgatacaaatgcagtgtcttttaagtgacagaaacacacctaaatacctgcaactcaagctcgctagcattttttttttgagtacttgagataaaatccaaaacccaccctctaattttgtgctgtatttatatatatgtacataaatgtatatatagagaaatgttgagttcttctggattctgaatgtaaataattcttgtaaattgggactctgcccacctgtttctcccttttccctcttcccttcagctctatttattcttttcttgactttcccatatggggcatcttatgacttttttttttttttttttttaagaaaagtatggaaaacttttcatttagaaaagtatttgttcctgtattttagaattcagttttgcatctttgctgtagaattcctgttttgtgttaatgttttttactatgtcttattgtgttgtgtgcaatgcattgtactggggggatgcacttgagtgccatttctgatactgtcattgtatgactgctgatgctcgtttatgttgttctttggaagctatagtgagcctgatgttttcacattttaaaaaatgcttcctgagacttctttaagctcctctaacttcttcagtgcatttgggatcaaacttagctcttagatcagcaaacctgacttgcttctacttttgcaatttttcaggccttaccatatttcttatctctgtcttcccacctgataggaaaatcttgcagatttgaaacagtggtttctggcctgctgctgcagcaaattccctatgtttatttaagaagtcgggcctatgcttttaacctacaaatgatgagtaatttacttgcaatgaacacaggtagcctgctgctgtttataacctgttgaggatatttatagcaggcaggaggcaggcctagtgtgttattgacaggtgactttagagaatgtacattggccgggtgcggtggctcacgcctgtaatcccagcactttgggaggccgaggcgggcggatcatgaggtcaggagattgagaccatctcctggctaacacggtgaaaccccgtctctactaaaaatacaaaaaaaaaaaaaacttagccaggcgtggtggcgggtgcctgtagtcccagctactcaggaggctgaggcaggagaatggcatgaacctgggaggcagagcttgcagtgagcccagatcgcgccactgcactccagcctgggcaacagaccgagactccgtctcgaaaaaaaaaaaagagagagaatgtacattaaggaacaattgtcctccaaaagagagccaagcaactgctctggagcctcctaggctgactctgctggagggtgagacaagcagattcccattgcagcactggtccctggggtaccctgaacggctgtgctctccacccttgtatcggtgagtggatcttgtctacatcagccgtaagcctagaagcagagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtgaaggccactctgcaggcccctggtgagaacctgtctggcttttccactgcgggcccctaaccagtaccctgcccttgtggcccatttgtgcctgggcagatgtttctggccagcagacactgaaggcctttttgctgtgacagtatttatggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtca

SEQ ID NO: 571 - DNA, 25374 bp, Homo sapiens
aggcccaggaaactttacccggcctaacagctgaggcgctttacggcgacggcggctgagtgagaaccttggcggctgtggaggctgccgcggctgcgaaggaggcggcggcggtggcggaggaagaggagtggcggcagcggcggcggggacccgtgcggggtgagccgtgaggaggggccgcgagtgacagggctggcgggtgggcccgggcggacggggacggtggccggctgagcagctgggcggcgctgaagagcgggggggtggcggggaattggggggcagctccgtgagggacggtttctgcctttgttccccccacctcggccgccccccatccgtcgccccctgttctccgcgctcctcggccgggtttcatggcctcccctctcggtctgtgtcgcttctaggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggtaagtggatagaataaaaagagggtgaacccagcagtgatcgagactgtgcggggcagggagtgagggcccagaatgtggcagtggatatctcctgctgcgtatcatagtacgttatatgatgtcaagtgctgtacacattcctagttatttaatgaaattgttttgaaggtaagacttcatgattcgggttaacgtgatactagtgtaactgcagcaagcctgtatggtggcgtgtttcactggggtgggggtcttgtgtcttgtttacattagattataatcgtgtttaaccgtctttaattacccgcccgcatcctcaaacactttacagtcatttaatttgaacatggttctgttcagatacaggccttattagtctctcgattacaaccataatcagggaagagtgtatgcataaacatgttgtggtgaacatggatgtcagcaaacttggtgtggtcatattggagaattaaatcttacaagcattttcggtaattatggagatgtttctctttacttcaactggacaattaacagttgtagccagcctgctttctggtactccattccagaaagcgctactaacacttctggtggctgaaagactcctgaaacttgaacaaaatacccttttgtggaatgtagaaaacttgtgtgaaattgttaccgatctgatttttttttttttaatttaagaaactggttgtagatgtggccaaacactagtaacactggcttgtgtagagtataattgacaataatattacacgtaagtgaaagacttttggacggtttttaaaaattaacatagtattggcagtaccagtaatttcttcacaataatattgacccatttcagtctgtatgaaccctttaacttaaacgttgactgcaggtgtatgctttgtatcatgtgctcacaagcatattgtttctgttgaattttactacagaaagatgacatccttttaaggaatattttttaatatgtgaagggaaaagccaccattacttaatgttttagcattggcttagtttcacttggtaattccctgcaagatattttgacaatacttatctttttgattctctagcttggtgataatttgaaaatgtaacctgggtattgtagataatggtagttctattttctgtcttaacttgcttaaacttcaattcagtacatttgttaaaactgtgggtactactttatattcttgaaaactgctctttcagtattctaagcattgtatcagaatagttctaagacatgtctgtgtcaatgaatatgagaaaatgatttatagcactattataaatgtcatatcaaatgccactgtaattgctaaaaattgtagatttagttgtaagttaacccacagaagtagatgattgagtcacatttcaagttgaaatagatgtttttctgtcaattccaggaaatagttgtgtatatgatatttagtcaactttgagtcctgatagttacctaagcctctctcaacttgtttgctattttagactctggtcaacaatattagtaaactttagatttgattttatgtagaaccctcccaattcaccagctaatgtgtatgttagcctttagtagctcaagtttgtttaatattctgagtatctagaattgcgatatgcacaagtggttgacctataagatttactggtgcaagtatgaatcaggaggtattaaacaataataaaacagtaaaaaaacaaccaggccatttaaaactgaagcctttatcttggcatacttttaaatttaagtttcccataggaactatttttttaaaaatacagatgcgtaaatgtctgtttattttaaatcatatccttttagaactgaaagccatcctagagataatctagcccaacttaggttttgttctgttttgttttttgattgaaaaaaagttaagaaccaaagtgacttaaaatgtttcaatctccagatatttactgacagaggggtaggttttgttttgttttttgattgaaaagaagttaagaaccaaagtgacttaaaatgtttcaatctccagatatttaccgtcggaagggtaaagctagaacccagttctcctggcctctcattatggtaacaaacaagaacctgaaaaatgacatacccttgatccattcagtgaagattattgtgtcaccaagttatcttcaccaagggacagttgcccttacatcaatctcaagagattaaaaacctccaaaatgttccgttttccgtggataacctgtaatgggtcaatggagtatatggggttgaaccttacaaaattgccaatacttgattaataaaaatgatagcttattatgattcttcctaattgtaaaagatgtaaaaaaaaaaaaaaaaaaggacaaatgtgagacactttcagttactctgtacttaaccattttatctttacctgttttcatagtaacattttcagttgttggtatctttttgaagttcttaaacttactctcagcaaatgtaacatagtacttccatttatttgttctaaatttaactttttggcttcctccagttttctatttgtagtgttctagaatttgggaatctctcactttatttttttcatagttttatagactgacaaccctttggccttgtagtgttaagtcttaatcttgccggggatttttcagttcccatccttgaaaaaatacatttaatagcgtgaattccaaatgtatatgcagagcttttatttggaaaaattgacaagcaatttagtgattcctgtaaatgtaccacatattcatgagtagtttatcaggaaaaaaaaatgcagcattggtcttcactactaatgtcatcgtaatggtgtatgatatattgggctttttagatgatgtatacagcttgatttttgctcctatagattctaaattaggaagaaatcaggtcttaagaatgaactaatttaatattttgtttgcttattccatgctcaaaggacaaagatttgtttgaaattcctgttcagattgaaagtactgtccagttgtattgtgtttaatggttttaatttttcctcatttttggatagttttatataaggtgtagctattctgaggtttgtatcatcaatctaatacaggttttcatttcacctgagcctggcttatgaggtcaggccaaaattttttctggcccttttaaatataccatttggtctgtgataattttatgtatgtgtatgtatttatacgtgtctgtatatacgcacatatatttgaagtgagtttcaaatcagaaaaagctttcagagttggtcgaggcgatttttgtgcatacttcaggtctttgtttaaaaaatttttttaaaagattgatgtattgtgagggaaaaaattagaaataacaatttcagaggtttattgacccaaaatagttttggaatgtgtgataaaccagaaatgaattagcgtgggttgttgaatttcatattccttcaaaaggatttttccgacctagtttaggtttgcatgaaatggattagaattatcttgctgaaaagatttctccacagttaaaaaaaggccttttaatcaatttacagaatgacagactaaaaaagtcacaaatttaaaatatgtattaattataaattggacattacttattagttttttgactcatttctgcttttgttgaaatagtttcttctggaaagttaatttatggaaaacagacttcttactgacacattatttaaacagttggagatactgccctatttatatttaccagaaatactgtgttactagaactttttatcagcattggaatttttgaaaaacattttcaatggtaacactagaaatcttaatgaaaatgggggatgattagaatttaacatgtagcttttaatactctggaaagctgtacgtttttattaaaatagaaatttctgtaaaattaaagcttttaacataaagctttgattttgaactataaatattctgagagctttatgacagttatccacactatcaggagtatcctaaaaatgagactatgctacacttacatatattaacaaaaacctcttgggtatggtctaagcaataccttataaactgtgctttttctgaaaatttttaatttttttttcctgatcgaaatctaccattcaggtgtaaatatgtattatatctggctttcactaaaactttattattaaatttattttcatttttttcttttattgagatggggtctcactctgtcacctaggctggagtgcagtggcacgatctcagctcactgtagcctctcccttcctggctcaagccattctcctatctcagctttccaagtagctggaactacaggtgcatgccaccacacctggctaatttaagtaattttggtggagacagggttttgccatgttgcccacgctgatctcaaacccctgagctcaagcaatctgcctgcgcctgcctcccaaagtgctgggtttacaggcatgagccacagcacctggccattattactaaatttaactgaatatatttaaatttacattctgctgatgggcaagttttacaatattttatgtcctaatgaatagactttttctttataatcattttttttttgcatatttccccttccagaaccttaggtctttgttgcaaataattgtgattttaagcacctcatatgtaatcttataaagtacttgaatgtttaccttgtggaatcttgtcttttttccctaggctttaatagtaagcataaaaaattcatgttctaaagaatattgagaaattttaacactggaacatttaaaggagttaggggatttagatttctgaaacttctgtgactgctgtcttgcaagagttcccattatcttcccccgtcgaaaatgcttaccaatggttggttgttgttttctctggataattgtgcagtacctgatggcaatgtattcttcataactgtttgtttatttttaaggccatggtaggggaggagtgtgtaggtgccatcgtttgcaagttggatatgcacaaaaagatgttccgcagaggttatatagccatgttagccgtggattccaaatacaggagaaatggcattggtaagaaaaatattattttatggaaagaatgcctaagctattttcatttttgttgtgttttgaaataaaagacttaaatgtaagtatgtagaaatgaaagaaactaagggaagaaaattaaggcgggttttaatttttaatttcaaaatggtatttttaaaaagttcttaaaatgaattttttctttattaatgttttgtttgacagtttttcgttttaacaagtagccgatcatcagctttcacctgcagatttttttaatcacattcaaaatgctttgcattatgctaagtaccacaagaaatactgcaatttataattacattatgatggtccttcatgccagccttcaagcacttgtctgtatttgggttaagtggacctcaatcaagccaaaattatggacaaattgttaccattacttggtgctagtcatcaactatatattgcaattcaggaaagatcaggagatgagaattgattgtttcttgtaattcccaaacttaattttttgttgggtctacttttcctgacatgtttagttaatcttaacactcatgatttataatgatcattagaatcatgtgggtggtttaaaaacatgtatttgggcccctcaccctgagactcttgtttgtcttgtcagaggtggggctgaagcttccctaggtgactgtgatgtaagcctgattaagaaccactcttctatggctgggttagataacttttgtcatttaaataacgccataaaactcaataggccaccaggtgccgggtgcggtggctcacgcctataatcccagcattttgggaggccaaggcaggtgagtcactaggtcaggagttcaagaccagcctgggcaagatggcgaaaccctgtctctactaaaaatacaaaaattagctgggagtggtggtgggcacctgtcatcccagctactcaggaggctgaggcaggagaattgattgaacctgggaggtggaggttgcagtgagcgtgccactgcactctagcctgggtgacagagcaagactccgtttcaaaaaaccactcttctattctctaggacctagtggctctttgttcacagtggagaattgggtagacaagcatttgtctaagcatgtcaaattttgtgatgtgctttagctgagtattcataaaaaaaagtttaatacctgtaccagtatttaatcattagttttttcactttcatgttttttaaaaactattaagtgttattgtccaacctaagactcacacacggtcctaggtatcatgagaagtaactataaataggtttacttaatatgttaggtttagccaactttattgcagtgttacagctttccactaagatttttaatgaattgggcttgttttatggactaagtttgagcctttgatgcattaaaaagcactgataaggactcatgataaattatagccaattgtttggctagtttggagggcagaaaccagtggcttttgggttgcatcctggccttcagacatactttgtttgggccataaaatgcgtgcatacttgtatgcatggcttgaaaattaagagtttttaatttaattttattattttttgagacagagcttcgctgtattgcccaggctggagtgcagtggtgtgatcccggctcactgcaacctctagcacctagattcaagcaattcttgtgcctcagcctcccaagcacctgggactacaggcacacaccaccacacccagctgatttattttttttattattatttttttttgagatagtctcactctgtcgcccaggttggagcgcagtggcatgatctcgactcactgcaacctccgcctcctgtgttcaagtgattttcctgcctccgcctcccaagtagctgggattacaggcaccctccacctgtaatgcctggctaattttttattttttagtagagatggggtttcgtcatgttggccaggctggtcttgaactcctgacctccggtgatccgcccaccttggcctcccaaagtgctgggattataggctgagccactgcacccagccagttttttgtatttttagtagagatggggttttgccatgacctcagcctccaaaatgctgggattacaggcgtgagccaccacgcctggccaattttttgtatttttaatagagacggggtttcaccatgttggccaggctggtcttgaactcttggcctcaagtgatccacctgccttggcttcccaaagtgctgggattacaggcgtgaaccactgcgcccagcctaagagtttttaaataaaatttgtctgtctgctcttaaaatcagatttggcaaattttttcccttttaatataccaattatatttgaccctaaactaggatacattttgctagacatgtacagacacaccactgacatcattgggagtgccagacttgccagacttcatcgtgctcactgtaaagtttataggaacctactgtgggtaacagcagttctgatgaggttgtcttgtcccttgtgtccaggggagtttgaaggatctttggtgagatcagcttgggttatgcagtaagttctggccaactcacggggagttcctgcgttgttctggccataccatatcttgtctttttctctttcgctttcctactgctttcaaacacaatagaacaaactcctgcttgtggcaaataattatgtctgagaaaaaggagtatattgggagataggtctttcaagaggaaacatactgttatgtataggttctgttggcttctcttagcttatagctaaaatttttcccatttaatttgaggtaatccgtgtatctggattcaagatagaaactagcatttgacatttctgtgcttacgaatattataatttaggttatctttaagaaatacatttttccttcattaatactcagatctatattctaggtactaacttggttaagaaagctatatatgccatggttgagggagactgtgatgaggtaagtctttaaaaatgtttaatattttttatctgggcattattctttctgggtatttttaataaatattttataatttattgcagatttcattgcagtgttactatacaaatgcagcttgtggggaaaattatattccatttaaaaacacatgaatttttgacctagaacaaattttaaaatggagctaaaatttcttcaaaatgtgtggggggaatcttagacattttcagtacacaattttggtattcagaggctttatcatcagttatttaaggtagctcttattacagactctgttataatttgcttacatattggccttagtttctgacaatgggaaactgtcagtctatatggaggacatttcacacttgaaaataatcttttcagaattaaataatgacaatgttggctagggggaagacaaccacttttaaagagtagagctatctgcgcattaacataagagcattttctctcttcagcttgtttgtaaggtctgatggcagatatttctttgtatcctactgcacggtgtttctacatatagtaggtgcatgataaatattggtgatgattgggaatgttaacatttactgttgcacagtgtggaagggaacaagtataaactagagaagtatagatgtctttaacatagcagtggtgactaaggaggagcaaagttgtactagtacttttatgagtaatagaagtagcaattgtctttattattagaggtcagatgtgccttagagaattctcaaaatatgtgaaattgggtaagtttttttaaaaggttgaccttaataaataatttgtttagtgacttaaaagaaatggagtgttttggtacaaaatttatacacagtcagcatatatgatatatgtatgcatgtgtttttgttaacaaagtcccttctaccattctcatgcttttcaactctttatccatctttccattgatagctactgttttttgttgttgtttgttgttgtggggtttttttttgttttttttttgtttttgtagagatgggagtcttgctatgttgtccagctggagaccactccagctcctggcctcaggtgatccttccacctcagcctctcaagtgttgtgattacaggcatgagccgttgctcctggcctgttgctactgttaactgtttgaaatgctttctctcattttttaaacacacctatgtgcaaatatatagtttttaaaaatacaaatgaagtaattcttattcaataattattagcaataataattgcttttttcttttaacaatatctcatgaatgcatttccgtgttagaatacagagatttactgctgagcattctcaggctccttgttcacattaggctctattctgacagatccattctaagtggtggttatatgagaaggcctacagacatagtgggtggcacagtgaagtcatcctgggatttaaaaatatctaattttactccaaagaaataattcacaggtgttgaaggatctcacattgttcacagcttttaatattataatgcaaaaggtgcagtcgccaaagctttacatgactggtaactgaaatttcgaggagagaattggatcagatatgttcatgagtataggtccatgtttggaccatagccacactgcttgtcagctcatcgagaaaagtcaggtttcacaaaagttgcttaacagcttggagaaatcttcgggataatagatcatgttttgatcttctgcagatccagtgaacaggggtgttaagagcagagagtattatgttccctatgattaaaccttttctgagttatcctacttgctatcctaagttactacttgtgaggcaggctatgtgcttttgtttaactgttcaaaggtttggatagtgttggcttttcatgtaaagatgtcaggaatgatatgaagatttttattgttttggtctcaaggttaaattctaaattaatgatatattttatggtagaaaaacttcatttccagcctaaaaagctaatgctgattcattcattttttcttttgaaacaatgaatgttacttaatctttaggctgacatcagggatagctttgtgaactttctccttttgtatgattatggttttgcagtttgtgaatacctctgtctctggattagataactttgtcttggtataaaaattttgcttatctgtgtccagtgttattcagatcgaataatttgccatacgaactcttgtttactctttagaagatatggtagctatttggttttcctttgcttgttaaaatactttagtctttaagacccaattcaaataccaacaactcctttaagtttttcttgatccttctggacagaatccatttcacttttctgttatttttgctactctttttgtaattattgcacttaatttcacttgttcagtgccttagcacaatgtaggacagagatgccttctcttgtttgttgctgtattcttagtgcttagtgtgacatttgtgatagagtacctgctttgtaaatattttttgaatgatcagttctgtgcttccagcatgatgtttgtaatccctctctctcttgtttaagtacttttaaattttgacttgtattgttattaacttgtctttctctctgaactttctgtgtgctttctaaaaacaccaattgtcttatttttgttcatagtaggattttttttaaaaaaaggcatctttagggttaaccaagttgttaaaatgcctttgaaatgataaatctccaaaaatacagcgattaatgaaaaggcaaataaacatgtgctttcactttcattaatttagaccaaccttcctttcttttaaagggtttagaaattttgacaaattatctgaaaatctgtgaaagacatttcagaagggttttaaattagattttctactacttaggttattctgctatttttaaaattcttacaaagagagagattttaaaatctgtgaaccttttaatagaggtacatttggccaggcactgtggctcacgcctgtaatcccagcactttgggagtccaaggctggcggatcacttgaggtcaggagttggagatcagcctggccgacatggtgaaaccccgtctctactaaaaatacgaaaattagctgggcgtggtgccacacgcctatagtcccagctactcgggaggctgaggcaggagaatcgcttgaacccgagaggtggaagttgcagtgagccaagattgcaccgctgctttccagcctgggagacagagtgagactctcataaagaaagagatacatttggaaatctccgtgaaaccttactgtgctccgtggccggaaaaaaaaaaaaaaaaagatacattggaaatctctgtgaaaccttactgtgcacatcaaacaatttttactttctattctgtatacagaatttgtgaccttgagtcatgtttatattgttctttgttgttactagtcattttaagctcagagtattcagccagttattagtaatcacagaattgaaaggtagatgtttttctccaaataatgctgcactgttcctagtctaattgatgttttcattttgtcttactgtaagtttcccaacttttcatatcagaattagacatatgttaaaacagtatagctaaaaaattttttcattttctatgtatttggagctgactaaaaaattatagtatcaaaacaagaaacaagtggatttgttacttgatgagtaagaaatatattaccagtatgctgatctggcttaaatttgtttacaccccctgcacgctctggctgccagatgtgtagtggctaggacaagtatctcaggttcatgtttcacaatagaagaaagaataagataaatacatatagaatgaatgagttttctatgatgtagattttaaaataggatctgtgtacctaaaatcaacctacttggtggccatttacatttatgtactttttttcctgaagtaaattagaatatgggcaggtgattgatcagtatcagtatgatgaatagtgcctcgatttttaagccattgatatccttaaaatcttaatctctgaaaacttcaaggttgtttttgttttgttttgttttgtttgtttgttttgtttttagagttttaggctgagcacggtgtctcacgcctgtaatcccagcactttgggaggccaaggtgggtggatcacgaggtcaggagttcgagaccagcctggccaatatggtgaaaccccgtctctactaaaaatatacaaaaattagccaggtgtggtggtgcgtgcctgtaatcccagctactggggaggctgaggcaggagaatcacttgaacccaggaggtggaggttgcagtgagccgagatcgcgccattgcactccagcctgggggccagagcaagactccatcacacacacacacacaaaaagagtttttaggtcgattactgtgaatatgaatagccagagataactgatcagaatacagtggaattaggatttcttaatggaatttatagtatcttaaaatatttttagttgaaaatcacgtcatctaatttttgcttatttatattaaagacattttttccattgaaaaaccgtaatgaacattacagaaaacttgggaaacagaagaagaaagttcactacctacctttctagcacgttgtattagtccgttttcacattgctgataaagacatacctgagactgggcagtttacaaaagaaagagtaccacgttggatttacagttccacatggctggggaagcctcaaaatcatggcagaaggcaaggaggagcaagtcgcatcttacgtggatggtggcaggcaaagagaagagagcttgtgcaggggaattcctctttttaaaaccatcggatctcgtgagacttaattcactcacgagaacagcacgggaacgacttgccccatgatttagagactcccaccaagtccctcccacagcacatggggattcaggatgagatttgggtggagacacagccaaacagtatcacacatccaatttggtgttttctttccattctttttttgttgcgtacatttatttttactagacagtttcttctgtaaatagtatgccatgtaacttgcggcagactgtttacaatctgctattcaaacccatgactttccctgcaacctgatttgcttgacctacttaatgctacttatttctagcaatataaaggtaatgcaaaagacattttggtaaattttagataatatagtagctgactctattttgtacaattaaaagaataaaatagatcacattagcactaatgagtaaattagattattaggagccaagaagatctaagttattttttgaaataacttatacttttctaaattagaaaagtccaacttagaaaaggtacagtcattctttttcccccattataaaaggttactttttatctttttaattagactatatttattgtgtttattatgtatttactaataatatatatgtgtatatatatatatataaaacatctttagtttcactggaaacattatgctatgtgatagagcctgcaaggtaaagaacagaatacagtggggttagttaagctgcaaggattttgggtgagtagtttggcctaataactgattatgagacacctggtttccatatttatcttctgtcacttggcagttgtgtgattgtaggcaggccatttaactttttctggtctctctctttgtctatgcaacatgatgttaattctgatcttaaagatacgttgtgaagagcagtactgtttgttgttcattcaggaaatagcagtggaagggcttctaggtgccagacagtgtggtagtgctaaagttctagcagtgaacaagcctgctctccaggagcttccagcctacagtattaaaaaatactatcttaagcagtaatgttttgtaatggtttggcttatcctgataatgatctgttactgttgctaagaggatcggtggaatttcactgtaatttttttttctgttaggtagaattcaactctgtcaagtttctttaggaccaaaataacttcattttatggtgaatttctaatataaattcagatattcttttaatatgtttataagaatttaagaattaaaaattagttactttatcctggcatttttctgttgtgtcaaataattttctaaagaaagaatctctttgtttagaaaatatgagtgtgccaggagaatctttacattttgactagattagacattggtgtaacttttttctatgtaattgagcttcatttcattaatatattaggatgcaaacaaacttgaactcagttcttaaccacactttaagtgtgtatttgtgtagtggtggtagcctcagatgtgtttggaatattttagattgctaaatattgatggtggacttaaaatccatttcatcttgtcttaagtaggttagatttcccagtcactgctttgctttactttgggaaatgagggggaggtacagtagagtagttactattaagctttagttcataattggactctgttctgtccttgctctgttggtggccttgagttttattcatctgtaaaatggataaccacatcaatttcatagggttattgtgaaaataaaactacataatacatatagaatgctttacattgcacatagtacagctccaataaatattagctgtcatattttaaaattgtcactttttatttacgtgaaatcaattccaagttttgagttgttgtgactttagtgtttctcatattaaattgctttgattcaacattttagctataattaggtgctggacctcataacaattgcaggaattacccaagagaattgttaaaaactaaaaacttgtattgaccagactgtggtgttacagactctagtatgacatacgttactagaaatttaattatgtctgtgtgtgtatgtgtgagtattttaatttgttttttgagacagagtctcgctctgtcacccaggctagagtgcagtggtgcactcacagctcactgcagcctcaaccccctcggctcaagtgatcctcccacctctgcccctccaagtagctgagactataggcacacaccaccacacctggctaatttttaaggttttttagacatgggctttcaccacgttgcctagcctggtcccaaactcctgggctcaagtgatctgccttgacctcccaaagtgctgggattatagacatgagccaccaaacctggccaaattgtgttttttttaagtgcagagagaaattgacgtttacttaaaccaatttgtttgctgtacaacttgtattttaggttttcttaggagcgtgttttcttgatcctgaactgttaattacttcattttagatcttttaaaggtttagatttagcattggtccctgctgttgttgggcttaccagctaggagagatgacataccactcatcaaatgttgaataagaatgtgtcataggaacggtgcagaatgttgctgggtgatataaaaggaaaggggcactgtacccaatccagaagtgacaaggtagggccaaaagagaggaggataggaagagcattcttctagacagaaaacagtttatttgaatgttctaaggtgggaaagatcatggtgggttccagaaactgaaaattcagtgttgagcatggaaagcaagaagagagagacctaaagcaaagctgaggccaatatattgatggactttttatgtctcttgatattatttttagattgtggactttctcttgaggacaagagggaatcagtaaacggttttaagtagagaattaacaagagcatcaccctaactctagagagaatgggagacctcttgagttaggaggctcttgtaattatagtgagagttgatggcagcttggactgtggtatatcgagcatagaaagaagaggaccacttagagatttaagagggagaattgacaataatcagtgcttggatgcatataggtggttggagaggaatgaggttcaaagatgactcctgggtttcaggtttgaggcattggtgtggtggggggtgatcctgtttactgagatatggaattgaggaggaagagcagattatgagttcaattttggatataagttgaggtactgtctttattatttgcatcagttgtttgcattcttgtcagactttttgatagcttgagaaagaacaggaagagacttatgcttcacttgggcctttgtttaattatactttgccatttcccccccacccactccaaacacttgagggttatgacacccaatagtaactgtggctcactgtgttgatagttctcaatgaaataagttgagaaacaattgaaaaggcaaatagagctacgtgtgtaaaagttgggaagatggggtagagggtgttagagggaggtaaaaataaaatcgcagttttcaaaaataccagttattcattgtcagggccactggctcagtaatatttcaaaagacttaaatgaaagttaatactatgtgttcctctgttaagctttgctatatagaccagtggttctcaaaatgtggtcccttgaccgcagcaacatcatcatctagcaatttaaaaatattaaaaatgcagattcttgtgtcctactgcaaacgtactcataaactctgagggtggggctcagcaatctattttaacagacccttcaggtgattatgatacactgtaacattttgaatacctcttgtctggattcagcaaactttcttggtaaaaggcccactagtaattattttaggctttgtggaccataggtctttgtggcaactgctcagctctgcccttgtattgagaaagccaccacagacatcatgtaaacaaataaacatggctgtttgactaaaactttatttacaaaacagcaggcacatttggcccaaagtctatagtttgcagactctggtcgagactccagacaaatatggtagttattgccagaataaatgacatattaatgaaaatacagaagttggaagtcaatctgaatagctgcttataataatatagcttattattttaaggaaataaaccagcacttttgattgttgattttattttcatctgtagtcattttacctttccccacagggaaataattaatctttgttttagtataaaacatactctcattgctaaacatttcaaactacacaaatcagtagaacagaagataaatctgcagtggtcctccaagcccttgacccaaatataatattacaatcttgatgactgtttttgagttctttctgtatattatttattgttttcactatcaatttttaaaataatgtatgattttttaaaaaattgtttagttggtaaattattttttaaattgtgtaattataacttagtttttttctcatttctttgaaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgctttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgcatttttcttttagatacagctgtgtgcattttatgattgggttgttttgcttttacctactaagtaaaacagcaacaaacaatatattgtttcccgcttcctgcctttcatctaagagttacggggaagaagtattacataattgtcatcactgttgtgtgttctgacaaagtaaatttgaaaataacatgaacttgatttttctaaaagtactcagtcaactcatatgtcagttatcggtacattttccatgtgttcagtcaaaagtttatctttttagtctgtttcatagcagtttatttctaagacagtttttattttaatttacttttttgtctgtacactgccactctgtaatgttccccccaccccatcccacccttggtaagacaccaaagtaaaatagagcaatatccaaagagctttttgcccctgtcttgtgaggagctttaaatagctgtgaatacttctgtatgtcaagattttcggattttagtggaaggatgaaatgatctgttttaatcatttaactgctaaattacttttatcatgcatgccaaatctttacattattctttagagtaatactgtaaaagtatctgagtttgttttatttgggccttatgtggaactcgaaatacttcataaattcactctaaggtctaaataagaaccagaaggttgataccattttttcacaccagtaaacacagatcagtattaacctgtagcccagaggtgttagatttattttttgagacagagtctcactctgttgcccaggctggagtgcggtggcacaatcttggctcactgcaacctctgccccctgggttcaagcaattcttgtgccttagcctcctgagtagctgggactacaggtgcatgccaccacgcccagccaatttcttgtattcttagtatgagacagggtttcaccatgttggccaggctggtctcaaactcctgacctcaagtgatctgcccgcctcggcctcccaaagtgttggaattacaggcgtgagccaccacgcccagcctatgatattctttttataagcaacttttaaaaagttttttaaaagatctcataagcatatagcactgctacactttagatcactactgtccagtcacactttatataaggatagatgtgtccttttcactccccagtatggtagttactagtcacatgtgtagctactgagcccctgaagtgtgggtgggatgattgagctgaatttgtaattttaatcaaagttagccacatgtggcttgtggctactgtattggacagcagagctttagataagcagtaataacaggaagggagtgtttgtataggttgaaagataaaatggaaggatcacaattaggccagatgtggtggctcacgcctattatcccagcgttttgggaggctgagatggtagtttgcaaccagccaggacagcatagcaagactgtttctgaaaaatcttttaaaataacacaactaaaaattacctctgagcaagagtatagctgaactgtttatactgacaatatatttcattaatacagtgtttgaccactttccaccccaccaaccactgcccttgttatgtagcctttctgagaaaagcagccctttcagattttattgttggaagttccttgggttgcagagatgcagattcaagtgccaaaagttgtttctgatgagacttacctttttagccttaaaatatttgtatagttggctctaataatttctcatttttgatgaatttgaaatcatttcacttctaaatgagattggtcatctcatgagtggtcaagttggaacatggaggtctatcatgtttttaacctccaagatccacttatggggatgaggccaaaggccaatgttacttctagaagaaccagattaatttttctgccttccatcaccgcagtgtattacctttgaccctcgctggtcatctggtaagtgtagttcatcaaaagagcagaaataggcatagtaaacacctggacacaaagacagtgccaggcttggtacaacctgttaacactgttgaggaaagagctcaaaacatgcattactttggggattaagtcagtgtttaatctcaatatgaaacagacctagaaataacaaagaccactgaagtgccaaatttatcttctaatactactatttaaactatgcaatatgggggttataatgaaatagttttagtctatgtaaggtttttataatgctaagaaataagcttatttttagatatggattttttatgactacctctttgctgtatgaatatcttaattttctaatacctcagtttcatgagaactgtatgtacatttttgtaaataaaataatttaccatatactaggagaaggacctgcttttaaagaaattgtgtaaagacatttgttattggatgtgttacatagtaaatcaatttgaaatttcttaaaaacgtttataagacttttctggtctccttgaccgagggattttagtataagtatttagtgagatttgtattctaggaagtgtgtgccgtcacttgttcatttacaactgcaaagattgtatgtctcctatgttttcctttcatgccaaagaaactcaccctttttaaaagccagcaggttgcacaaaccaaaaacaaaatattttgccccttaaataggcattttaagaagttttatttcctggtacttaaatattgtgtagagggaaagctagttgtaataatttgtaaaaatgcgtgtatttttaggaatgcgctatttccagtaagggaagtattgacatttttaaggaactgtgctgcattaaaatccacagttgcatgaaacttttaaaagtttaagatataaagtaattgctaaaatttgtgaactactcagaggactcaatgccctaacatgtaggggattgatcattgcgatgtttaggccaggatttctcatgattgtatatggttattgatcatttttaaggggctgaacctgctgcctttatacttttgacacctccctccctccctccctccaaactgtggctgtaaacagtgactctgcatagtcagcgttatacttgatttctttgtgaatgcaaataaaataaaatttgtaagtccaccaaatattgacttaa

SEQ ID NO: 572 - DNA, 160109 bp, Homo sapiens
gcgcggtgaagttcggcttcctgagccgcggtgggcgtggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtaggtttccggagggcgactgagcctcggacttcagcttggcctgggcctctcgcttcctctcccgtgtctgggtctcactctgccgggtgtgcagataagacctgggctgcctgtccaaagggtcgtggttaatgactgatcctggagctgcagggctcctggctccccgtccaggactacggctacctccaagttccatctcctttctctctatatagtctattaatggtaaccttgagtctgcatctctcccgcctttcaaagccagcccctttgcctcaccttcctaactccaggactgaattttgggtagaatttatctcagtggcctaaatgaattaatttgcgtcacctagcggttaactcgtttgcactttgagggaaatttcagcccatgtttaagaaaatttcagtccatctttaagatttcttgagaattaatattgggataatgaaattctattttcatactctaccgctgggccaagttttagattttcgaggtccaaactgtataataaactagtaataaaaataaaccatttctgtctcattaactaaagctatttaatgttcttcaggtatttaaagcatgtgatgaagatcacaaaggatatctcagcagagaggactttaaaactgctgttgtaatgctgtttgggtacaagccctccaaggtagagctttcttatatatttggggatggggtagacgatcaaaggtgaatggatcctaagaaaagttcacagggctagcttaggatgtttataaattgctttataagcaatttcagagatgtgtccagtgctgaattttagcttcctcttaacacctcagcccagagatgaagtagaaatcttttccactggagtctacacaagcctatctcaccaccaggctgctaataactactataaatacaagatgctagagaggtgccaagagggaagactgagaggggagtgttggtaacaggagaaatttacataggacatgacatagtctctttctcgttttacttttgttgctttgtttataaaatacatccacggtcaaaaaattaaaacagtgcagaaaggtataaagttgagcataaaatccgctcgccgcctaccagagggtcccactcctaggggattaccattaacagtttttttgtgtaattctgaaattttctatccatgacatacatatgcatagtcttttattgaaaacataaatgggtaaatattgtgcctactttaacttgcttttctcatttaacaatatatcaacctaaaagcacacaccactactgcattttaaaatatggttgcatattctttttagccaggttcctgtctggggttatataggtggggttttttttttttttctgccaacattgctgcaatgatacacacatttatgtccttgtggctgtatatctgtggaataagttcctagaagtataactgctaggtcatggaatatgtacgtttaaaattttgttagatatttgctctccagaaaagattgcaccaattcaccaataatgagagttgagctgagcctccatgaacctcctgcttgagtagggcaagtttcctgctcacccctgtctttatgcttttctgctttcctgttacattcattcgagagacaacacccttcttgttaagctggaattagtcagagtcaagatattgtccagattcaagaaattgagctgccaccatcaagcaaaggaagcactcagagctcagcctggaatgccatccctcactctcattagaccagacagcttggcagttaattagggcccagctgttctcctcatgagtggactgtgcctttctgtcagattgaaagcccagcaaagccagggaccctgtgatgtcatgcctctccgccctatttgtgtcaacagaacatacttactgtgaagttgtgatgcacaataagtattaatatattctcttgacccaagtaggttgcatgaacagctcaggtgggttcagagtggctcagctatgaggggctgcctagttactgagaagcttattatggagctcagagaagtagtcagggctgactcttagaaatggcagctctcctgtttacctgtaatcatttcagttggaattacaaagcaggtcagctgaaaagagtcagcctgtgaagcattgtatttaacttggattcacctggaaaggtatcttgtctcatttttgcctttatcacccttgagtctatttggtttcaattttagaatgaggaatttaatgacagatacagtgatgtaacatactgtacatacactccatgaaatttaacagattttacttttcatattgaggtgaggttttctattttattttttaagcaaatgaactatttagtaaccgcaggtcactaaacggtatttactaatagcatgtcacctataaacttagtcatttgtacaatgaacttttattatgcaggtgacacttaatttctgtgaaattcaacagatttttttagactaggttgaggtttggggtttaattttttaatattgcttttgagcaaatgaaatattcactgactgcaggtcatgaagcaataaaatacttatataataaatcacttatacattcatgcagttttttacataattaagtttatttatttgttgagatgcagtcttgctctgtcacccaggctagagtgtagtggcgtgatctaggctcactgcaacctccactttccaggttcaagcaattctcctgcctcatcctcttgagtagctgggactacaggtgcacacgaccatacccggttcttttttttctttttttttttttgtgtttttagtagagatggggtttcaccaatgttggccagtctggtctccaactcctgacctcaagtgatccgcccacctcagcctcccaaagtgctgggattacaggcataagctactgtgcccacccatacacaatgaaatttattgtttctatttaataaaaggagtacttgctagttgctagtgatataaagatgaatgaaacacagtctctacttcgaagcagttcagagtttaatatagaaagacataaaactgtgatagataccaagaaagagaagagattgaaaaacaaagtgaagggagcaaagaaggaaggcctaattctagtggtaactataacagtctgggtggtcatttagactagagaagatagactactctgataagtatctaggaacactttgtgggtggtgggacaagttaggccctgatgactgattggatgtggtggtggtaagagtgacatgaccactgggactgaagggatagcaatgccaccaattaagagaaaatttaagagtaggttcagaggaagtcagtgagtttcgattggaacacattgagtttgaggcagctatgagcattccaggtgcattcactcgttaaataatatgctggctattgaggttatggtggtgaaaatccaccgttagattttactgcttccctgagatgtagcaatctgaaattgggtggaggggatagggctggagatagacttggggctccttggtttccatgtggttgctcaaaacacgaggctggatggcattgcccaggaagagtatgcagaataggaagagccatggtctgaggatagaacgttagggaatacaagcatttaagggtaggaggggacttgaagaagtgggagtgggaaccatttggcaggaacaagaggaaccaggaaaatgcaggaaatactgggaagggttcgagaccagaagtggagaaattatgtcagatgctgcgaaggctctaatactataacgtttataaagcccttgtaacagtgtggtaaagggcttatattttaacatttagtgaaagcaggtcctcatattttctatacagtaaagtctcaaatgtttaaagatgcataggggaaaaaagctgattagtctaaaatgataacaatgattttcattggatggctgattttttaattttcttcataattttttgtatttttcatgctttctacatcaatcatgtgatacttttataattaggaaaaaaatcttaaaaatagagccatagagcccattataacagttgtatttgtctaaagtagaaaggctgcctgcctgttagattatattatatatgggacagccaaattgattttctgttcttaaactgttttggtcaatggaataaagttttgggggctattagggactagcagattagtgtctgctattttatagatgttgatggaaaaataaaatgactattatagctattgtgtatcattacttgtctgcttggttcaacagacttggtttctcataaaatagatccttattcccacctgaagaattaagaacttgcactgtgaaaacgtgataaaattacatgttctattattttttcctcttttctagatagaagtggattctgtgatgtcttcaataaatccaaatacttctggtaatatgaaagttaatattaatttttagtaccttatttagacactgagatggcttggctgtgtccctacatcagtctcatctcaaattcctatgtgttgtggaagggacctggtggaaggtaactgaatcatgggggcgggtttttcgcatgttgttctcatgatactggataagtctcatgagatctgatggctttataagggggggcttccctgcacaagctctctctttgcctgctgccatccatgtaagacgtgacttgctcctctttgccttctgccatgattgtgaggtttctccagccacgtggaaatgtaagtccattaaacttctttcttttctaagttgcccagccttgggtatgtctttatcagtagcatgaaaacagactaacaacactcacaaaatgaaaattaaaaacagaaactaggctgggtgcagtggctcatgcctgtagtcccagcactttgggaagccaaggcaggtggatcgtctgaggtcaggagtttgagaccagcctggcaaagatgatgaaacaccgtctctactaaaaatacaaaaaattagctgggcgtggtggcaggcacctataatcccagctactctggagactgatgcaggagaattgcttgaactgaggaggtagagattgcaatgagctgagattgagccattgcactccagcctgggcgacaagagtgaaactctgtctccaaataaataaataaataaaaactatatagcattatatttaagcacatctttattttgtttcccgttgtccaaaagaaaggttttggtggtttttatttttttttaatttttaatttttgtaggtgtatatatagagaggtggtacatgagatgttttgatgtaggcatgtaatgtgtaatagtcacatcatgggaaatgggataattatctcctcgagcattaatcctttgtgttacaaacagtccagttacactcttagttattttaaaatgtttatcattttgactctagtcaccctattgtgctatcaaatactaggtattaatagtcacatcatggagaatggggtatccatgctatgaagcatttatctttcatgttaccaagaatccaattatactcttttggttattttttaatgtacaattaagttgttattgactatagttaccattctgtactatcaaatactaggtcttactctatttttttttttttgtatccattaaccatccataactctccccaacatcctcactatccttcccagcctctggtaaccatccttctactttctatgtccatgaattaaattgtcttgatttttagatcccataagtgagaacatgcagtgtttgactttctgtgccttatttgacttaacatagtgacctcccattttcatctgtgttgttgcaaatgacaggatctcattcttttttattgctgaatagtactccactgtgtatgtgtaccacattttctttatccattcatctgttgatggacactgagtcttcttccaaatcttgcctattgtgaacaatgctgcaacaaacagtatatgagaatgcagatatcttccatatgttgatttcctttcttttgggtatatacccagcagtgggattgctggatcatatggtagctttatttttagttttttgaggaacctccaaatggttctccatagtgattgtactaatttacatgcctaccagcagtttaataagagctcccttttctccatatccttgccagcgtttgttattacctgtcttttggataaaagccattttaactgtggtgagatgatattattgtagttttgatggcatttctctgatcaatgatattgagtaccttttcacatatgcctgtttgccatttgtatgtgttcttttgaggttcttttaattttgattatttataaatatgtttatcacagggaaattttaaactgttgaagtgcataaagaaaaaatatcattcataattttaacattcaaaaaatgatactaggttttctgacttgtgcagctggatgaatggacatggcacctactgaaaagagaagatggcagacgggtggggcggtggggtgggagcagggggcaggcaatacctgggggtgagggagactaagagctcaattttgagtatgtttgagaagtgttagtttactatgtcaaagcagtcagattggatgaatttcagaagtaagttctgggctgaagaaattgggagtcatcaacctgtagacagattttaaaatcatgagaatgaatgagaccacctagagagatagagtggactgagaatgttaagaactctagccagtagaagtcaggtggaagatgaagaaatggcaaaggagacttaggagtgacagaggggcaagaggaaaatcaagagtgtttgatcaaaagccaagagaagtagatattttaatgaggaaggtgtggtcagcactatcaaatgctcctgaaaggtgaggtggcataactgatgagtatcctttggagttggccacctggaggtgtttgatgactttagcaagaggcatttcaaagtgtggtgagggcagagtgggttgaagataagtggaaagtgatgatgaagtgtgacaatgtgagtagatgagtcttttgttaagtccagagtggcaatagatcaagagatgttttgtttgcttcttcttgtttctatttaaatggaagaacatgtttccaagcttagcagaatgatctagtgaagaggaggaaggaagatgagagagagggagggaaggagacctattgtgtaaggggataggatccagagcatgttagattggctttttaaatattacctttttttgaataatttaaaacttccaaaaagttcaaaataaaacagtacagagaatagcttactctctgtgtaaggtataccttttacccagattgacattgttaacattttacaccatcttccttctcctttgcactttctaccactatccccttctcttctgtaatgaatataaccaaaatatgcttatcatattcataaatatatgttgatactgttttatctgatttatcatctatattttgtcagttgatctaataacatccttaatagtatctttccttttttagtatgttaaaaaatcataagtgtatctagggaaaaaaaagacacatatgaataggaacaaagataaaaatgacagcagttggctgggagtggtgactcacacctgtaatccaagcactttgggaggccaaggcaggaggattgcttgatgccaggagttcaagaccagtctggtcaacatagtatgagactctgaatcgacaaaaaagcaaaaaaaaaaaaaaagccaggcatgatggcacgtgcctgtaatcttagctacctgggaggctgaggcaggatcccttgagcccaggagtttgaggttgcacttagccattatcataccacagcaccccagcctgggcgacagagtgagacctcatctcttaaaaaacttaattaattcaacagaaggaagaaaatgggaacaaaaaatagatggaaatagacaagtagaaaaataatatggtagatttaaatccaatcattaatgttttagttagatgtaaatgatctcaacagccccattgaaagggagatactgttaaattagataaaagagtaccaactaactctgtgttgcctagaagcccactttaaacataagggcaaaaaagattagaaatatatactgtactgaacactaaccaaaagtatgccaaagtgagcatgttaatatcagatgaagtagacttcagaagaagaaatattaccagggataaggagagccagttcattaagggaattaaacatttatgcccctggccaggtgccatgactcaagcctgtaatcccagcactttgagaggccaacgcagacgaatcacttgaggccaggagtttgagaccaaccatgatgaaaccccgtctttacgaaaaaatacaaaaaaattagctggacatggtggtgcatgcctgtaatcccagctactcggggggctgaggcacgagaatcatttgagcccaggaggtggaggttgcagtgagcccagattgcatcacggcactccagcctgggtgacagagcaagactctgtctcaaaaaaaaaaataaaaaaaaaaaatcccctaataatggaaattcaaaatacatgaagcaaaaaactaataaaactgtaaagaaaaatggacaaatccataatgatggtaggaggttgcaacacccctatcaataattaagcaagtagacataaaatcaataaggatataggagacgtgaacagcactgtcaaccagtgtgacctaattgtaatctatagaatgttctacccaacaaaagcagaatacacattcttttcaagtctacacagtatatttaataaaattggtcatactctgggccattaaacatgtcaatacatttaaagtacaaagtatgttctttgtgatggaacgacattagaaatcaatagcaaagctgtctggaaaagttgcaaatagttgttccaagtaaaagtttaaaagttccaaacaaatagcacacttctaaataactcataggtcaaagaaaaaatcaaaagggaaaaattaggaagtattttgaattgaatgaaaagaccacatttcaaattttgtaggatggattgaaagcaatacttggaaagtggtagcactaactttctatgtttaggaaagaataaaggtgtcaaactgatgacctcagcttctacctttaattatcttctacctttaactacaaaaaagagtaaataaggcccgaaataagtggaggaaaggaaatagtaaagattggaatggaaattgttgaaattgaaaagaggacaaacaagaaaaaattaaaagctgattttgttgaggtaatcaataaaaatgagaaactactacccacactgagtggggggggaaaagagagcagggattactaacatttagatttaaaatctaatattttattagatttattattagatctaataaaatctaatattttattagatttattattagatctaataaaatctaatattttattagatttattattagatctaataaaatctaatattttattagatttattattagatctaataaaatctaatattttattagatttattattagatctaataaaatctaatattttattagatttattaatattgtattaaaatctaatacactttatgtacaaggtttagaatcacatttaaaataagactttcaggattattgctaggagaacatgttcttgatataatcgctaacttgatagaattgctccaggttttaaatttcttgttgaaaattttcactttcaaaatattcagaataatgtttgatgttccattagttacaacttcttgataaagccttttctacatttttttcattagggttttttgtgaatattccaatctacagagagttttgttttctggcaaaaggatttcccacattctttgcattgataggatttctctttcttaagagttccctgatattcagtgagttattctttctggatgaagatcttaccctagtcataatatcgtgtttctctattatgttactgatatggattggctgtgtccccacccaaatctcattttgtaactcccataattcccacgtgttgtgggagggacccagtgggagataattgaataatgggggcaggtctttcccaggctgttcttgtgatagtgaataagtctcacgagatttgatggttttaaaaagagaagttccccagcacaagctctctcttgtctgctgtcattcatgtaagacatgacttgctcctctttgccttccgctatgatcgtgggggctccccagccgtgtggaactgtaagtccattaaacctctttcttttgtaaatcgtccagtctcatctttatcagcagcatgagaaaagattaatacagtggcttttctgatacatcaagtgtgactattgctgaaggcattttaacattcattattctcatagactttctttcttctgtatgttctctgattttgaattaaggatttgacttcacactgaatgttttctttccttaactagttctctaatgtgcagagaggtatggattctggaagaaagaatacagtccccacctgtattctcccagctgtactctagtgtgagtgtgtatgtatgtgtgtgtgtgtgtgtgtttatttggagaaactcaagaccacaaacattcaagaaaaggagtaaaatagcctagcaagaaatcactgctgtactctgattgctgctaacatgcaatttttctattagaattgttcaatactgaaccaatttcaaaccatccactttttcttctttccctcttattgatacgagtcaattttacatgctatttctcttgaaggaagagagcacatgtgcagattaaatgtttttccacatatattatctctcttcttaatgtttggatcttgaagaactgaaattggcggggtgtggtagctcacgcctgtagtcccatgcaatttgggaggccaaggtgggtggatcacttgagcccaggagtttgagaccagcgagagcaacatggcgaaaccccatctctacaaaaaatacaaaaatgagccaggcctgatggtacatgccagtcccagctactcagggggctgaggtagaggattgcttgagcccaggaggttgagactgctgtgagccatgatcacgccactgcacgccagcctaggtgacagagcgagaccctgtttcaaaaaaaaaaaaaaaacaggtctgaaatgctggccttggcctcctgggaactatttattcaggtaatcaactttccaaagttgttctgtataatacagctgtgacttgggaattctctgctatccattgttcttcttacttcggaacagggctctaacacaccatccacaggattcttttgcagggcccagttgctgcccagcttgcagggcaaggtcagactcacattctaggttggcccagactcagctgcttttaggaagggccagagtccggaagctagacaccctgcactttgggttcgggattatacctaaacctggatgcccaggccctgcttcccaagggcttcgaatcctcttgaaaagtaggtcatttcaatagagatttcctcgtgaaaattaagaagagtgaaaagttaagtcaaagctagtagaaataagagtaaagtatctggaagaagtgtacatgctgggagaatttgagggcagccagggtgagtagcagaaaggtgctaatgatgtttttattgcctgtaacctaacaagcaagtgaatataagcaaaaactgttgtggctgcttgaaacaaggaaatatatgagtgggagaaaaaaatcaagccattagttaaaggaagcggcagatcacagttgaggttggttctgatttatagtcttgctacctctttcagagggtttcattataaccctcattctctgtgatgcacttcataacttttccaagtgtatagaatgaagaagcttgcaactagaagagacctggaaaacagtcatctgtccttattttaaaatgaggaacctaggcttcagagaagaatcacaaaatgatatagaggaataataaaataataaatacttggcaaaatccttttacagtatttattattattatagataattgcagcaatcatttcctgaacagttatcatgcagatctgtgatgagcacattcatctgtgatgattgttatatttaatgtaactatgatattatgattatcctctgtattagtccattttcacactgctataaagaactacctgagactgagtaatttataaagaggtttaattgactcacagttccacagacttaacaggaagcatgactggggaggcctcaggaaacttagaatcatggcagaaggcaaaggtgaagcaaagaccttcttcccatggtggcaggagagagagagagtgaacggggaattgacacactctttcaaacaaccagatctggtgagaacaacaagggggaagtcagccctcatgattcagtcacctcccaccaggcccctgccctgacagggattacaattcgagatgagatttgggtagggtaaggacacagagccaaaccatattatcctcattatattttatttatcattttagatgattatttttgagacagggtctctaactcctgggctcaagtgatcctcccaccttagcctcccaaagtgctgggattacaggcatgagccactgtgcctggctatccccattttagaagttaaaaaactctggccattcatggcggtatgcacctatattcccagctacttgggaggctgaggtgggaagatcacttgagtccaggagtttgagaccagcctgggcaacagagcaagaccatatctctgaaaaaaaaaaaaagtactaaaaagtttaaaaataaaaaataaataaatccagaagcctagcaagattaaataatttgcccagagtggcaccggtagctagtaagtaccagaccaacgtgatccgaccttctagctcaccctcttaaccaattgatgagcccttcctttgatttttaatagtgccatgggtcatactcctaattgtgacaaaatcgaggccagtattcattcccctaaggaactttatgaatcaatgagttgaagtcaggagtagaatcaatacacgaaaaacaaatcaccatgttctctatagttgttaggcattaatttcaaatttggttctggactacctagcatccagaacaaataggaaaacacgagcaagcacagctgcagtcagggtccatgcaacaaaacaatttttctagagaggcataagtcctcctgccctgggatagttcttctgtgatgtctcatggaggggaggctgctgagtggatgtcagtgtcgatgagctgttcaataaatgcagtagtgaattttgtaaggctgttgcttcatcttttctcaatgtagaccagtgtttaatgtcagggcaattctatgaagggcaaaggctgtgtgttccaagtatacatatctcaggtggtctgactttattccagaataaattgtagatcattctatataaataacaacagctaagatttacagggcttttctttatgctaaaagctataaataagaactgaatgagcattgtcccactgaatcctcatacatttgtctctttgttattatctcggatctatgtaaaatatgcctaagattaaaaaccagaaaaaaggacttcagaattttgttttcactaggcgattagattgagcatcttttctgtttccttatactattgccattttaaattaatgaacatattctactttgatacttgaaaaagctttccaggaacttacttttaaccctcaactttgaatgatggaaaaatcaaagcgattgattcatcatagcagtaattatggactgtgtgactgctatccagtgtaaggtccaattgaaaaataatttgtggatgagtaggttaatggtcagttggcttgcatgcttttatttattaatatcttgtctggcttgttctaaacaagacagttgactattaaaggtattatttttctaaatttaaatatcctttttctggtcttagtttctgtcataaaacacctgctgttgtgtatggttttttattttggctcctatggaacaaagatcagggtatagcagggatgaaggttttggttgatttcagatttcaattggcttcttagttcttttctataatcaggaaactgcatacacattaaggttaccttattttgaaattataatcgtagcattttatggaatctcctacagatattcacccatccatgtttatttaattacccatttagaaaacagtgaatatgtttcactatacagatggggaagaattaggagacacagacactgacctaaagacatttaaaaatatatattttatgtgggctgggcacggtggctcacgcctgtaatcccagcactttgggaggccgaggaaggtggatcacgaggtcaggagttcaagaccagcctggccaacatggtgaaacactgtctctattaaaaatacaaaaattagctgggcgtggtggtgggtgcctgtaattgcagctactccagaggctgaggcaggagaattgcttgaacctgggaagcggaggttgcagtgagctgagatcccgccactgcactccagcctgggcgatagagcaagactccatcaaaaaatgtgtatatatcttatgtgatagggaagatgaaagaaatattgccacttcttttacggccagatgttatattactattataggcaagaaaacctataagagttcaggagggcagcactgccccctagaggaggtgtgggcctggagctggacatgctgaaggatgggtgggatttgaaatagtgatggagcaaaggagaaaagaggcggtaaatgaatgcagggcaggtgccagctgtgtgccccgcctcctgctcctgttgctggtgctgtgctctctgtgtagagttcttcagagaccctcttctgtgctgtccacgtcagtgcctgaaatcttttcttcctagatccctgttcttttacaaatctctcgcccatctcagatttgcatacctaaatatatcagctatcatgctgttaatgcagtcctcccattaacagaatctactcttcttggatttttactttttttttttaacctctgcaacagcaaggaatatagtatgtaactataaatgaattgtgtccagccgagtcagctggcatgatgagagctgggaaggattaaggaccggtgtgcacggaaggaaggatgaagctttaaagtccagaataaggtattaggactttgtggtgtttgacactgaggaaccttttaagctttatgagcaggagatgtgtataataaaaaagtaacaattcctgcctgggtttgatagaaataagattttattggttcagatttctctattctactgtaactggtttttttttttttttttgctttgttgttgttgttgttgttttgttttttgaaatggagttttgctcttgttgcccaggctggagtgcagtggcgcggtcttggctcactgcaacctctgcctcccgggttcaagcctggaggtgaacatgtgattcttctgcctcagcctcctgagtagctgggattacaggtgcggcaccacctcacctggctagtttttgtgtttttagtagagacaaggttttaccatgttggccaggctggtctttaactcctgacctcaggtgatctgcctgccgtggcctcccaaagtgctgggattacagatgtgagccatcacacctggcctctaactgtttttactcattttccctccaattatatagtaaaacttgatttcttccattaaggtagattattttctctttatttccctacacatccatagtaagctggaagaaaatattatcctctgaattcatttatcataggtgacaactcactatttttgaagtcactttcacctaccatccttgcagtctttctgtgcgaacacattatatccttctcccaccccttcactgtcatggcctccaaaagtcataatttgaattttgtgtctcagactagagaaggcattatgtcttttgaaagactgcttcatccttttaaaccctaatttttaagcatttttttaactcctggaaaaatcaatatgtgacacaatgaacatgaacccttcctttctactaaatctaggaccaggcttactgtccaaataacttgcgatttttattgttttctccttcactctccccaggtttattgcagtttctaagttgagctcactgtgatagccagatgctagactccttcattttcaagaggatttctctgtgtgcactgaccctgaagcttagaactgtgaaccacaaaaaactatacttaatggaactttcaagtaaaaaatttatatagttttgttagactttttgaatttatcttcccctgtggtgaaagatgattaccctcctaagaaactgcttaaaaacaaacaagtaaaaaaaaataatctttctagtctctctctctctatatatatatctgtcatagatatatatacatgtattaagtagtttggaaactaaaaaatatgtacatgttggccaggtgcagtggttcatgcctgtaatcccagtactttatgaggccgaggcagacggatcacaaagtcgggagttcgagaccagcctggccaatagggtgaaaccccgtctctactaaaaatacaaaaattagccgggtgtgatggcacacacctgtaatcccagctactcgggaggctgaggcagtagaatcgcttgaacccaggaggtggaggttgcagtgagccaagatcgcgctgtagcacttcagcctggcgacagagtgagactccatctaaaatatatatatatatgttatagaacatgaagagagtccattttaccaaggattgtttataaaatggaaggagatgttttccagttgtacaaaaaaatgcatggacttgcagggtcaagaaggatttgtaaagatcattggtccagtggtctttaaaccacaaacctcaatcctagatcctttggggacacattcaaagacactgttggatagggaagaatgggaagcccacccacttcaaaccaaatagttcttccttcatctcctctacacatgaggctttccattttcatataaagaagaatctttcctacagctgaaaaaagaaatagtttgccaactattgatagagtctaatgacccaggcaatttctgaataccttctgcagacatattaataataaacacagataaacacatagatctgtgtggttcctaaggttgtgatgctaatttgtaaccacggtaaaggatgtttaggtaactattagtagtggaacagtgtgcacaaatgactcaacattgtatttgaaattagaattttctgaacatattcttcctctggaggcggggtgggaggggacacaggtaatatatttcttattgggtatgaaatctgatgtcagtagaattactgaaagcctttgtgaagtggtaattttaggtttgaatgttgtgacagcaggtggagctagtagtaggaactctatttctaggttatttaaagagctagatgtatacagcttacattaatgtgttttcattgcagagcttcaggaatagcatgttactatgtattggctttggaaagtgatcatattactacaacatgagagccgagctgaacaaaaactcctctgtgctttttagaaaagggtcttgtatttggataaatgttgcgttagaagattaagacaattaaaggcatagaagggaggggatatgttcacacaatatatgcttgatgagtttaacccctagagtatggactttaagaaataaaagcatatgattgtgtgggaaaatagtgtgaaagaaattgattacacatacggagtaatttttgttattggatgggttttccttttaagtggtaataggcatacagtttaaatccacatacattttctcctagtaaaagctaaagactgtttgtttttatcctacaatattgtaaaataaagacctgaatacttcacagctccaaatactcatgagttatctgaatatgtaatttaaaagatatcaccactcaggtccttttttttccttgtgaattacacgatgaaccaggaattgtgcttttttccctttatcacttctctaagtcaaatgcaatgataagagcaaatattatcgatgtagttctctctgaattttgtttggtttttactatatcatatgttttaagaaattggagtttctgaagtgacagtttattttgctggctatgtgaatagaaagagacctactttttggcattcatttacagagttataagatcatttaaaacatgggtttttttttttctttttttgagacagagtcttactctgtcacccaggctggagtgcagtggcacgatctcggctcaccgcaacctccacctcctgggttcaggtgattcttgtgcctcagcctcctgactagctgggattacaggtgcatgccgccacacctggctaatttttgtatttttagtggagataggttttgccttgttggccaggctgatctcaaactcctgacctcaggtgatctgcctgcctcagcctcccaaattgctgggattacaggcgtgagctaccgcacctggctaatttttgtatttttagtagagacagattttgccatgttggccatgctggtctggaactcctgacctcaacctctctgcccaccttggcctcccaaagtgttaggattataggcatgagccattatacctgctctaaaacacacattttaagcctggcatggtggcatatgcctttagttccggctactggggagactgaggtgggggataacttgaggctaggattttgaggctgcagtgcgctgtggccatgcctgtgactagcctttgcactccagcctgggcaagagagcaagaccctgtctctaggaaaaaaaaaaaaaaaaaacccacatgcattttaatgctttttgctaaaaactagaaataacatcttgtttgttattattcattgaatgttacttactcagcaaacatgtaatgaatgcctactgtctgctaggcatcatgctaaacatgggataaaattttgagaacactatacactgctttccctcagcatgtctcaggcagacatgtggccaaataattaccgtagatcctaatcacttctatgattgcatgatgaacaaagggccgtcgggtcacagaaaaaggacttagctgagagaaatcagagacatattcaaacaggagatgatgcctgggttgcatctggaaggagatacaaatattcactaggagaaaaaaggagaaagtgcattattccaggcagtgtgttctatacatgcaaaggtgtggagtgcgaaagggcctcttggcttggggaagcaccaggaagttgactaggaagccttgagaggtggactggggtacgtttctgaagggtctcctaggacatgccattatcagtgaatacattattcaagaatttcggctactctagatgctacttaattgactagattttggtgttcatgaagctaaagttatggatatgatcttatgggcacatggcatagctagacttcaattttaacctcagctaacaatttgtcattatgttctctgtcacaagggtaattagataagaatggagctgcatcaatatgtattccccacaactatggaaaaaaatgctacatatgctaatttgctacagtacgtatgattgagcacctgccaggcactctggtaggtgagggagatatgccctgttgcctagaagacagccggccacctcctgaacttctcctcttggttgtctccagagcactgaacacttcacacagctgaatggcaactcttcatctcgccccaattttgctcttcccccagactttctcctctctttaagtagctcttcaagccagaatctacgggatattcttgacatctctttctttctcacctgccacatctagttcttcatcaagctatgtcatttagattctaaaatatatctggaaaccttccactcctctcatccccactgccagcaacctggcaaccacatctcttgccagtaggctcctaactggtctctctttttacatttttgctcccccacctccgtccttttatcaggataatagccagaaagatcatgtaacttcccaattcaaaccttctgttgacttcctattgccacttaaataaaacccaaattatttactgtggcccacaagagcctgtgagttttggcccctgctgccctccccaacctcatcttgtatcacttctctctggctcactttgttccagccacagcagccttttttcattttcccaccttgccacacaacagcctcggcacaggctgttcctactgccagcaatgctcttcttcccaacattaggcagttggtattgtctcatggtttaggtcttggcttaaatatctcctccttgaagggctctctctgtcaccagagtctacttgacatgaggattcctgtgaatctttttcacaacctcctgtctttcccctcattgcccatgccacagtttgtaatgaggtgtgcatttgcagttgaacctgtgtaatgactgccttccccaccagatcagtagctcccttgggactggaatcatgtgtattctcttttcccctctatttccaaagcttaatacagtgcctggcccatagtaggtcctaaaaggaatcatttaaaaagagacagatttctttttcagtttataaatctttaaatgtaaataaagatgtaggaaattaagaaaatcatttctacatttttttaaatgattggaactattttagaaaaggtatacagcttagtattacatcactaaaagaaaaaatgtgcatgtggttattgtatgtttggaggctatttttaaaacagtgataatttttttatggaaattctgagttataaaaatgaaccactctttttatatatgtagagctcagttcactaaaatgtttaaattcttggcttcgctctttaaacctactacaaagatcacattagaattcgttttaatagacattgtaagcacagtatccaatctcattttatcatgctgggctcttttatgatgagagtcgcaggaagctgagcctgaggctgctccacacgttgtggggcgtatccagggctggagatggtgccagctgtattgtttatgtaatattctccccacctttatctgtggtgtacaattggtattgacttttaagaaactacttctctgacccgatctcccagttggaaaaaaacctgccatagtgacatctggctaggaaaaaagggatcaaagaagcataaggaaacaaaaattatgagaccttgtttaataagtagtttcatgcctattagatctgttagagggaagagtgttacagttttttcaaggtcaccattcctttacccctggaaaaagctcagtgaaccctaaaagtgtcttgtgttttcactattgatttctagtgttggatctgttaaatgttagcatttagcaaaatgcctttttcggtcttcaggaaacttcacagatcttgagtaaatactgttcaccaaaattaagataaaatttgattattggtgagatttattactgtccatttctgtttaattttttcttaaagaggaagacaataatctttgacaaattgttttttccccaacttttaggtatattactcgaggggtttttaaatattgtcaggaaaaagaaggaagctcaacgatatcggaacgaagtaagacacatcttcacagcctttgacacctactgtaagtgtctctaaagtgttttgatgtaaaaaaaattacttttaagggattgcaaataggattatatacccagtaaatcaaatatataatatacttggaagattatattactgtattcattagctgttaccttaggtattgatgcacatttttttctccgtcgtgatttcttgacatttaccatagatgaaatagtatttacagttatatagttgtactaatatattgtaccttgattgtcatggggactgcaaaaggactggccctgggggatataggccatgagccacctatggaggtgtgggagaccgtgtggcttcttcatcaactcttgctctgacctacatatgattggtggaattgttttcccccatagggtgtggctgagaggggtgggtggctgtagaccccctaggccccacagatcatacacagaatgaaaagactcatggagtctagggtcagtgtcttgactgctgttatggtttccttctaaatagcaatatttcatgattctaataccacgcaaaggaaaaaacatgcattttgaagactgcattgttttggcaactcgcaaagactcaaagtctaacaccgttgttagagtgcatgtctctatatagtgctatctctggtactgagagaatcagcaaaatgatagggccagaagtgaccttcaagatcagccgggactgcactgaaggaaagtattattagaatcttaaattattccgatgagacaatctcagattaccttatctgtgaaatcaatcgtaaactactgcttttctcctagtaatatattaaaataagttttgcacaaatgttatggctgaagtaacagttgataggtcttattaaagtaagtgaatattttttattgttttcaaatagatcgtggatttttaactttggaagatttcaaaaaagcatttaggcaggtggctcccaaattaccggaaaggactgttcttgaggtattcaggtaaggcatcaaaatccttctgtacaccaccttttgatttaccatttgcttttacatgtttttgactttatggaaagaacttatttattctgatttttgagtctggaacatttttctcttgcagcatagtgtcatggtccaggagggaaatctatagttagctatgggtccttccatgcccctgacagtgaactgtaaagttgggggagcgcttgcacaccaggcaggtgcatacaagcacttatgagtaggggcaggagaggaacaggaagaaagaacttcttcagatacttacgtgtgaaccaagggaaaatggagctttagtaatatttagcatggatgctggtgtcctcacatggtctgtatttcagacaaacacaggttacatgtggttcttgagttgtctggagagaacagctggagttgcctgatggtagcccccttgttcccttgctttcaaagctactgacacatgttgctgttcacacatacctgataaagtggatttaaagattatattatgtggttcttatgaacaaatcctgacaaaatggacaagtggcttaaaagcagtttttgttaggaaactgcagattgaaggtaatattaatagtgcaaacacatgctgacgtgagaacacagcagagctgtctcttctctgactcccagcatgagctcttcatcaaccctgttaacaggtgtattcattagcgttcagcacaccagcgagagccagaaaacccaaaagaacggaaactcaaaaaatatagaaattcatttctctgccatataaacataggcaaaccaggggcgaatgttgaccacacagtcgggaaggatccagattgccccttttcttgttgctctggctgtatcaacacctggcttctccctcttgcttcaagatggttgcttaagtttcagcagtcaaatattaagtttcagcagtcaaatctgaattccagctggttaggaggaaaagaaagtagaaggtatgcactccttttcaggatatatattatttccacttacaacccagtgaccaaaacttagttccaaggtcatgcacagctgcaagggggaagggttttggaaaatgtagtctttgctctgggcaatgatgtgcccacgaatagaggttctgataccaaggaagagggggagagaatggatattgggggacatctggcagatgttcccatttgggataaaagtaacttaatgaaatatgaccagagccagcccttctcaatagaaattagtaaataggttatttgaatgaagatttgcagtcattatcattaacagtgacatatatgaaattcatttgctgcatcattgacaagcaagctactgagcaagctattgaagaagagcaaagaagttaaagccagatgcatacaaaatgcttatgggaaaacattacttagctgattttgtaaaagcaaatcctttaaaatgtagcatctttgtattttgtgatgagataggtagtgaatatcaatatacttctaccatacaaaagttgtttttaacaaaggaactaaaaattgatactcattttctttttacaaaaagaccagttgtccaaatatgatgaactttatgtgttaaatggttttagtagatactaccttatagagatttttgaaaaatgtttttaaatatagccattcaagatacaggcaatgttttaacgatgaatgagaaagtaacaccttcttagaagaaaagctatgctacagggagaacatttttgaaatagatgtttgaaaatgttattttattttaaaacataatgtcacctattaaaattcatatctgcatgtttggtatgtttaaaatggaatgtcctggccaggcatggtggctcatatctgtaatccccacactttgggaggccgaggcaggtggatcacctgaagtcaggaattcgagaccagcctggccaacatggcgaaaccccatgtctactaaaaagacaaaaattagctgggcatggtggcatgcgctgtagtcccagctactcgggaagctgaagcaggagaatcacttgaacctgggatgcggaggttgctgtgagctgagatcacaccactgcactctagcctgggtgacagagtgagactctgtctcaaaaatctgtaaagttgtggtgattttagcacacaattattaaaaacagaaattcggcctggtgtggtggttcatgcctgtaatcctagcactttaggaggccaaggcaggaggactgcttgaggccaagagttcaagaccaacctgggcaacagagaccctgtctctacacaaaatacaaaaattagccaggtatggtggcatatacctgtagtcctagctgctagctatttgggaggctgagatgggaggatctcttgagcccagaagttcgaggctgcagtgagccaaggttgcacccctgcaccccagcctgggcaacagagcaagaccctcctaaaaaaaaatatgtgtgtgtgtatatatatatatatgtatgtatttatatgtccatctttccataggttagagtatatcttgaaaatgtattaaagctattgaattatatatataattatatattgaactatatatgtaatatataattatgattggaattatataaatgtatataattgtatatatgtaatatataattatagatgtttaagcatatgtaatatgtaatatataattatttaattatatatgtaatctataatatataattaattgcatttatttaattatatatgcaatatataattatataattaatataatcagttatatacaacagaattatatattattaataattgtatatatgattaacatatataaacatacataattatatatataattcaatagcaagatatcaggaaagatggactttactagctgaattttagttggcattaacaacaaaataataatttaagaaaacaaaacaaattttcaaattcctaaacctttgcattatcagaggatggagtcagtggcatgatgagcttttcccatttagatctatgtatttacatgaggtacctatactgtccattaaaaccaagtatcaaaacaaattgaattttaaattgctcacttataaaatattaagccaagattttcagaaataatagagtatattaatgtacattgttctggttaagtattaataatttctagagacatcagaaagttatttgccattaataaaatattttatctttaattctttagaaatttctatactttaaccatgtacatagtatattaatataataacatatgtgctcctctataaataagtatattcatgttgtggagtatatgcccacaaatcttgtacttcctagggttgtgagaccaaaacagtttggaaaccactgtaacatacagccaaagaagatactttgttgactgaatatgggctttttaaactctcaactgtatttttataatatcacaatcccaaagttagactaaataatgaataacacggtcaggcatggtggcttgcacctgtaatcccagcactttgggaggccgaggcgggcggatcacctgaagtcaggagttccagaccagcctggccaacatggcgaaactccatctatactaaaaagtacaagaattagctgggcgtggtggtgggcgcctgtaatcccagctactcaggaggctgaggcagtagaatcgcttgaacccgggaggtcgaagttgtagtgagccgagatcgtgccactgcacttcagcctgggcaacaagagcgagactccgtctcaaaaaaaaaaaaagaataacacatattaaaggaagttgcgaactggaaaaatatttcctgtttgtgtaaattgaagtaggccaaagaaacagagatgtctaacatatcacacatatccttatttcagtcatgcaaacaattttcaataataaaaaaatcagctgctgaggctattagtgatgcaaaattatttaatgtttccaaggttagacgttcactttttgagacgcttgagtagcttttcacttaattgactagcatgtatgggtttctttacccaggtccacaattcactacacaggtccagaaaaaaagctgatctctgaaaagcactaggagaaggcagctagagagggagaattctaattaggccggggtcctctgtggcttgaatgactgaataagtttttatagtcttcaattcagtgactgccagattcttcccaaagaaatttctagagatcaagagtaggctctttcggaagtacttgcccgtattacactttaattttacaaaccaaacaacagcaattcaaccaatcaaacaacaaaaacaatccaaagaaagagacttggacataggcatcaaggaatcatttcactttataatttaatagaacactggtgtatcattcattaattctgaaagtgagaactaaatgtaaaataattttgtaaggtttgtgaattgttgcctaggtattctggtgatgtttactttagtgattttatcattaatgaaagcaatgtgtttttttagaaaacatattattagggttcataacgttgacattctgttgtgcaatcataatctcctgttttgttttagtcatagctctacagttgaatgaattcaaagctcacctccaggccttttgctatggtttctgtttagctgaagtttatcctcaagtaggggtcataagaattatattccccactgtctttcatgttcaaaaatgcttatctgggtcattgtatttgaataaaaatatgtaatggattgaatgctaacatttttgagtcacattctttttctttgagaacattggttatgcctattttggaagtccttttaagttttttgctaatttttattttaattgcttgctttgctcttagtatattaccatgtctcttcgtgtattttcaacaatatctattctcctttgtgctgcatccaatttggcatttttctttttctgttttggttttacttttctcttacatttctttcttgagctgtatctgctgatgtctcatatccttttgttattttgctgtatcttgttattttgtagtagctcccctacctactttcagctcttgttttatagaggtctttgttttattaggggaaacagtgatttttcagattttatttttaaatgagtgattgcttgggggaaactaattataactttttccacataaattaatgaaagcaagttttctaccaagagaaaagttgtgaggaacaaattactttcataaaccaagggatatctcatatacaaaattcaaaattgctactcatttgttatgtctaaagatattataaaatctttaatacttggatttcaaaatttgagacttttttcagtgtttgaaacttaaaactttcgggtgggtgcggtggctcatgcctgtaatccaacactttgggaggccgagacgagtgggtcacttgagaccagcctggccaacatggtgaaaccccgtctctactaaaaataaaaaaaattatcccagcatggtggtgcatacctgtaatcccagctactcaggaggctgaggcacaagaattgcttgaactttggaggcgggggttgcagtgagccgagatcacgccactgcactccaacctgggcgacggagcaagactctgtctcaaaaaaaaacttgtctctactgaaaatacaaaaattagctgggtgtggtggcacgtgcctgtagacccagctacccaggaggctgaggcaggagaatcgcttgaacccgggaggcggaggttgcagtgagcccaggctgcgccattgcactccagcctgggtgacagagcaagactccatctcaaaaaaaaaaaaaaagaaagaaacataactttgtattcctcttagagctggtagtcacaatttgtgtgtttgtgtactgtatcaaagatgatgtttcatttttagtcagaatttctacccattaaaaatggcagaagttcaagagacataagagctgtttgtactatagtactgtttgtactatagaattaatgttagataatagggtgttttgagcaattaaaagttaagtaagaaacatctttcctctttaacactaataaaactgactgaaaattttgtagtgctatcttttgtttttcatgttcagaaatcttcagtgactctaaggggtatagttaaaactctttaacctggctttccaacatctggtctcttttccaacatctggtccccttttcaaactcatcttacatcagtcccaaattcctgtgtttcccttggcgtggtacttgttcctttgattatgtgatgtgcatttatgcttcattctgtttgcagtgcctttctctactcttacctgtccaggtttaaaccatctttaaaggtcctcctcaataaagcctttctttctctgcattgtacagtcttctttccttaaatgttgatagtatttattgttatgtattttttcattcacttacttgataaatgaaaacacagtgtttatgattatccccataaattagtacaagttctttgagtttatggacttatatctgtaatcgccactgtccttggcatgttgccttttgcactgcagttaataaataatcgttggtccattgccacttattccaaataccctgtgacagtaaaattctgttttcttcgtggtttaatttatttctcataaactaggaaagagtcctttaaaatgcagtcaggagcttcatagccacatgtggctttgctttccattttcctctgtctacatgtgattttcatgaattaatctctggtggtctctttttgctttatttcagaggcattttcagtgcatgatttaacttcggctgtcatcaggaagctgacttaaagttctttcttgactttgcctgccatcaacaccctgtggtatttctggctggcatttttctctgcatggatatgtttacttctccatgcctaggaaccttctccatctcattgtaagcactgctatttgtacattcccaccacctgtcagttggcaaaaagctctgggaagctgcttttgcttcccagtcatgagatgaaatgtgaatgtgcataaggtccatgccctgacccagcgtccaagatcctgagtgcacaggcagattgccacatgatgatgtaaagtggcaatatcgaggcaccaaatgctcccatcatgactggagacgtttaaagttatatcctgatatttttggtgtaagaatccctttcttcatattacacaagggaaggtcaaaggacataggacatctaactctccttttttgaatattagaaattgggtgaaaatgagaatgtcattgcttgttgaataagatattttcaaaatcagagtattagtgggggctgggtcttaggaatgcaattgtaaaagggagtgatggatattcccttggcagaaaaattatatagatgttatatcacagccattataggggtaaggactgtcaccagcttgggtaaaacaaataggctcttctgttatgctgattggaagagtcttacagagctgagggcctaaaggaaagtgatttcagagaacatttactttttcaagtcatttgcgtctcttttgaaatgttatttctcactgtaatttttagcttcccataattcctttctgccagcagccaacttgtggagtatcattttcctggtccatctctaacaagagaaaatttccagtcattattttgtgcttcagaatgattctgtgtatgatcatgcaacttcagtaagatcacagttattaaaatgagtacctaatttagtgactatgactattggtctttgagtatctgcctgcttccaggtatagaaacatccataaaaacacctacaaatcatatttcattctttgtagccatacatagataacagtcatcagctataccttctgtgtgaatggcatgaccgaagaagtagacttcttgaggtcccaacttttatttcatgaaattttgtgtcttctctggaatggaaatgctttagtttttatttcaatggttttgtttcaaaattatattgtcagagattcccttttctgattgtcctgttgcacatgcttataagatggggagtatgaatgtgtgtaagcttttcaagctgacctcagaatttcctctctgagggacttctagggattttcacatgtgatatattgaataaaactgtactttaaaaattcagctatagaaataattatgttctagtcattttaagaaaataccaatttttcagagggttcttaattgattttgattgtctctttttaccagtatgaactttagaaatggaggaattgaaactcagaaactggaccaggaagcaagtagagaagatgactttgttacatagattttcaaatagattatgttattttggtttcttcatttaagctaacttatgaaggatatattattagattggaaggaatatttagtctcttcacatttaggaagctcagattttgaagtcctctctcatgttaaacccatccggatacaaattcgattcatccttcaaggcccagctgttaagatatttcttatcttgaaagccggccctactctgccaccttgcaacccccaaaaaggaaattgtcttcaccttctgctttaaactcctaatctttcataaatatctttcttcttcatgctttttcatagttatttgtacccatgtgttatttccagtgtcagaatggaagctaaacgtgagaaggcatagtagggtattcatcatcacactccccacacccgtagcacagttttgtaggtcttgaatagatgacttcatcttatgtaaatgaatggcttatttcattggaaaaaaaaccacaggctttttattactattatttgttttactctttaaataccacactggcaccatgttaaggtcaggagtctagtcaagccccaggatgagttctaggcccagctctgcctctgacccatttttccacaaatcagtgaacctctctggactgcactgtcatctgagaaaaaagggtgttgtgttatacaatctggcaggcttctccagctctgaaattcactggtggcgtcatctatcatggagaatggcatggccgtctcctttattttccctgcataccacagatattattcagaatccaccacagcatgaatatagatgtggtctgtcagtgtgacaaagactgttctcaagaggaaattactgggtttgacagctacccaaccctgggtttagtttttgggatgtcactatagcaagtgttgtggccgatgtatccaattcctcatctacatatatggctgaatatgctgttcttgctgtaatagcatgagggctatttttcttttaattcagctgtcacataggaaactgctgccatggtttccttctatgaccaaatgttgctaaccctttcagtcatccttgaagttattaatagccacacatcatgaatgtattcatgccatttcctttatagaaaaaggaatcaatttctcgtgtttttcttttgtagtagatagctaacttctaggtggaattttggtaatattgaatgtcatatttataaaataagagaaatctgtatttaataaaatacacattttatgagatacttaacaattgttttaaaatgccatgacaaagtaggccaggaattaagaattacatcaaagttttgattgtccaccttatgtatagactaaaatcaagaccaaagatttccagtactacatttttatcgatgacagcaacctatgagtttgttgccttatgtctggccatcttgtctgcctacctcctaccccatcgttctcctccatcaggctacctcagataaatgcatccttgacattcaaagagttctccaaagaccagtggcatcagcatcagggagcttattagcaacgcctaatctcaggccccactccaaaggtactgagtcagacatgtttaatattcctaggtgattcatatgcacattaaagtttgaaaatcactggcctaccctagttaaattttggataatttgagtaaattatcatctctatttatgttacttcctaacttcaatagctttttattccctaccaaataatgtctagattccttagcctgacatacaaggcccctacagacagaaacatacaaggccatatagacagaaatggctgtgccttttttgcatgtcccccagtatttcatcctactccgcctttctggtcttcttgccatatactgtctcatttctctcctagcatttttgtttatggcaggttcactgctctctttcctcttcctcccactaccccatccacatatctgaatggtatccattccttagctgaacattcttctatgtagcctttcttttctttctttcttttctttttttttttttagacagagtctcactttgtcacctagactggagttcagtggcgcgacctcggctcactgcaacctctgcctcccaggttcaagtgattctcctgcctcagcctcccaagtagctgggattacaggcgcccaccactatgcgcagctaatttttgtatttatagtagagatggggtttcaccatgttggccaggccggtctcaaacccctgacctcaagtgatccaccctcctcggactcccggagtgctgggatcacaggtgtgagccaccacgcccggccctatgtagcctttctttatcactccagcccacaaaatatctttcctcttctgtagaactcctataacacttgccatattgacatatttaatggtagcaaccgcaacaccactggcaactaatatttactaagtgttttccatgtgccaggcactgtgctgaacggatcctcacaggaacatcttgggttgggctccgtctgtccccattttacacatgagggaaaagctcagagaggtctaaagacttgctcaaggtcaccagctggtgactgatggaaccaagattcaaaccgaaggaggctgcctttccagcttatgctcttaatcactgtcatattcctttctcacttcttttaacagcgttagagaccctgaaggtaggaagcatgcttttgtgtccctccattgcctagcataaacaccaggaagcaaggcctattcactctgccctaagagcattcttgatgcactggttgcatgattatatggcttttccctgttcctatgaagtggtttggtttggattgttatacttgagatttcatttgaaaaaatatacaaaaggaagctgatgcaacatttatatccatcaaactgtagaaggcattccagttcagattgctctgataggaacccatgtgttacgcatcttgcctatggaattatatcacaagaccaaaggatttgccaaataaattataaaaatcaaatatattgaaaattgctgagaggagttttatcataattttaactggagtgggagtgctaaacgaaattcatgactttctcttcataagggaggattatactttgattcacttggaagagtctttaatcagttactgtgagtttagcattgtgttttataaattccagctgggccacattatctgctcttcttctctccttggttgcaacctgctgctggagaaaatcagggcaaagcagtgattaaatccactatagacttactgtgaagcctcgtagttcctgcactcgctcttgcctctgcctaccccagcccttgaagctactgatgatggctcctttggtagactggctcacccatttcctaagccagccccaggaaaggcagaacaagtactaatactaataccctttactctcccccctactctgcctgtttatcactcacttttacctgcctcccactcatggagtttttagaattttaaaatcccaggactggttaccggtggctagacatgaatcctggactcttgtcattattcccgaccctcctcctttctcccagtgccatgtcctccacatgccacacctctagtctccttagctaccattaagcccaagaatcaatgttgacaccactttttcctccttatcttcacttaggcctctgtccaaggcccccgccctttgttctgacccatactgcagggcctgcactgttaagtgggctcaggtgcttggacctgctcttggccgatctgagatctgaagcttacttaccacttgccttctttctttaatgtgtctgcctccccatcatacattccacagtgaattagtgtttctctctctctctctctctctctgtctctctctctctctctcatcaagtgtgatgtctgagaaatctctaaactctgctatccaccttcctggatcctcttgcttagatcccctggtgccggccttgatcccagaatgggaccatgtcacagtacaggcagaaactgatctctatgtgaccaaagtgtttgggctaccagaatctgtcttctgtactcagttcccccaccctggtcctgtgtcattccagaatgccttccatttcatgcagagatctggtatgcctgtcactcaggtcagacaatacccctattgctatccaggagaaatgtaactcagctggcttcagttccctgttatagggatggcacgtagttgacatgcctgccactgacccctcctgtacctgtggctgccctcttctgcagaactcagagttcttctcagtacaataccccaagccagctcattagagttgtcatatgagatcaaatctcttgctctctctgtaaggatgtattctctgtgatggttgtaccaaacctttcccactactgtgctttgcaggtgatcttgcctttttcttcatggagaggatcatggcctcttcctgggtttactgccttctcttcatctcttttctgtattcctttaattttctttcttcttcttcttctttttttttttttgagatggagtctcgctctgttgcccaggctggagtgcagtggtgtgatctcggctcactgcaacctccacctcctgggttcaagcgattctcctgcctcagcctcccaagtagctgggattacagacgtgtgctaccatgcccggctaatttttgtatttttagtagagatggggtttcaccatgttggtcaggctggtgtggaactcctgacctcaggtgatccacctgccttggcctcctaaagtgctgggattacaggcgtgagccaccacgcccagccttcctttaattttatttctgaggaaaaggggtctcttctttttttcctaattcctctcttttgttctggtcttctctcttcccctttttttgatctaagacatttctccatcagccattcccacttctgtttataatgcctatccctgcctgaagatatactcatatccatcctagaaagctgctctccccaactaagtacctccagttgtcccctgtcctttttctcagggttcattgttgccagcttctcacagcattcacaccctgcctggagagccagtcctcgattctcgctcttccccagctttcattgcactgtattgtccactgcagtcacagtgcttcccgttcattgattaccaactacgtgttgccttacttagtccttacagtgactctccacatcaacggcatttctatccattttacagttaaagctgagagtcctttattgctcaattcaaaccaaacaactaattcgcaattattattatttttttggtcaaagaagtcacagaaccaagcccctagggcaatcagaattttttatttgattataatcatgttgctggtacttgttaatggtcaagtgttttcataacctcaaaatgttattttcttgtttagaaatgccactgcctagtaatgataatgatggagtagactgaatttacaggtagaataaaatgtctgcactcccatgttaattgcagcattattcacaatagccgagatatggaaacccatattaagtgcccaccactggatgaatggataaagaaattgtggtatgtgtgtacagcagaatattattcagccttaaaaaagaaggaaatcctgccatttgcaacagcatggaggaatctggggacattatgctaagtgaaagaagccagacacagaaagacaaatattgcatgatattacttatatgtgacatctaaactagtcaaacttggagaaaaagagtggaatggtagttgccaggggctgggaagtggggaagatggggagatgtcggtcagaggatacaaaattttagttacagggtgaatgaattctagtgatctagtgtacagcatggtaactatagttaatgtgttgtgtacttcagatttgccaagggagcagatcttaagtgttttcaacacacacatacacacacacacacacacacacacacacacacacacacacacacgaagcatgtcaggtgatggatatgctaattagcttgactgtgagtcattacacaaagtatacttttataaaaacgtcatcttgtataccttaaatatagacaattttttgtcagtcatacctcaaaaaatgtctacacagacttagtgagactcatgacatgagtcatgttaaaggatataagaaacaaataaaagtttaaaaatgcttttcttaacccaagtcttattgttaggattcctcataatccagtcatgacttcaattagaaatccttgccgtgggatatcaagactcttgtccaaggagaggaaggggcaggagggtctcactcttgttctctccttgtaaaaatttaactctgtttgcaggagagagtatttgacgaatacatgaacaaataaatgaatgaaatgaacgaaggaatagaattaatctgatcaaagtttacatgttcaaattatgtgttgaattggatagagcagctgctggcccttacttttttctgggcctatttcaaatggtcttctttactaggctttcaattggagatttagacttggaggctttaacaaatatgaattgagtacacatttgtatagcgatttaaactgctattatcacaaaattgtcacagtagttttaaactctgtcagatggcttttaaccaaaccctgccatcagagtcaaatttgattctttggatggttctttccttttttctgtctctttcacattgtctagtaaagaagtttcttcaatgaccagttttgtcatagagttggtgccatttattctgtgggttacaaatttatcatcacaagtagctagatgtacttctcatagacaacttgtatccacaaatttgttgtttttttctttttttcttttttttttttctgagccattctccctagaaaacacaaattgttttggggggaaaaattagactgttcttcaggggtatttattttcatgattcactgtgcagagatcggagttgtgccttaagggcttggctctgctctcttgatactggtatccattgctaggtgtggctcaattaaacaggaaggatggctagatagcatatatattcacatgtcaaatggcagcatccatctttgagacaggaatcttggtgggaaaagttcaattttttaacaaatgtgaaattacctcctcaatcatttttatttccggttaaattaatgtcttatataaacactgtaggctagcatagtatttgataccatttagtttgctctctcttttagttcctaattttcattgtagttctcagtgtttgctttttgagtgtgagtttatggcagaataaatcaaattaactttggtgggtagattgagttttctctgatgacctttactaaccaaaacatactttcttctcaggtgaaaaagccagagtggattattatttatttgactgacaaagaaatgcatttctaattttatttagtgactaaaataaattgattcaccgtaaattaaatatgaaataaatgcatgatcctctcttaatgaaccaaacagattgagagccgagcacctttgcagtacacctctttcaccagttggtggtgccaaaaactctgctaagaaactgattgaaagaacagaaggttaaccaggagcctttcttaataagcgttatttttcgtagtttttgaaaaatttgtactgaaaacatatgcccaaattatcgcattttctaaggttaggaagcaaagctaatccctctggtgaccagcagaatatatttctagtaagcttctgtaataatgtcattggtctatgttaatattcacatattggaaattgcaaagttgtgtaacatctgactccatcctggaaatagcctttagtgtgcttgcctggagagtggaggagcaaatgataataatgtgtacagagaagaagagtgatgttcctggctatatttattgtcgaatttaggtctttaaaaatattgacttgcgttattattactatgtgtttttttttaaccattaatatattcctgtgacagcaggaacattgcttttttgtgtgtgtgtgggcgggggcggctaggtttgtttaaccctttactgtttagccctgaaaaagtccaaatggagcagtagcctgttgcttgaatgtgtcctgagatacagtcaaaagaacccagcctttggagtcagagagatcaggttttgaatttccctacatatttcataactgtctctctcttttttttttttcttttcgagaccaaggtctcactctgttgcccaggctggagtgcagtggtgcgatcttggctcactgcaacctccacctcccagattcaagcgattctcatacctaagcttcccaagtagctgggactacaggtgtgcaccaccatgcccgggtaatttttgtatttttagtagagacggggtttcaccatgttggccaggctagtctccaactcctggcctcaagtgatccgcctgcttcatcctcccaaagtgctgggattacaggcgtgagccactgtacccagcctttcataactgtcttttaattacttatgcagattttttactgctcagtttttccagtttgtaaaatggagataataacatcttcccctcagagttggagtaaacatcacctgagataacggatgtgctgattaagtgctcctcaccctgtccttttctagtttaagcacagactcagttctttttgagcctccaccacatcccatgctcttagccagggccttaggaccggagtccctccttgggtgtgatgatgcctcatgctgcgttaatgagaagatgtttccaggttgtaaagttccacaaggattttgtaaagaactcacaaaagagatactcatattgttagctatatgtggtgttcagatatttgcccgtctaccctgggatgtttccatgttgatctgaatctgcctaaatgtttaagattggagaagggagcacagggttgctgacaggtgtagcaacagtgtccccaacagttcattcatccatttattccacaaacttttactcaacattattattgctgggtctccggcatacaaagatgaattcccagagagcctgaagatgcttctgagagctgcagactcaaggagcaggatgctttctgcttggcaggaattgataagcagccctgatctatgaaagagcaagaaagataaatttaaatattttttaaaatattattttacaaagttataagactgtaaaaaaaattttaactttgaaaaactctgatagttgtattaagcttttgatagcatcatgtttggaagaatgagcaaatcagaagaagccttcagcgtggttggtaaagtcataaaacactgttaattaggagctttagcccagtatagaattttaaaatacaactgtataaggtatatatattttttaggaatagcacaactaacatctttgattagattcgattgaaagattcagacccttaagatttagagattacggaatcatagaactggatggtggctgggactttaggaatcacatatgccatctcccttattttctagctaagaaaatggaagtcaaacaaacgtatgtgactcacccaaggttacatagacctggatcaaaactcaggtctccatgccaagacattatttttccatcctaactcctatacaatgagccattttcagtagataaatatatacttgtcccatctcaataaactttcatgctaaatatggagtatcatgtccgccctgttaccaaaatgaaaactttggccgtaccttcggcagttaattaaggtgctcctacttccatctcagagctgagctgaggggaggcagggcacaccaggcctgtcatgtgcagttctcagccagagccagtgagttccccacagaagcaggcagcgttttcattcacgcctgccttgcctgcttctcgtttcttgctagatgaatggcatcatatgccgcaggtgtattagtaatttctgagtttgttccccactaaaaatgacctcattgttttgtgcttcttttccataattatacagtaacaggaaaataaaccagctctgagtacagcccacagcagaaatcttgtgctctttatgcaagtttgatttatagacgtgtactgcagagcagagtgactatgaaacattcatcttcccattgctagttgccatggaaatcgagtacacagagcagtgtcattccagtcctggtgatgcctgcagtagtttattcctttgttgttcccgtttcttaagcaactgcctagcattctttcatcattacaattaatcatgcacacaagtttttatctttcgtcgcacatagaaagtactaaaacgtatgacaaaaacagggagaatttaaatattcctatggctttaaatatgcatttgtaattttcatcctcagtcccactggaaaaataggtcatgtaaaaaaagcatatattaatgtacagatatttcaatagagcagtatagaaatttgaaggaaaaacaatgctaactaagcccaggaagcccaggaaaccttaaggaacttcagatcctgagggtcccccagtgtttagatctaaatcagcctgggtaatgccaatcaaaaaagaaaaaaaaagcccctgagctatgtatcatcaactcctgttttgatttgttagtctccttaacggtttgaacaacctagatatttgctggatagacatgctagacgttagaatagagatcctttttctctttaaaggccaataaagttcaggattttttttttaagtgggagtaaaaggaattctagttttttcttttttcaatgaaaccattttacctcagttttaacccacatagttcatagtctatagcataccaacaatgaataaatgcttgttgattagccactgccttcttttgtggacttctggccattctgttggctaagaaagcgtgttctagaacaattctctggatctaaatccctgctgcattgcttattagctgtgagacctttgaaaagtatctcagcttgccttagtttccccatctgtagagggaacagctataaaattaagataatgacaggttgttaggaggcttaacagggataattcatgcaaattgctcagccctgtgcctggcacaggacacgtgctctgtcagtggggactgctgccgtggcagtggtggtttctattgccatgactactacaggccacaactgaatggagaactgtgctctgacctagagaataatacttggttgatctacagcaattctagccccaaagccgcaggactctgttcccagcatccaggctcacacaatgattgctggtgctttgttgtgcttgggctacatggacttgtttcatctcaagactgtggatactaggatggtggctgagaagtatttacaggggtctttttatctgcaaattgagaagagaaggctgctacaggcagtccttgaagatgcaaatttctcatctttgacctggatttgtttcttacaaggagctgtgtgcggagcacgttgggagggagtgggctgcctttacttgtcttgaggaaggttctcgtgtttgtctgcgtagtctgaaataacgtctgacctactgcctctccacccccaaaccccccttgtcactcggcagtgcctgcagcattccttcagcctttctggaattgaagttttcctaactggtggcagaagcattctttgttgaaattcactctccttggcagttctccagggcacacggcaatgcctatttatttgatttagcctttgtttggttagccttgtattttgtctgttttgctttgcgaagttcttttttccccaaattttcatgtttaaatcccttggacttcacttctatttattttactagcttgctttaaaatactgctaaaagttgtttgctttaagctctcacaaaatgagtagtcttggattcatttgtctgttttctccaagcctgatccatagtgtgtgtactaggtgcacctttgttaattattaaaacaaaatagactttatggtttgtactttgtacatccgaatattatactacattgtctccagttctctttatttagctctttgtttttttaccctgtcctccaatcattaggctcatgttaattctaaagagatagaagtagcttaacttttctgaatcttttcgttctccctcctctgccattcttcctgcttcttcccacaatataaaaacccgtccgactctcctgtcttccgagtgaagctggcaacactccaagtgacatgagtaccctaagacacccatttttttgtaagtaaacattcagtgacgaaacttagaccttctctagacatttttatgtatgtatgtatgtatgtatgtatgtatgtatgtatgtatgtatgtatttgagacagattctcattctgttgcccaggctggagtgcagtgacacagtctctgctcactgcagtctccgcctcctggttcgagtgattctcatgcctcaacctctcgagtagctaggattacaggtgcccgccatcacacccagcaaatttttgtatttttagtagagatagggtttcaccatgttggccaggctggtctcgaactcctggccttaagtgatccgcctgcctcagcctcccaaagtgctgggattacaggcgtgagccactgcacccggtcactagacattttaaatcctctcaagacccctgattgtatgtgtggccttcacctcacacttaacgtggccaaaatgcactcctgccttctctttgtcccctaatcactgtaagagagatctttccctgtgctcttttattctcaggcttatatctttctttgttttggaaacacatatttgttagaatcttctgcattgcagatactgggattgtatgaaaatgaacaagatagaaactgctctgccctttaggagcttagagtctagttgaggatgtaggtggttagaatccaagatggttaatcctgaaagatgactacaaagtactatggagaagaagaacgcttgctgcagactggggagggggcaccaaggctgacatcagagaagtgatagccggcgtgagacctggaggatggtctccatttgcctgacttcgccttagccagggaaggagggagggcatattctagacagagtgcatctgcagaggtcagcgggagagcatgaataacagagttgttacgcatagttagcctactatcaaatacacctatttttttcagtgggtgggtggaacgagagatgaatgcagagtgatgagactggagagataggcagtgccaggtgatgagggtcttgtaagagttcagactttatcctgagataccgggaagccatcgaaatgtagggaagtgaggtgatcagacattttttgttttgttttgttttttgagacagagtcttgccctgtcgcccaggctgaagtgcaatggcgcgatctcagctcactgcaacgtccgcccccccggcttcaagctattctccctgcctcagcctcccaagtagctgtgattacaggtgcatgccaccactcccagctaattttttgtatttttagtagagacgaggttttgccacattggccaggctggtctcaaactcctcgccataggtgatccgcccaccttggcctcccaaagtgctgggattacaggcgtgagtcatcatgcccagccgatgtgatcagacttacatgatctctcctagtgtagtgtggagaatggattaaaatgtggcaagaatagcctctatttgggctgatcctagggaccgttttcccaactcagccttctctttaactccacagtgtttgtccagcccagcatgcatttttctgattagcatgagggttcatctcaaacatcagctccctttctctagcttcctgtcttaaaggccaggactgtgtcttttccctagctctgggctggctcttactctacactaaatgtgtcatctggagcaccaactggatccaggctttaccattgcccagagagtctgttgttttgcctactatcttggctcccctgggattttggtgccagcttagatctagcctgagttcagtgatctcctttgacccctgaaattcattgccattcacacgttggctcttcctgctcagccagtctagaacaaacctgccgctgagggaatccctctcttttcccacttgcagttgagtatcctagatacttcacaattgatctccattgtatacctacatagaacaataccttcgataagatggattgaggtaaggtgaggagaaccagctacaggttgagtatctcttatccaaagtgcttgggaccagaaatgtttcagatttttttattttttcagattttggaatatttgcatatcataatgagataacataagaatgggacccaagtctaaacacaaaattcatttaagtttcatatataccttatacacaaagcctgaaggtaattttatacaatatttttcatagttttgtgcataagaagtttgtcttaaatacttatgtatggaattttccactcgtggtgtaatattggtactcagaaagtttcggattttggagcatttcggagtttggatttccagggcaagttacttaacttctctgtgccttagtttcttcatttataaactgcaggtattaagagaacttacaccagagttgtttggaggattaagcgagcgaatgcctgtcaaacactgtgcctggcccataactagctctcactgcttattcatgttgttattatggtgtctagacttaaccctagggaaagtgggagaacataaaaggtttttgacttcaggaatatttgacaacagacaaatgggtattaatcttgaaaggtccacccctcctcttcactgtgaataattgagagatgacagtggtatcacatcctgcccagctggggggctattccagtgagtaaatagatgtgagggagtgataaaaatagctagctgatatctagtgctcactgtgtgccaagccctgttctaaatgctttacttgccttaactcatttgatccgcacaacgaccccatgaggtggctactgtgattgttcccattttactgacgaggcaacaggtacaaagcagctgagtgacttagctaagatcccattaactgctggaatttggcttggaccagacagtctgactccacattggaaacacaaatagatacagccaccgtgtaaaggaggatctttgcctttcctttttctctctccccacaggtgtacccttaaaaagggattttgaatctctttatcaatcagatctattacagtctgtaaattttgaaggaaccattttatttaaaggcctttccagttcagtttcaatagaataaagatctagacagcatataaattttcatagtaaaaaatagagctatataatctatgaccataacccttttcatagccctaaggttggggatatatgaaaacacattagctgaattgtacattctttttataaaatgcctgatttctggcaatttggtcatacaatcttttgataaaaatatcaaaaacctcatactgcaatactgtaaaatgtgactctgttaatggccaaaaacatctgtattttttactgtcatgaactgtttaaacatcatcataataggaaacatttatgacttaaataattgaagtctacatttctcagaatccacctgctcatctcaaccttttgttagaccctcaaacaaatcacagaattgacaggcttgagtttctctgtaactctttcttctccatcatggggtggtaggatgtgcaggggctgttggtcagttcttccaagtttgaatgtcatagtcgtgggaaactgatgtaggcatctgtcatgggaaactgatgtagggaaactgatgtctgttaacctccctggacttcagtttctacttctgaaggacttctagctttaaaataccttgattctctctttctaaaccttttgtttactcactctttaaagaatattataattaatagtacagtgatctaatggtaagaaatagagaagaaaaaataatttggtttcattaatttcatttaacattatttcacaaaagttcattaagcacctactatgtgcatgataaatacttgtttcacagtccagtatactaataatgttaaattctcaaactgacttgggattttccttccctcagttttcccattgctaatgttcccctcctggctacaacattaccataaaatgttatactctttaatcttattttcatattccccaaacaaaacaaaacaaaatctttcatctcaaagggatttttagcatgttgcaaattatcattaaatcacacacaattttctgtcttcaatttttcaatgtaaaaaaccacattttaaaacctactaggttatatttcttaggaaaaaccgtagacatcaaatgttcacttctaatttagatgcgtcagctgacatactagtttcaatgagttgcagtaatgaatttgtcatagaattgaagccattttctagctataaatcgcccaaacccaaatgctataggaaatttacaaggactgccattagaataggatattttaaattatctcagttgtattgaaacaaaaccaaacctgattaacagatatatcaggtaatcatgaattgatgtgacagaaaagagttattgggctatttgtcaaatgataaactggatgatgatgatggggaaagttacctttaatttatttatttatttatttatttatttatttatttatttatttattttagtgctctaatgagtgccaggcattgtcagtatttcatgtaatcctcatgataaccttatgagatgtacagtattactatttctattttacagataagaaaactgagcttggagaggttaatgttcccaaagtcccacactttaaatagctgaaaatgtttcacattgcttgttgtcaccttgagttcaccatatttaaagtgaaagtcatcatcctcatcccttgttgttctttctgtttcgtcagtgatatcatgattttctgtttcattcttgcagtcattgatttttccttttccgtctttgctctaaatccattcaattaccaagtccctttcctcattcagtgtctttctgctgtcagccctcttctcatcacttagtgtctaggcctcccaactaaatgtacaggctaaaggccaaactccataactcggtcctcaaggctggctactctctgactcctcctcttcttttaggctctttttcctgttacttctctccagatgaactagttacctaaatactttgtgcgcattttctacatccccttatgcaaatgataactcttgagatggcctctcccctgttccctggtccgtgagccctgtcccttcctcagcatgagactgggtcctctcctgaaagatgtgttttgatcagctcattcctcagtgagtatcccttcttttcaatgcttgtgacagtaggctctatacctgtcattttgcactaagcacgtgccacctgactagcattgctgtacaactcttcatcaatgtgatctgtctctctcttagtggtggttaggactgggtctagatctctccctaacatgtggaacattgttctatacctagaaagtacaagtcttcatgcttcgtgtgcatgggtaaggagaggaatttttatggtaactatagtaaatatctcacatattgacttcattgacttaagagatctcctgtgaatcctccaagccttattattcagacccatttcactagaaagggaccacatgtactcataggatacagtggtagattgtttgcagagatggtcacagctccttccatccctgtgcatgcacctgtgtaaagtgacttggctctcttcccagcaggaggaagaatttatttcttcactccccaaatcaaagctgacttgtgacttactttgagcaaagagcatagaaaaaactaataaatctcaaaacctgaggggtggtctaggtgaccacccccaacaaaggatcccatctgggagaaaatttttgcaatctacccatctgacaaagggctaatatccagaatctacaaagaacttaaagaaatttacaagaaaacaacaaccccatcaaaaagtgggcaaaggatatgaacagacacttctcaaaagaagatatttatgcagccaacggacatatgcaaaaatgctcatcatcactggtcgtcagagaaatgcaaatcaaaaccaccatgagatagcatctcactccagttagaatggcgatcattaaaaagtcaggaaacaacagatgctggagaggacatggagaaataggagcaattttacactgttggtgggagtgtaaattagttcaaccattgtggaagacagtgtggcgattcctcaaggatctagaactagaaataccatttgacccagccatcccattactggatatatacccaaacgattataaatcattctacgataaaaacacatgcacacgtatgtttattgtggcactattcacaatagtaaagacttggaactaacccatatgtccatcaatgatagactagattaagaaaatatggcacatatacaccatggaatcctgtgcagccataaaaaaggatgagttcatgtcctttgcagggacatggatgaagctggaaaccatcattctaagcaaactcacaaggacagaaaaccaaacactgcatgttctcaatcatagatgggagttgaacaatgagaacacatggacagagggtggggaacatcacacaccagggccggtcagggggtagggtgctgggggagggatagcattaggataaatacctaatgtaaatgacgagttgatgggtgcagcaaaccaacatggcacatgtatacctatgtaacaaacctgcatgttgtgcacatatacctagaacttaaagtataataataattaaaaaaacagatatgtttgtgttagggttctctagaggaacagaattaataaaatatgggtataaatatataaaaaaaaggaatccatctgatgccatgccttttgccacattagcgcctgagtttttgttccattgtgtacatatgatagatgtggtttgagatgcttctttaaccaaagttttaatgcatttcaaagttctgcacttctaagaagtgatcttaaaggtagataataaattgtggttattcacatgccctgataccatagttctgttttatctcttgtagtttcttgaacgtagtccaaaattaacattgatttaaagtgctaatattttctcagatctatttttaaaactttgcattcttgtgttcttcatttgcaaacacccagaattgcccccccccttctcttttacccattataaggaaacaagttctctattcgtcaaatagcaaaacagcctttgcttagcagtgtatatttcacttttgtgctaaagctgtatcccagtaacattttctttcactgaaaatgaccatttcttcctggagtatataatttttttcaaatgcgtgaagttttcaaaatgaaaccatatcagacagaatgatctttggctttatgaaagtggaatattttttatagttctgtggttgttcattattttaaaacctattagttacaacaggttagcttgaaaaatgaggaggtttaaatctgagacaaaatatctcactataattagattctgaaactgtgccagcaaaattgtgtttgaacgcttcttgaatttgttttgtaaggggtagctttctgttttaaatgtgtattcagtaaaacacagttattcaaattctactagacatgtaggagagccagattcatgtgtaacgcagatgcggcattgttcatggggctgtttcctcctaatgactgacctaatgtgttgtgtctcctttttctggctgagagaaggaaccacattttagaagcattttattcagtaatatgttcacattgtgtttcacctcttgctatctcttatactacaagaatacctgtgacgtattgagatagctaatatcattgctagaaaagtacaaggtaatttggatagaaaataatgtaatagctttagtaacagaatataattaaattagtgcctagagtaaaaatagtgaaaggatttatttttagtcttgaatggcttagatcagtatgattaaaatacgtaaattaaataacagcatttagttcagtggtgttctgagtggtatcaactctctctaatatctaatcttaagtgttaataatctaattctaagtattctattttcctctgccctcccccatttttaagtaaacccaatatgaattagataaaatagggaacacatttgttatattcttggaagccttgagattaaggattttaaattgggctggcatatttttattaatctactggaaagtggttattggagcaccttctgtacaccaggggccattctggatgctgagaatagagccaccaacacagcaaacaaggtccctgctgtcagggagttcacagtttccttgggagaagacagataataactgagtaagcaagttaatttcagatagagataaaacactgcaagaaaagtaaaacagaataaattatagaaaacgtttgaatggggaaggggttgcttaaaattgggaagttagggaagatgtttttgagggctgacatttgaactgagacctaaatgacgaagagccatccagaaagaggaaaagcagttgcaaagggtctgagatgggtataagcctagagggactgagaaactaaaagaaaaccagagtggctgggttgcagcgaacaagaggcagcaaggtctgagcaaaatttgagaggtaggcagggcaagatgctgtgttagtcatgggtgctacctctttcttttatatgacggtgagtagcccttatcggaaatgcatgagaccagaagtgttttggattttggatttttttttttagattttgtaatatttgcattatacttactggttgagcatgcccaatctgaaaatttgaaatcttatacattccaatgaacattgtctttgaatatcatgtataatatcaaaaagtttcagattttggagctttcagatttcagattctggattaaggataactcaacccatattatattctgtattgtgttacattccattatgtcatatcatatttcacaccatgttgtgtatttatattgtattatatatttatgtccctgtaccttacagggaaatgaagagtcaaagaaagaccttagatttctcaagatatgtaggttttctggcattcccagtgtacaaagtcatgctagtgggttgctgtatcctggcttggggtccccagcttcttttcatgtttctttcccattgtcagttaaattcagttcaacagatattttcttggtgcgtgctgggcccaagaaacggatgagtccacttgggccattttacagatgaatgcagatgaaattgtgataggctttcattttagagtaactttcctagattatgtctattatttcaattagtgagcacctatcttttgtaccatcttttttatccttaggttacaagcagtaaaatgatcataagggccaaatatctaatctaaatggcagtgatatgtaatgttaacatagtcatcatttgtttctctccactggcgatacaagacataaaaaagtgattttgagtcctgcttatgcatcacaccaagaagtgtttatcatttgaatacctctcttctgggaagagtaggggtaagaagttttaaaaaaattagcagtttaataaaatatgtgaaagtttacaaatatatatgcttttaaatgaggcaacacagatcttctgttatgatggttatgattcagagtgtctgatttacactagaggatcaggaaataatgtagactatttcctttccccgtgtcttcataccatatgtagtcataatatactgacttaaaatttccaccgaattaaactttccagtgatttataagacgttgaaatgcattaccaagagcagttattgaatcttccttcagagataattaacgaaaagactgttattaaaaaagaaaaaaagcaataatttacctttcatgttggcaaaggtaagctctagaagtctttctgtgatttgctgatattaattccactccctggatgtttgttttgctttattctttctaactctccctgattctgtggtttaatagattttcctcctgtttagaataaaattgtagaagtcagtaccacatttagtatctatctccaggcatggccaatccttcccactggctgtgttccggaaggttctggaaaacagctgacaaagcctgaatgtgacagggcaagacattttaggcagccctcatggctttttcagctgtgcttcttattttcttatagatgtatgtgtggtatgtaagtgtgtatgatgcatatatgaaatattcaagtcagaaaatttgtccatttatgttcctcccaggttacgaaacaaaatattccattctagccatggttaaagccccctgggtagccctgcctgattgccctagagatcatcactgtcctgatttttttttaatcattcgtgtatgtctttatattttatgacatggatttatatatcttaaatagtacagagtattggtttgcttatttttataccttatataaatgcatattgctttttctcttattatattcttaggaattatccacattgatccatgtgtctttcatttattctccctactgtatagtattctgttggggcaccagggggcacaataaccagcaccttcttttcccctccagaatcaattgaaaattcgactccaagtgcaagagagtaatagatagaaatttcagctttcttagtgacatagctctattggagggattggtttgctaaaatacagcccacattaagcaggtttaccctttagagtggagtggcagggtctttagtgtattcatatcagcagttgacttgtttcccaagtggttgggccagttcacagtattaccctcagtgcaccagaattcctttctatccatatactcaccagcacttgttactgaactctagtttttgccaatttgatgggtgtgaaatggcatcttattgtgatttttaatttttctcattacttacaaagttcatcatgtctcctagccctttgggtttcctgttcaatgtcaatttcctatttatgtattggcccacataaaaaatattgcatagtctattttaaaatgatttataggggctctttacatattctgggtactaattattccttatgtgtgagtcacagaaatttttacccacttgtggcctgtcctcactttttgtgggggagggattatcttttgatatataacaggactatatattttcccagaggttttagagagaacgtgaaaaaaagaaaaaagcctgggactgtttggcatgtccaaagtctagaattttggagagcatgtgtgtagtgttacttgagcatgtaaatggggtctccctggtgattttctgcctattgcaatactcactttgaacagttgctcatctttctttttctatattagccagtttgaatatttctctaagatttacattatgtttcaagttattttacattatagaattaaatgcttactgcttaaattatgattttttagcctcagtatagttgcatgaaaaggctataccataaaacaagtgtgacctaccaaaaagcaaatttgtctaccacttggcaactctctacgtgtaacacagcttttgcattttagctattctgatggcaatgctgtattaatatttcattctctccgtagagtttgtggacattgtcatcatccgaaggcatttgagtactaaattgcatatgatgatacttataaaagaaaattgcaggccaagcatggtggctcactcctggaatcctagcactttgggagtccgaggtgggaggatggcttgaggccaggagttcaagaccagcctgggcaacatagcaggaccccgtcactacagaaaatgaaaaaaaattagctgggcattgtggcacacccctgtagtcccagctactcaggagactgaggcaggaggatcctttgagcccagaaattggaggtttcagtgagctacgattgtaccaccgcaccccagcctggatgacagagtgatactttgcctccttaaaaaaaaaaaaaaaaaaaagaggccaggcgcggtggctcacatctgtaatcccagcactttgggaggccaaggtgggtggatcacttgacaccaggagttcaagaccagcctggtcaacatggtgagacactgtctctaccaaaaatacaaaaattagccacacatggtggcatgggcctatagttccagccactcaggagggtgaggcaagagaattgcttgaagctggcaggtggaggttgcagtgagccgagatcgtgccactgcattccagcctgttcaacagagcaagaccctgtctcaaaaaaacaaaacaaaacaaaaacaaaaacgagaaaaagaaaatcacatcatgattttgctaattcttcataagaacagtttcttgtagggtcatgcatagattttcaccataaaaagagcctcaaagagcatgtggtacagtctcttattttacacatgcgaggataaatgacccatgcaaggcctcacaccttgttgggggtgaatgtgggcatggaataggattaggacccagggttcttggcccctggcacagtgtgttttccattgtaatggattatagaataataatgttattctttatttttataaagttggtgtgcatttctagatttccttagctagaattccttaggtttcacagaaacataggtttcagtgcttttagctttttgttgatgacatcttttcagtttcttagtactgaaggaactgttcatcatacttgcttaaattagctttatggaaataatgtatactgttttccttccttattttcaaccgtatttacatgctagtctttccaacaggttgtataaataagttaaatgttatggtaaattattccaaaatggcatattaagtttgcataaattaaaactatggtgtaatactatgaatcagattgtaactagatgtaaatttgtaaatgtgtatagttaattttttaaacataatttttccatgtgcgactgctttatttaagttagtgtgtttaacaataaaattaatgcagtcaacccgagaactacaatattaccattaactcacatatacccgcacactcctccatcctatcttcctgcctttttccataggaaccaatatcctgaagtgagtgtttattattcccgtgctttaaaaatacatgcacacggctgggcgcggtggctcatgcctgtaataccagcactttgggaggccgaggtgggtggatcacgaggtcaggagatcaagaccatctggctaacacagtgaaaccctgtctctactaaaaatagaaaaaattagttgggcttggtggcatgcacctgtagtctcagctactcaggaggctgaggcaggaaagttgcttgaaccctggaggcggaggttgcagtgagcgaagatcacgccactgcactccagcctgggtgacagagcaagactccatctcaaaaaaaaaaaaaaaaaatgcacatatacatatatatacctatatgtttctctaatgtttaatcttccttgtttttaaactttgtaaaaaagaatttcaaatgtatgtagtctttgtgacttgctttttttcactcaatagtgtttctaatatttatccttgttttatctataattcactcatttaaaatgtgtttagcggctgggcacagtggttcacgcctataatactagcaccttgagaggccaaggcgggaggacctgtcaaggccaggagttcaagactcgccaagcagtaagcaagaccccatctctacaaaaaatacaaaataaaaattagccaggtgtggtggcacatacatatagccctagctactgtggaggctgaggtgggaggatcgcttgggcccaggagttcaaggcctgcaggagtttgaagatgcaggagtttgaggcttcagtgagctatgctcgtgccactgctctccagcttgggtgacagaggaagatcctgtctctaaaaaaataaaatagtatagcattccattgtatggatttaccacagtttgtctttgtttcctttttctcttcttattaatactgtatgaacacttttgtgtcataattcctagtgcccatgtgcaatgcttctctggatatgtacttaggaatggaattgctaggttgtaaggtacacgaatgtttacttagatagtgctggaatatcataatgccaaatgatattttcaataattcatatcaatttacattcccaccaacagtatattctgttgatgggcatcctctccaactcttgccaggcttctttttttttttgagacagagtctcgctctgccacccaggctggagtgcagtggcacgatctcggctcactgcaagctccgcctcccgggttcacgccgttctcctgcctcggcctcctgtgagtgagtagctgggactacaggggtccgccgccacgcccggctaattttttgtatttttagtagagacggggtttcaccatgttagccagatggtctccatctcctgacctcgtggtccgcccgcctcggcctccgaaagtgctgggattacaggcgtgagccaccgcgcccggccgccagacttcttaatctttcccggttgagtgggtttaatatctcattgtcggcttgatttgtattaccctgatggatgatgagttctctctcttatctcttcacatttactagtctcctctgtgacatacctgttcatggtttttacccatttttcgattgcatcttctattgatttgaatgtgttctttatatgtgttctcagtacaaatattcggtctagttaacaaatatcttctcccagcttgtgacttgtcttttcactttcttcaagtgacttttcagacataagtaaatttagtttggttaaatttatgaatctttgtcatagttagagggctggtgtcctgtttaagaaacccttcattacccccaaagtcagagacctattacctatattttcttcataaaatttacagttttgctcttgaaaattaaatctgtaattcttctagaattgatttatgaatagggcgtgtgtgagaacccagtttcaccttttccatatggacaatcagtattttcagctttgtttattgaatgtgccctcttttctctgctgttctgctttgctgcctctgctcctgtgttttctgttgtttcactggtcacttaatctgtctctgcaccaatttctcactgtcctcataaaatcttaataccagtagggcaagtctccctccttatttttcgtctttagcagtgtgttgattatttccagctctttgttttctcataataattccagaaactagcttgttaaaaaccagaaactgttcagatttcgattaacattgactttacagatgaatttctggaaagttgacatcttaataatattgtcttcctattcataaatatatttttcattggatatttcagaaaattctttttctgaaccatcacactgctgtcaccatcataatcacattggttttcacttacgctgtatttcttatatgccaacccccattctatttgtatgcagtttttacagcagtcttttgaggtagatcctattattatgaaatattgcacataggaaactgaggcacagagaggttaatcaactcactgtagatcacacagctagtaaatagtagaggcaagattctagcccaaggtgcttggatataaagttcatacttttaattactactctatattgcacacagctttttttcttcttttgttggatttcttcctacatattttatcgtttttgttgctattgtaaatagtagcttttgaaaattatgttttttaaattacttgtagaaacaatagaaatgaaattgctttttgtatgttaatcttctagctaacaaccttgttaactttgtagatttttaaggatccacaaagataatgacatcagtggaaaatagtaattatttcttccgttccaatccttatatcatttatttctttttgctgacatatgcactggctaggacttacaggggtgatagtgtcttgttctgaaactcaaagggaaagatttcaatattttatcacttaatttgatcatagccgtaggggttagatcctttctcagattaaagaatttcttatctggtctagtttatcatgagttttttaaaaatcaagaattgatgagaacacatggacacagggaggggaacatcacatactgggggcctgtcgggggcggaggtgggggggacaactggaggcagagcattaggacaaatacctaatgcatgtggggcttaaaacctagatgacaggttgataggtgcagcaaaccaccatggcacttgtatacctatgtaacaaacctgcacgttccgcacatgtatcccagaacttaaattaaaaaaaaaaaaatcaaggctgggtgcggtggctcacgcctgtaatcccagcactttgggaggctgaggcgggtggatcacgaggtcaggagatcgagaccgttctggctaacacggtgaaaccccatctctactaaaaatacgaaaaataagccgggggcgtgatggcgggcacaggagaatggcgtgaacccgggaggcggagcttgcagtgagccgagatcgcgccactgcactccagcctgggcgacagagagagactccgtctcaaaaaaagaaaaaaaaaatcaagaattggcattaaatttcactatatgctttttctgtatctattgagatgttattttttgaaattcattaatatgatgaataacatgtctgtgtatatgtatgtatagttttaatatcaattcatcttttatatttttgatataaacccaagtttactatcctattatctttttttttgtttgtttgttttttttttttggagacgagtgtgcagatgtttattaggggatattcttgaaatggatacctgtttggggaagaaaaggaagcaggattgggcagggggataacttggctatgatgtcacaacagtgtcctcaatgaagcccacagagactgataaagttgggtttgactttcagagttgtccagagctggggcaagagggaaaggcctttaaggccccccaggagatggactttggatacgggctgccctgaagggagggcctttcccagagagtggggcaagctgaagtccatcatccagcggcacttcagcagctggggagagggttgatgggttccccagccagaaagggggatcttggtggctcatcacagtggccactgtgtgcccaacatagttgctgcacattcgtgttcatcccagcctccaacatccatttttcagcccctgggcctagggtgggggcaaacccagcaaccctgggtttgacatcacatattaatcccattcccagaatcattttagcctgaggacataaggagcctccaagccaagctccccttggaatttcccgcacctgcctttgctcatgcagcagcttcctgacgctggcttctcagtgtctgagcccaggaatgctgccagagtgggcacatcacagccaagaaaaagggagtgggaatgagagcttttgtcattcagttcacagcgcggcaggctctgggtgagcacatcctgtccactatctcattcgtggtcaccacctccctgcaaggtgggatcttttatgagccccatcgatagataaggacactgaggctcaaggacaggaagttgcacatctgggctctcaggcctttcttttcttttcttttctttttttttgaaacagagtctcactctgttgcccaggctggagtgcagtggcacagtcttggctcactgcaatctctgcctcctgggttcaagcgattctcctgccttagcctccggagtaactgggattacaggcatgcaccaccacgcctggctaatttttgtatttttagtagagacggggtttcaccatgttggccaggctggtctcgaactcctgacctcaggtgatccgctgtccttggcctccgaaaatgctaggattacaggcgtgagccaccatgcctggccatcagacctttcttttctgtagaaacccttgactctaaaatccaggaagcatgactgtgtcaggatactgtttatatgaacccttctgtcatttgtcctccagagagatactaacattccccatcccaccaggtgggctaaggctgggactgctttaaccctttctctcctagagtcaacactggcatgggcctgggtgctgcttcctgctgggggacctggggatttgggtcttgtggatgagccggacaccccccaagccctcttctagcttgatgtccccctgctgcagggcctgctggatagcatcagtgagggcgtcaaaggccaggtccacattgcagttgtttttaacagaggtctccacgaaggccatgcccagggaggcagctagctcctcggcctcctgggctgagacacagcgggtgctctgcaggtcactcttgtggccaaccagcaggaagatgaccttgtccgggccctgagtggccatgacctcctggtgccagtcttggatgtgttcaaaggacttcctgtttgtcacatcaaagaccagcaggacacccaccacattccggtaaaaggacccggtgatgcagctgaagcgctcgtggcccgcggtgtcccagagctgcagcttgacccgcggcccagcccgcagctgcagcgcgcggcggtagcactcggcgcccaccgtgggctcgggcttgggctgtggggcgccaggcgcgcccgccacgtagctccgcagcagcgacgtcttgcccaccgccgcgtcccccagcagcgcgacccgaaattggtagcggcagccctcggcctccatggccgcgtccctatcctattatctttttaatgcacagtaggattcagtttgctaatattttacttagggtggtgtgtgcgtgtgcgcgtgcgtgtgtgtgtgtgtgtttgtgtctaaaatggagctgtaattttcctttcttgttttgtttcatttcaagcttatactggcctcatacagtgaattagggagaattccctctttttatatttggtacagattttgctattttaatataaataaaatattgccttggaaattttataactttaattataaacataatcagaaacctcttgcttctgacaatacattgttttctgctactttgaaaaactctgatttctaccataatatctcaaactcttaagtaattttaatgaattaaaagtacaaaggtattaaaaggttataaacatttattaaaatcctctgttacatcttatagttttctattccctgaagtcacttcaagttatttatttttaaacatagaacctctagttgaagtctatttatgtctgcttctgctggttcttgctcatggtgactagtttccctgtaaacttgtttgtattcaactttctggagctcaccgaccttgaaaaataatttatgaggaattccacaagtccaggatgaaatcagagtggtttatgtgtttttgccaggctccttgtagcacagtcagtacaggactatattaaaacaaatccacagatggaagtttctgtattcactcaaggtatgtttagacctaggatcccagggactctcccagtgagggtcagtcaacactcataacttctcaggggtgaatgatcgttttttatttcatttttctcttactcctttgctcagcaccagggaaactttcatgtagtcctttggatttcagcttaatgtgggaaagttatcctgtgagatgatccaaattggcaaagtcctggatcttcacttctggcctcgtctccccatgaggctaccagaccgcagccccagtgcacgatgtgagtgaatgccttcagggcaaaggtggctttgggatgccaactttctttccactaacctctttgggttcaagctagcctcaagaatttggcctggcagctctttttaatttttcagtccttttaaggtggttttgttttagtgtcttatccagcatctttagttttttgcagtggggagttgatctgagtatccaaaaacagaaactcatgtgaattcttaaatactttgtctcccaaacttttccttctaaattctgctttccaaatattgatttattaggtagacaataagaattattaagtgttagaaaagagtatcacttatttgtaagagatatagaaaatatataaaatcagtaatgcatttctaaagcttagtaattctggcattttagctttactttatcttctattgctgtttaaagaatatgaccaagtatttctgaccttttattgctcttatattgaatatcatttagaagttgtaagctaaatatttattttcgtataacctaaaaccatagtattaggaaatactgatgtaatttagtgatcatgtcattgaagcttaacatttttattgcattcattatttatgagaagaaatcatgcagtgtttctgtttttatcaaggtattatatctaaaaatcacttttcttgaacttgaactcaatatttataaaagtgcattttatagtacttatacctacgacaaaataattgattaactgtgtccaagtgtgttgatgggtccccaagggccaacgctagatttgatgattcactagaaggacttccaagactcagcctacagtcgtattcatggctatgatttattacagtgaaaggattcaatgcaaaaccagcacacgggaagggtacatggggtgaagtccaggggaaaccagatgccagtttcccattgttcccctccagtggagtcacagagaacacaattccccaatagtaagctgtgaccaaacatgtgaaatgtgccaaccagggaagctcagtagagactcagtgcccagggtttaattgtgggctgatcacactggcattctctgtctggcatgtgccaaaatttcagactcgcagaaggaaagcaagtattcagtgggagccatgttgtctgcacaaacagttttaagcacagtgatcaactcttaccagttaatggtggtaggaaccttcctgaaatccaagttcccagatgccagtcaagggccaggcttgtaagcagaattgcagtcaggtctgctgtcttaacttttttctacatgtggaggtgtggctgaagttttttaagcacttaccatttggcaagcactgttctaagccctttactcgtttcatcctcacaatcaccatttcatagatggggaactgagggatagagaagttaaaaaatttgtctcatatttcacagctaataagtagtaaaacaggattcatagtaaggcttcgaatccatgattttatccaatactttatttgggtttttttgaaaattactttcattttgtctcacctcatgaataagatgttccatacatttccttaaaatggtgattaaaataaattgtcaaaaaaaggaagaaattgtcttcatacagccccttttaatcttcagtgttgtttcatggctcttaattttcagatttgaaaaatcattctaattatcatgcaaacccttcctgatctcataggcttttctctgcctctgtgtttcttctgggttggagaatttgaattgttttttccatttgtctggtccttgaccactaatttactgccatggttctttctgtatttcccttttggtattttctgaaatttagcaattagaactgcaaacagagacagtatcacagcgccatggttttataaacaaagacaggacagctgtcttagtccatttgggctgctataataaaaataccataaactgggtggcttataaacaacagaaatttttttctgacacttctgtaggccgggaagtccaagagcaaggagctggcaaatctggagtctggggagggcccactttctggttcacagatggtaccttctaaatgtgtccttgatatagtttggacatttgttcccacccaaatctcatgttgaactgtaatccccaatgctggaggtggggcctggtgggaggtgtctggatcatggggacagatccctcaaggcttggtgctgtcttcatgttagtgagttcttgtgagatttggccatttaaaagtgtgtagcacttcccctgctccaactcttgttcctgctctggccatgtgacatgcctgctcctgctttaccttctgccatgattgtaggcttccccagaagccaagcagatgccaacgccatgcttcctgtaaagcctgcagaaccataagccatctaaaccttgtctttataaattatctaagctcagatatttctttatagcaatgcaagaacagcctactacagtcttcatatggtgaaaggagagaactctagtctcttcagccccttataagggcaccaatcccattcatgggggttcagcctttatgacctaattaccttccaaaggccccacctccagccatcacattggtgattaggttttaacatatgcatttggggcaggcacaaatattcagaccatagcaacagcattttctgttttatttccttctttgtaattctcatcattgtattggccgtattatctacctcagtatgttgaacagtgacttaagggcatggcctttaaatgctgctagagggccatctgggatatagctgataactaagagcttgcctctctacaagtatactttagattatttttttagaattgaaatgagaagattcactatttgctatatccatttccaagaaaatatattatagcttcaagaaaaatgcgagtgttaacacgtgctgaaatatgatacagatgtttaatgtcttactgtaatattattttactgttcatagtcacctgcttttttgatccctgcctaagtttgctttctttattccataacacctgttcccaggaatatatttacagtctgttgtcttttctaaatggttggtacatatgtaagaaaaaggttgacttttactggtttctttcagtaaataccttaaggattccttgttatttattttcagtgttactttatttcaatttaataccttagtactgtttttacttaaataccacataaggagtcatgctatatgacctaggcatgacacttacttaaatgtttatggatagaaaacaaattatttctagttttactttttaaaaagaattccaaaacttcaaactacacatgataaatggccctgtgtttccataggcttagaaagcttatgtctaatttattactcctatgtgatcatgtgtatctagttgtttgctaccttctatttcagatctttgcatttgtagttccctgtttaaatatcacatcatcagagaggcctttcctatccaaagtgacttcactccatctcccatccccagtaaatctctgctgcctggttttatgtcattcatagcagttagcaaatctcagggaagatttttgtttttgtttccttattgtctatctgtcaggcttgactataaagcttcatgagagcagtgatgttgtctgttcttgaatacctctggatgttcaggttagttcagagcacttgttgaataaattaatgaatttattaaagactataaaaacaatctgtttatattagtatggtatttgatctttgttaattcaaatctataagattttctgtggattatttaggatgtgaagaaggtatccagactgaccttaggtttaggttataataattagctaactaaaaagttaacaatggatatatttaatctctaagcctgattaaattttctgactctttgggctgtctctgagaattgtgtatctgctgtaaattaccaaaactgcaataaatcaggagtctttccaaatatcgagatactaaatacatactttgatctctttgtgtccattagaaatattttaaacatagaaaagtatggagaataatatggtgtaacacttgcatttcagccacttccctttatcttgtcttaatatttgtcatatttgcctcagtgtttgatcaaaaaccagtcttgatatttttaagatatacttaaatcagtagatcttgagtaaagcagatcactttcctttttttttttttttttttttttttttgagacggagtttcgctctgttgctcaggctggagtgcagtggcgcgatctcagctcactgcaagctccgcccccagggttcatgccattctcctgcctcagcctcccgaatagctgggactacaggcacccgccaccacgcccggctcatttctttgtatttttagtagagacggggtttcacagagttggccaggatggtcttgatctcctgacctcgtgatccaccagccttggcctcccaaagtgctgggattacaggcatgagccaccacgcctgaccgagcagatcactttctataaggtgagagggcctcatctaatcagttgaatgccttaagagaaaacatgtaggtcccccagggaagaagcagttctgcccacaggctgccttcagatttgaggctgcaacattaactcttcccttgactctctgttatgttgcattggtctgtttgtctatctttgtgccagtatcacactctctttattatataactttgtaatcttgatgtctggcagtgtaagtcctagagctttgtgttttcttcagaattatcttggctatttttagcccattgtgttttaaaataaattttagagtcagtttttcaatttccaccaaagaaaaaaaaagaaaaaaacaagaagccaacttcaaacccaaaagttgctgtcttctttctttctctttccttctttctttcttttagttgctgtcttctttctttctttctctctttctttctttctttctttcctttctttcctttctttctctctctctctctttctctctctctttctttctctctttctctctctttctctctttttttttttcaacagagtcttgctctgtcacccaggctggagtgcagtggtgcgatctcagctcactgcaacctccacctcccaggttcaagcgattcttctgccccagcctccaagtagctgggactacaggcgcacgctaccacgcctggctaattttctgtatttttagtagagatggggtttcaccatgttagccaggatggtctcgatctcctgatctcgtaatccacctgcctcagacttccaaagtgctgggattacaggcttgagccaccacgcccgctggctgggtttttaattgaatttatattgaatctttagactagatcaatttggggagaactgacaatgccaaaatgttttaagtcttccagtgcatgaataaagtatatccttttgtttttaaaggtcttatttaactttccttgctgttttgtagttttaatgtaaaagttttacacatattttatcagataattctgaaatatttggtttttatgtagttatatagatttttaaattttattttctacttatttagatatacaattgttttttatatgctggtcttacaccagcagcatgactgaatgtcttagtctagtccgtctgttgtaacagaataccatagactgggtggcttaaacaacagaaatttattttctcacagttcttaagactgcgaagtctgcaatcagatgccagcatggtctggttctggtgaggaggctcttcctggcttgcagatggctgcctgcctggctgtgtgcttctgggtcctttcctggacatgtgcacagagtgggggatctcttgctcttcttataagagcactaatcccttatgatggtcccactctcatgacctaattacttcccaaagacaccacctccaaatactgtcacattgtgggtgagggattcgacacagaatttagagcaggagtgggcacacacattcagtacataatacaaagttaacttattctagtacttcgtcttagtaattgtaatagtatatattttatgttttctaggcatgcaatcaagtcatcttcaaacaatagtagttttatttcttcttttccaattcttatgtcattgatttctttttcttttcttactatatcagctagggtctcccacatagtgataaataaaagttatgtgagcaggtatcctgtttcttccccatcttggtggggggaggggaaaactttagtatttcacattaactatggaatatgcaataggtttttgggttttgttatgtttttaggggataaataacctttattagattaagggagctcctgctttgctaagaaattttatcatgaataaatactgacttttattaaatgctttttctgctcatgttgccataatcatatttttctcctttaccctgttaatgtgatgatgatatgcagtagaccaatagtaaaaatagaactattgtaccattagtaaatgtgaggcttagaggatatacaattgtataatttttttttgttaagggcatttaaaaattactgttttcttattattttttagagacagagtctccctgtgttgcccaggttggagtgcagtggtgagagcatggctcactatagcctcaaactcctgggctcaagcaatcttcccacctccgcctctggagtagctgggactatgggcatgtgctactatgcccagctagttttttaaaacttttttggagatgaggtctcactctgttgcccaggctagtcttgaactcctggcctcaagcagtctcccacctccatctcttgagtagctggattacagatgtaagccactgtacctgactatatggacattatttgtagtagattccacaatgctgttaaatttgtctatatctaacaggtacttgggaagaataattaaatgaacagagaagtggtttagaagtgacaggtgacttggcatttgtgtccaaataaaaagtaaatgtacatttggccctctatatcagcaagttccatgtctgtggattcaaccaactgaggacagaaaatattttttttaagttacatctacgctgaacatatacagacttttttctttgtcattatttcctaaacaatattgtataacaactgtttacatgccatttacaatgtattaggcattatgaataatctggagatgatttaaagtatacaagaggatgtgcttaggttatatgcaaatactacaatattttatagtaaagacttaagcatctatgaattttagtgttcatgggaggtcctggaaccagtccttcatggataccaagcgatgactatatttatatattcagtcaccttttgacaaagcttaatggcagtatttcttttgtgagtctgaacaaattttcaagaaactacaaaacattcctctaatatcaatttcttttattcaaagatgtactagaatattattatgttaagataactatcttagtccatttgtgttgctttaaaggaatacctgaagctggataatttataatgtaaaagggttatttggctaaaaattctgatggctggagagttcaagattgggcgttttgcatctggtgaggcctcagatttcttccactcttggtggaaggcaaaggggagctggcatgtgcagagatcacacggcaagagaggaagcaaaagaaagagtggggaggcgcccggctcttcttaacaaccagctctggtgggaactaatagagtaagaactcactcaccctcaaccccaagagagcacattcatctgttcatgaggacccacttttccacccccaggacccaaacacctcccattgggccccacttttaacactgggaatcaaatttcagctggaggtctgaggggacaaacatccaaaccatagcggtagctgtaggactttttagctctgccttctttaaattgtatattatatgtaactgagccacagactgagaggtgggtagaacattcaccaggccttttcttgttcctaagaacagtgaaaattcaaagaaggtacactctgtaggaaatcggtatttcccatcattgcttatataaatcttaagcaaccttattttaaggtgagtagatgagtgaatggatagagagagaaaaaaaagagagagagtgagagaagtcatagaaacttgctgtaggtttttcacctggatgaaatgaaacatcacagatggtttctcacagatgatctcttggcttccttttgtaggagtttctcccagggcagtgcattctttgtccatggtggggaaagagtcaaagtcactatatcaaaatgatcagtattctataacatatttgaatttagaccatctcaacatatgccgcacatacatttcccattgtgcttcacccttaacagaaacaaataataagacaaggtagtatttgaacctctcaatgaagagtttataatgcattgaataaagtcttcacagataccaatattttattcgtccctctggcacccaggaagtttttcaacactcaggcaatgcatgattgtaagattcatgttaggtaagaaatgtgcctttcttttgtaaagtagaaaaaaggtgtttgaaaggggaagtgggattagaaaaccagtatagctccacacaggtgctcttgagcaaaccagtttttggaagcattataaatagaagtcaaagttctgttaattgattatagtaatactacattgcttatgtaaccctaagcatacatgctcctatgtttaatgctactgatcttggttgtagacccaggtttgaaattatttttgttcaagtgcatgcacactgtcaacttcatacctttactctttaatgaaggaaaatttaagacaagtaaaatttagaacagattttgtatagttggtagtagaatttgaaaatatattagttccaggccaggcacagtggctcatgcctgtaatcccagcactttgtgaggccaaggtgggtagatcacctgaggtcaggagtttgagaccagcctggccaacatggtgaaaccccgcctctactaaaaatacaaaaattagccaggtgtggtggtgaatgtctgtaatcccagccactcaggaggctgaggcaggagaatcacttgaacctgggaggcagagtttgcagtgagccgagattataccactgcactccagcctgggtgacaaagaaaaaaaaaaagaatatatatatatatgccaagtcataaagtagaccaaaaatataagtagctctaaaaatagtttagataaaaattttattgatgggtagagagtggattttggagaaactgagatttttgtgtatctctaaatatgggggttgatgaagagctcagttattcagccttttacttcttttaacaaggacttattgaggcaactgttacttgcttacattgagctaggcagttggggatatggtgtgaagtagacaattttgttctgtaacattaaatggcaaaacagtatcaagtaaactaaaccaatgataacaaccatataatcaccagttgttctaaatgcaaaataaataaataaataaataaatagggtaataagaatgcagagtaattgggatagtcacttcagggtgcctgcagagaccacaggagagggtgacgtgtgtttgtgatttctgtggtaccacccatcagtggacctgatggaccatggttctgacttctatcctttccccattttatagatggggaagatgagatgcagaagcacagtaactttccatgtgcatgtaggcatctatgtaagtggttaagtgagaattcaaacccaggtggtatgactccagagttagtatttttaaccactgtgctgtactgtcccacaagtaatattagtttaattttagtgaaataaccaagataagtaccaagcagactaaccccaaagtccgctcttaacagctacactaactgcctctcaagaggtcgtagagcttatagactgacacagctggtgtgtttttatcattttttttctgtgaagtaattagtatttattttttctattttatttcgatttcattatttttcaactaattataaaacaccttcaaaagaaaagaaaaacggaagtgaagtctcagtttaggatcaatttgaaatattcttaagactcttttaatatgacatcagttaacttgagcaccttcatctgcctatgcagtccagtattcaggagaatgcagttcgtcttagtccctttgagctgctataacaaaacttcatagactgggtagcttataaacaaaagaattttatttctcacacttctggaggctgggaagtccaagatcagggcactcactggcaaattcagtgtctggttagggcctgttccctggttcatggaatggtgtgtcacatggtggaaaggaacaagggagtgctctggggcctcttgggcaccaatcccattcatgaaggctcttccctgtgacctactcttatgaaggccccaccttctaataccatcacattggttattaggtttcaacatatgaattttagggagacacaaatgttcagaacatagccgagtcatacagtaaatactaagaaaggtatactcacaacatttagaataaatggaaactgaaaaactattaataggccaaatcttaaaagaggatataccaatgctgacatgcgtacccacacatatatttggcatttttgatagaacaggtttgttctggagagtttatacgtaatgaattttgctaaaagttttctgtaacatccctgtgttgtaataggggaagaagcatcacttttctctttttataattagaaaatgcaggcttataaggttatactcagagtgggtcaagctgaatattgggtaatcttgaatcataaaccatccataccctcgtttaaaaattattgtctccatgaataataataggaacaagagtctatatgagcccagcagtgcaaattagcctacaaattaacttggtttggcaaaagtaaagtatgctcttagtcttcttcaaaaatacttattcagacatatgtaaaagaaaattatggtatatatttgtaagtaattgaagtgtttgggagtttttctgtttgtttggtccttgattttttttttggaggggtggcatgtttatgtttttttttgtgtagcttaccatagccagataaattaaatgcattgtaagtcactgaaaaatagaacaaatttaaattgaataaggaatatggttttataggattatagcatagttaataatatcactaacataaagaagaagtgtcaggaaaagaacaataacacaggctatgatgctgaaaggaaccaacatctagaatagcaaaagtgataaaaggaaaataataggaaatgaactgaatttcataaaaggtgtctttctaatgcctttaaatataaaagaaggaagtaggatcgagtacactaaaaagaaaaatagtcatatgatgtaagagtttgtccaccagagcttaacaaaaacagtggagaacagaaaaaaaaatgggctaaatattgaatacaatagcagtttagtaatgatcagaggacagggagatggggggatcatgtctcggcaaaagaaaggtcaaaacaaggcagaaagtacattttgggttaattcaaacaaggtaaagtaatagaagaaaataataccaagtagacattgttttaagataatgaaatgtatagcctaatgttatgcacattgcttagcaacaagcaattaaaaaaaagaatgaaaaaggaactatggaaaagaagagacatgtgtcttgtaaagtggtcagatacaagatgaaaatgagaagagccaagaaagaaaatgaatttagacctcaaagaagtttgagataaatgacccacatttgttattgtctcttaggtcagttttttaaaaaagttagatactgaattataataatcattaaaataactgctcaaagtagagatattgattgctatgtaaaatgtactccatattctttatatataaagctgtgaagatatatttagacattcatataattgaatattttgagaaaatatattttaatacagtatgataaaacaaatctataaaaatgatttaaatgtgatttagaagggcatttggagatgattttcatcttttattttcttgttttggatatggattgttgctttatacatctctaatactttattgtaaatatttaaatagtgggtagcatctgacctgtttgtaaagttcagaagtacctttatataaataatagcttctaaaggccagtagacgcatttaaaaataaacaagtaaattaattcatcccatacctggcagttaaaatagaatgcatttccattatatggctttagatttgactttgtaaaaactaaaagcaatacaaaccccacataccacactaccacaggggtcatctaatgaaaggattattgtctcaaaacattgctcagatcatcttttagtacgtcccacctgcaagctagaatttttctcctagtcatctgtcttttgaaatcatagaatctcaaaccttgttttttcccctatccatttgagaaaatgaccaacgttctgtagcgttggaagaaaggtacagatttaataacacacgtggaagcaattgaacaaaagtggtaataatcaggcttttattattgagttttgggacttacatgtcattacttatgataaagcttcacagtgcttctgccaatcagagttcttactgctcagtgttttgaggttgagagtggtaaattaaagtgtgcagtgcctctcaaaatagttatccaatgtcttaatatatgaaggggtgccttttgagatactctgatttgtatttaggatttacccattgctaaagctgagtgcttttaattaaaacagtagatccaaacaactgccaaaccctttcatggagtaaaataccatattttagtaaatctgagacaccattgattctaggggcaccatcatattatgtaccactaatgacagaaaaagttctgcctgttaaactgtgacacactgctaagataccaacaattgcaagatgctttgcaaatttagaaatttttaaattgtggaaaatggtattagagaagcaaggaaataagatcatgtgcaccttcgccacctcgttctgaattatctttagatttcttatacccagtagtaatcctatccagtgtactttattctgcccttttagaacctcttcttggccccattacctgatttcactgcatgtaaccttgacttcactcaaaaatacttttggttggccgggtgcggtggttcatgcctgtaatcctagcactttgggaggccgaggcgggcagatcacaaagtcaggagttcaagaccagcctgaccaacatgatgaaaccccgtctctactaaaaataccaaaattagccaggtgtggtggcacacacctataatcctagctactcaggaggctgagggaggagaatcgcttgaacccaggaagcagaggtttcagtgagctgagatcacaccactgcactctagcctgggcgacacagccaaactccatctcaaaaaaaaaaaaacttttggtcatctactctgggagtagatagtactctgactatctcagtcaaacatgcctctctgacctatcctagccttacgagaggatgtagacatcaattgtggatagtccgtgggctcattcttgccttgtaagcaggatgtaggcatcagttcatgaagatctggtcctacagccgttgtagagcttcttcattcagtgttggttgggcttctaccaggagcctggcattgtgcaggtgctccaagttacaacactgaacaagacatgtcctgcaggcaaggaccttgcagtctgggagagcagatgcataaacggggattggaattcacttaactttagccatgacaggcagcgctgccaagaggtaaagtttctcttcaactcttccttgatttactttcccccctcttttttcttgtgaccccaactgaacccttcataatatcaaacaaatgtaatctgccttgcattgcacagaagcccatcaagaattctctacaaatggactatctgaacccatgcacatgttgttttgttttttactttttttaaaacacatcttacatatataatcatgtgcacattttgaatagaaatttcccccgtcctaatcagctacccaaatgggagtaggaataactcattgtaatgatgatgtttgaccctgtcttggagatagcatgaccaagaggcccagcaccctctgaccttaggatgtgatctaaatacagcctcatctgtttaacggaaacatctcctcctcctcctctttttctccctcctcctcgaccaccaccaccactgatgctagtaatagaacccattctgggccctgccttctctctagctctaactcagccaagcttctgggaaaagtagtctgcttgttgttttcatttccccacagtctctacttctgaactcagtacagtatggctgtcacttctaccagctccactgaaataattttgctgtgctcaccaacaacctcccagttgccaaatgtaaccttcacccttcagtctttgaacccttttcaacattcaaactaatgacctccttgagatgcccttttccattggcatctgacactgctctcttgggtcgagtctgacctttaacagccaatgcttccactctcccttggtgaatggcactctgcctgcatgccctttccaattttctcttccttaccagtatacttctctgggatatttcactcacaggctccactcccacatggaggactcccagttccattcctttagctcagcttggttttctcagtgtctcacccccatcttcaactcctactgaacgtctttctctgggtatcctcaatgacccctcaaactccacatattctaaatggtttatattacctttaacctgctgatccttctccttttttgtataactttctttggttcatgataccaccatttacccagttacccataactggaacctctaaatcaacctcttttcttgaccacttataaccaactggtcaccaaattctgtctcgtctaccacccatatctgtctccatttttttccacctcaacattcttgacccgtgctatcttagttggctgtaacaaagtacctcacaattgtgtggctatatggtttggctgtgtccccacccaaatctcatcttgaattgtaggttcataattcacatgtgtcatgggagggacccagtgggaggtaatggaatcatgggggtgggtttttccagtgctgttctcatgatagtaagtctcatgagatctgatggtctttataaaagggcagttcccctgcatggcagttcttagttgatggagtaatttgtctgtttaattccgataacgaacaagactgtggcatgctaactagttacgcgaaccccgagcagtcagcatcccccaacttcttagagggacaagtggcattcagccacctgagattgagcaataacaggtctgtgatgcccttagatgtccacggctgcatgtgcactacactgactggtggcgttctgcccccatcccaaagatctgtggaactttgaacttgagagagatgatttagggtatctggtggaagaaatttctaagcagcaaagcattcaagaggtgacttgagtacttttttttttttttgagacagtttcactctgttgcccaggctagagtgcagtggcgcaatcttggctcactgcaagctccgcttcccagatccacgccattctcttgcctcagcctcccgagtagctgggactacaggggcctgccacggcgcccggctaattttttgttagtagaggcggggtttcaccatgttagccaggatagtctcgatctcctgacctcttgatccacccaccttggcctcccaaagtgctgggattacaggtgtgagccaccacgcccagctgacttgagtactcttaaaagcattccactttattcattcacaaagatgtggtttggaattggaacttatatttaaaagggaagcagagcataaaaaaattggaaatctgcagcatgacagtgcaatagaaaagaaaaacccattttctggggagaaattcaagctggttgcagaaatttgcataaataacaaggagccaaatgttaatcaccaagacaacgggaaaaatgttttcagggcacgtcagagacccttatgccagcccctcccatcgcaggcccagaggcctaggaggaaaaaatggttttgtgggctgggcccaggaccttgctgctttgtgcagtctcaggacttggtgccctgcatcccatctgtggctaaaaggggccaatatacagctgaaaccattgcttcagagggtgtaagccccaagcattggaggcttacatgtggtgttggacctgtgggtacacagaagtcaagaactgaggtttgggaacctctgcctagatttcagaggatgtatggaaacacctggatatccaggcagaggtgtgctgcaggggtagagccctcatggagaacctctgctagggcaatgcagaagggaaatgtggggttggagcctccacacagagtccccactgggactagtggagctgtgagaagagggccaccatcctccagaccccagaatgatagaccaactgacagcttggatcgtgtacctggaaaagccacaaacactcaatgccatcctgtgaaagcagccaggaggggagctgtaccctgcaaagccacaggggcagagcttcccaaggctgtagaaacccacctcttacatcagcgtgtcctggatgtgagacctggagtcaaaggagatcattttggagttttaagatttggctgccccactggatttaggagttgcatggggcctgtagcccctttgttttggccaatttctcccatctggaatgagtgtgtttatccaatgcccgtacccccattatatctaggaagtaactaacttgcttttgattttacaggctcctaggctgaagggacttgccttatctcagatgagactttggactgtggacttttgagttaatgatgaaattagttaagactttgggggactgctgggaaggcatgtttggttttgaaatgtgaagacatgagatttgggaggggccagggacagaatgatatggtttggctgtgtccccacccaaatctcatcttgaattgtagctcctataatcccctcatatcatgggagtgagctggtgggaggtaattgaattatgggggtgggtttttcccatattgttcttgtgatagtgaataagcctcacgagatctgatggttttataaacgggagttcccctgcacaagttctcttgcctgccgccacgtaagatgtgccttgctcctccttcaccttccaccatgattacgaggcctccccagccatgtggaactgtgagtcaattaaacctcctttataaagtacccagtctctggtatgtctttatctgtgacatagactaatactaatactaatactagtgtgagaacagactaatacagtggcttaaacaacagcaaaatttattttcttacagttctggaggttagaaatctgagaaagcaacagggttggtcccttctgagctctttctctttggcttgcagatggctaccttctctctgtatcttcacatattcttccctgtgtgtgtgtgtgtgtgtgtcctaatctcttcttataaggatacggtcatattcttccacatgtgtgtgtgtctgtgtgtgtgtgtgtgtgtcctaatctcttctcataaggatacagtcatattggattagggcccacctgcatgacttcacttaaatgtaatcacctctttaacaaccctatctctaattacagtcacattctagggtgctgggaggttaggacttcagcatatgagtttttgggggacacaattcagcccgtactacctgccttcattttcttatgagcttattgctcactctcccactttgtttccatacctccagtatcatctacattctgacgtatcttccatatcaccgtcagagaggttattctgaattcaaatagcagtgcagtactctccctgcttaaagccttgggtcagtggagtatctacccagacccctgcacaaggcactctttcctacttgcactgtgccccacccatgcggaagtatttcagcttccctaaaggcttagacctgcacctctgtgcctttgcgcgtgtggctttctgggtctgaatgttcttaaccctgcctccctttgtcttatcaactgaattgtttaagacccaacgtaggtggccaggaggaaacatggcaaatagcaatagaacaaatggagagaaactgttgaattattatatgagaaggcatcttgttcataagaacacaaaggaaaagaatatggtaatgtaaattaggctgttacagacttttgtcattctgtggagcccctgaaactttcttaaagggatggatgataaaatttacatcttccttttcatcagttacttagtcattagttcagggcccatctctccatatgtaatcactgcctagccttcccaaatcggagccccgtcatagggctgcagtgggatctggagaacccactgtcagcagtctctgttctttaaccctagacacaggaacaatgcagctcttccccaccttttctgaaaaatgagtacaaattgcaagaaatgcagcacagattgtacgatgtcagtacattagcagtgacatgggaaatctgatggagtcagggggaaaaggtgtaaattgcaggataatatcaaggggaggtcagtatgttagtaatgcagggaatatgatggacttaaagaaaaggtataaattactgggtaatagaaaggagaggtcagtacattagtaacatgggaaaactggcagatttgggaggaaaaggtgcaaattataggataatgcaaagtaggggcatcactgtaaagatgcttcatttcctgtttataaggaggagttggggagggacttgcagtggattcacagataattgcctagaaagtgcccgggttggttgctacctctcctccaggcaggaagacttcctcaccaatgaggtggtcagccccaggtccacccattgaaacaactgtacagagattcatcctgggttggcagaaggctctaccctctttcagataatagttatatagacagatgcctatattgagtgagaatgtagggaaatttatgatttccataggcagaaaccagagaatcattagaagtttgttttgggagatggatggtagggcatgtaatacttgttagggaagcatggtgagagctgagccatctcagtccagtccctcctgcactcttgtctgccaacttcagacccacatggagttaaaggtctcaaagattttcacaggatttaatcaaactaaaaaatccacatttcaagacccatatttggaagaaaaatattttgaaaagcaagagaatgagaaatgaaaagttcaggaaagtgattacttaagaagatgtggcacagggctcatatcaagaaggaacacagcgggagctatgttttgtttttgtttttgtttttgttttgagacaaaatctcactctgttgaccatgctgcagtgcaggggcacgatcttggctcactgcaacctccacttcccgggttcaagcggttctcctgcctcagcctccccagtagctagactacaggcgcccaccaccatgcctggctaattttttttttttttttttttttttagtagagatgaggtgtcaccatattggccaggctggtcttgaactcctaaccttgtgatccacctacctcagccttccaaagtgctgggattacaggcatgagccaccgcttccagccagctatggtaatcttgttagttttctagttctgacattgggggtgagttcacaagttttggttttattatgcttcatcatatacctattagtcacatatgttcttttgtatgtattaactattacataatacatttttgggatcagcttagggacatttataactggaattattgaattgctatgagtcatataacatctgttggattcttatatggctttagtagagtggagggtagtgtcttcccgtaaaagccctgtaatatcaaacaagaatgtctgacaggaaaatggtctatctccccaccttcctgggagaaatactggagatgttcaaggttttacctttcttagatagtagatagatcatgaaattattgcagactaagtgctctggtattttcctaatctaagattattttaaaattattttagcttaatgtctaattctagatacagttaattttcatcagttctgaaaacagatgctaaacacctatgtttataatgctgagggggcattacctgggaatttgagacatttgggaagatcttctatgtactctaccaacctcactgttcttgaggaatgaagaagccatcatatttccttttgtaattctgtcttccatctggtcaggagaaagaaggattcttcaagcctttctcaggtggcaaaactctaaggagaatcctgtgctttttgtgtcccctgtgaatgactgcagctccttgctgacagcttagcccaaaacaaggcctctggggactcaccagcccttatcacacttgcgaagagagcttgatgtgtggtctagttgttgttgggagttaggacactagattctttgtgaggtctcttaggatgttgttgtcataaataatactctctgaaggtttttaccacctactgtagaccaaatgctttctgtgctttgctttatttactcttcacagcaacccaaggtagctgttgtcaccatccccatcttgtgctgaggaagcagggcctagaaagaggcgaagtcactttttgtggcctcttaggcagagtgcacactcggtcctgtggattctatagctcatgcttctaacagtggcaggtctttgtcatttaatcctttaattctggtaacattacaggagtgtatagaattttttttaacctcatagaagtgagaatgtcttacagttgtgatcagacattatgtaataaggacaagtgggtcaagctctgtgacctccaggcaggagcccccaatacattagagattgctgagatttgactatcccttttaaagtgaattccatgctactacttttcagcaaaactatatcactgataccaagatggttaatattttctaataagtgggatttaacatttttaaagtgtgaggaggagggaccaagtacattagagatatttttatttttgtttttcttttttgagacagggtctcactgtcacccaggctggactgcagtgttgtgaacatgcatcactgcagcctcgagctccttggctcaagtgatcttcctgcttcagccttccaagtagctgggaacacagatgtgtaccaacacatctggctaatttaattttttttttgtagagttgaggtctcactatgttacccaggctggtctcaaactcctaggctcaagtgatcctcctcagcctcccaaagtgctggaattacagacgtgagctatatttctttaacatactaggatgagacctagtgtgcacacatttgtttctgtaagaaagcaggtttgcatagtattttggtgtctgttatgctcacgaaggatatgtcattttccttctgatttataattggtacctatgagggaagtcacagcacttaatgtgaaatgggcttcaaaggtaaaatatgaagtgtctttatccttagtttgctgatttgtctttatttggctacagaaaatgtaaatacattaatctggcatacagagcacgtaaaacaaggaaatgcagtgtaaaagtagccagaactggcctcctccaggtacagaaggctggccacatccctgaagacaggtactcactgggtgctgcagagaccttggacccccagttgtaatctttttaggagagctttttatagtttttctgcttaattctacggagtattttatcttggtgtattcttgtaaatgccttaatttgatggaatttcatacaaaattgacatatctttccttttaatgggaatgttttgtatctttataaactctttctgaggaccacatagtcctgtacgtaatagtggtttaaatatacataatttgaagtgcaaaccactccaacttacaaaccatatcatagcaagagaaacctttattttagcttagtcctactggtcttgccagtctctcttgagggaccatattcacttgacttgatgatgagattgcacactgttaatctatcagttaaacaggtgtttattgcatgcctattgtgggcttagttcagggttttcccctgtgcaagagacaaaggaagtacagcccccaattaagaatggattggtttccaaatgattgggaagctgaatctggaacctggaatgtggcgcccaacaatgtaatgaatggcgcttaattttccaggttcgcccatgaggcatcgttaatcgctagtgtggttcatccatatcttgatgtctaaggcttctgttagggttgagatacaaaagaaaagcggggggaactttcttctgcctttctgggtgctaagctcaccccttcttcagtgccctcctgccacaggggttcccagtgtcctccacagtcgccagctgcctcctccctgtttccccaacccagcaaaactctcatttcctcggcgtagcagatctcagttagatgttagtacagaagtattttgatttaactaattcatactaacatgtgcataactgataacttccttaatcttcccagaggcatttgcattattaaaacaaaatacttattaaatgcatattaagtcaagcaagggtagattatttagcacgtaggataaagtgaaataaaagattaagaccatgcaagggcagttgcgttggggctgcaggatcaccctggaggcagagcagccgtaagaggagcttgttccctggggctggctctccaaagcccaccctacttctcatcacctctttccttatactgtttctaaatttctggattctggaaaaggccacacattaacatgatgttggcaccagcagaagctccattggttgaggtgaggtttggggaggaccagggattggctgaggtcatccgtgactgatttttaggtttgagttgccaatacgccagatagtaataaatgtagggactgcctatataaggcagggtcgctgactaaaaaacaagacaaaggtatagcaccagtagtgaccagaaatcatggaatcattcagcagttcaggtcctatttgctgatggtgaggcaggagacctggttcctggcttcatactcagtttataatctagtcaggtaaatagactttatgtaaataattacactaaaaacaagatcaggccaggcgcagtggctcacgcctgtaatcccagcactttgggagaccaagacagatcacttgaggtcaggagttggagaccagcctggccaatacggtgaaaccctgtctccactaaaaatacaaaaattagctgggtttggtggcaggcacctgtaatccccgctactcaggagactgaggttggagtgggccaagattgtgccactgcactccagcctgggcaacagagtgagactctcaaaaaaataaaaataaaaaaaagataaataaaacatttttaaaaatgagatcattacacatttctctacctgctgtcatagaaaaccaaagaacatcatgaatgattatagcccggggcctgattgagctggagtgggggtggcttctctgagggagacatgtttcagcctagacaaggagatcaaggctgggtcagccaagtgacgagggtgtgggcccagggcttaggagagcattttaggcaagacgcatggtgtgcaagaccatggggaggaaacactcttggtgcctttgagaagtggctggtgaatcttgaagagggagaacctgcaggtgctggagggggcccttggagaggccaggaggcagctttgtcccacaggcctcgtgggccacgttttgaggatagaacctgaaaggcatggggtctgacattaggaattttaagcaggggagcaacagcttctactgtgtggccctggccatgcgtttaattggggcttaaagaagggaatctactattggtgagggcaattcagatctgaagggaacagaaggggctcttgccatacggtgtcatttaggggtgcccagaagggcccctgcccaaaaatgtctttccaaccatccctgacggtgtctaaaatcctatcattgaacttcatctcctttaaaacacaagtcctctgacagtcaagcaggatcagacaaaattgcaggatatttaaaaattttgtcaggccaggcacggtgactcatgcctgtaatcccggcactttggaaggctgaggtgggcggatcacttgagctcaggagttttagaccagcctgggcaacatggcaaaaccctatctcaggccaggcattgtggctcacacctgtaatcccaacactttgggaggctgagacaggcagatcacttgaggtcaagagttcgagaccagcctggccaacatggtgaaaccccatctctagtttaaaaaaatacaaaattagccgagcatggtggtgggcgcctgtaatcccaccaacttgggagtctgaagcaggagaatcccatgaacctgggaggtggaggccacagtgtgctgagatcgcgccactgcactccaggctgggcgacagagtgagactccatctcaaaaaaaataaacacaagccagacatggtggcatgcgcctgtagttccagctactctggaggccgaggtgggaagatcacttgagcccaggaggttgacgctgcagtgagccgtgattgtttcactgcactccagcctgggcattggacccaatctcaaaaataaaaataaattttttttagacctccagccatccttttcaaataaagtatctctctctctctctccccgcatagcatcccttccctcttcagacgcccaggactcatatgtcagtctctaaatcaacacctgatttcaagagaggctctgtcggatatgacttatatgaactttatgatgcaattttgaatcagtctgttgccttttcccaggttataatgtatggctgattgtaactccagctgctttaggtgataaaaggaattcgttgactctcacaacagaaccatgcagaagtgggactgcctctggtgcaatttgatctggcccctggccgcaggtctctgatgttctttcagccttgcccttgccccgtgtcagtggtgatcttggactgactcccaccaaggatgcagcactgactgcagcggctcccggcctcacacccgtaacctcaccaacctgagctgaaagtgctgctctactcaggacggtcacaagcccttggcttctctctaaggttgtgggacacccctgagccaattattaggtccaggagtatctaataatctgagaactagtcactgagggcatcctgctgattggtggagtataatctctggagctgtgggtggatccttctctcccaaatcacagggaccctggagaccaagaatgggcacaaggttgagtcagctctagggaagcaccaaacaacactgacgcatagggatatttgtattttaagtatttagtctgttaatttaatattaaagaaatgtggctggacatagtggctcacgcctgtaatcccagcactttgggaggccaaggcaggcagatcacttgaggccaggagttcgagaccagcctgggcagcatgaaaaaaccctgtctctacaaaaaaacaaaaaacaaaacaaaaattatctgggcatgttgacgtgcacctgtagtcccagctactatttgggaggctgaggtggaaggatcagttgagcccaggaggtcaaggctgcagtgagccatgattgcaccactgtactccagcctgtgtaacagagtgagaccccatctgaaaaaaaaaggaaggaaacaaaaggaaaaaggaaagaaaagggaaaaagagaaagaaacatgggcatcagcaaacagatgggagaggaattgtttttagggtagaccgtcaggccatccaacagttcctgaaacttgtgcttcctgtactagccttgcccatgacactcattcatataatcactaatttgttagtatggctcagttatgcaattatttttgcctctgacatactcctgtgttaaagggagtgcatttgagcttggatccaggacatttaaaattggctaagtatgtgggtgttggggatggaattccataaacatgtagatcctgtttgtttaggaccattatgcattatttagaactagttatttaaaaattaagtagtgttcctcattggttatattagaataattttataaataagcttgagagaagtggaagaagatgcaaataagggttattggttaaagaaaagtttgatgatcttttgtttgctatcttatctaagtttaaagagtttttaaaattcagaatacatgaattttcagttttaaaaatactgggattttttttagtttttacttgactagttagtacaggctgtattgaattcttcagaaatacttcaaaatcaggcaaaatgtgtagcattgccaatttttcatcctaggtcctttttttctcaaccaactgtattcattaatattcacagatatatgaacataaaatgagcatatgctcaacaaacatttatcatgtgcagggtgcatccccattgctggggatacggagaagtagaagacacacttcctttcctcagggaacagcatatgatctctttgggaagaaaagcaaataacatggaaaataaaaagtagcagttcattcactacctagtgccagcaggcaaaccaacaatgagtttagaaaagggggagcagttgctggggtgagaggagaaagcctgcagaggatgggagaggctcagatgttggcaaggaaagggagaacatcccaggtggtcaaacaagtttgcttttgcagttgaatttcattctatttttcttaaaattatggagtatgctgcttaattccaagattttctttattgtgtaatatttcctgtagaattgttaggagttggtcatatagatcacttctgaatctgactatcatcaagttggcagagttcttagctggctttctttaacattgagttgttggattattcttagtttaataaatttaggattaaacctaaaattttccatttcatattatttcttcccttttagttatttcctgtcctttactcttcattttttttttctactaagtctgtgaactcccctaggtggctgtgaattccttttagacagagatcatcaactccctggagctttggatagtgcttggcacatagaagatgcacattaaatgcttagtaaatgtatggaaacatttcacatatgagtagaaagaaataatgcagaggaaattagatgtaagtacatatgtataattgtaattttacttatgattttgaacaatctatcttcttatagcagcttcctgctagttttacctaactcagagctaactttgtcttaccttctccaggaggtaagatttagaaacctactaaagtgctctcagacatcagttattttgtaagtcagagttgttatctatgatacattaacatgtttgatgatgtgaatgctcaaattttacaagatcttttgttcctcttctgcataattcagttcttttaagaacaacttatgtgttgtagttccatgtgtgtatttcagactagtcaacacaactaaaatctgatcatgattactagcttttcaaagtcatccttcatttcccaccaggtagctttctgtcagaattcatttcccatttggaaaatatgtctctgacccacagttttctggacacaattcatccttcacatgtgtgagactgcccattgtcatcaatcctcagctcctcaggtgccaaaaatcccctctatattcagagtgataaaatatatcaaaagtgttacaggaaagaaaactaacaaaaatgtttaaaagatttttgtcccagtggtttttctaataaaaaaaaatgcttttagtatctgtttctattattactgtttaagaaattaaaataataactgttacagttgaaacaggatgtgctttctattttctttccatctttatataattaaaagtgaactttggcagagctgcaatataattcaattcaatttagcaaacatttgtggagacccttctgctggtcccgcaataccatggtttctataagagctggcttttagttgcagcaagtgcaagagagtgtgatccagatgtgactgctaaggaaactaaaattcactgtggaaggagattaggtaaggaaagattcatccaagaaggaatttcatgtttaattttggacaaagaattaaatttggtttgtgtctctgtcaattttttgttgctataactgaatacctgagacttggcaatgtataaagaaaagaaatttatttctcacagttctagaggctgggaagtccaagaacatggtaccagcatctggagaggaccatcttgctgcatcataacatggcagaaggcatcacatggagagatgacaagagcatgtatgtcagctcaggtctctcttcctctttttataaagccaatagtcctctcatgagggccccatcctgatggtcttatgtaatcccaattacctccaaaagaccacattcctaatcagtttataaatttggggattaagtttccaacacatgaaatttgggggacacatttaaaccatagcaacttgcaaaggggaatgacattgcaggtaagggccactgggattgggttcagcagggcatgtactaattcttgggcaaggaagggacatgatgagaaaggtcttcatctgtttgcaggctgcagcagataccagagaactaagtaactgaccgaggcttaagtgatgaggtcttgtttctagggtaaaggaggtagacatgtgaaggctaagtcaaatcttagaaagggaaggtcaaatcttaacacagaatcaggtagcctcagtagcttattggatattgggaagcaatgtgaagagaattgtcaaggttagttccaaggatggagagcctaggtgagtagggaatcatggtgtcatattagtataaatggatggtgagaaagagaagtgtaataggcagaggctttagaggatgtcagtggataggaggaaagccagaaaaggaatgtcagaggagaaccgggaacttacagtttcatggaagcaaagagaagacagtgtttcaagatgacaagaagaacagaaaagtcaagaaataagaggtctgagtttggttttgtttaggagaaggacaaaatgttgacctttgagtaacttcagaaaagtagtggaagtgggtaccagatggcaaaggccctgaaaatggagaagaatttgtgttactggggagactgtaaaacaagatccttcagtcacttcaagtaataaaccccttggaaggaaatttactccttaactgactagcattatgttacaaaatgccagtatattattaatacctggagatttaaaatgtacctgttttcacactgtaacccagaaacattatttttacaaaccatttggaaataatagtttgatattctttgattccactctttcagaatttcacttatccctctccaagatttatttctgggtcattgattcagattccaaaactaatgttttctataagcttattttatgcctagtagagtttaaattcaaacattttctaacagtagcaactgaaatatcttcaaagacatttttcacatctaccttactttttcttggttgattatatctttttgaaaacaccccagattgacagcatgtgaggtagtatgcctatagtaacaacacaagctttttagaatggttgagaaatgtactttggccttgttctggttcctgaagacatttgtttgtttgtttgtttgtttgttttgagatggagttttcactcttgtcgcccaggctggagtgcaatggtgcgatctcggctcactgcaacctccgcctcctgggttcaagcgattctcctgcctcagtctcccgagtaacagggatgatgggtgcccgccaccacacccagctagtttttgtgtttttagtagagacagagttttaccatgttggccaggctggtctcaaactcctgatctcaggtgatccacctgcctcggcctcccaaaatgctgggattacaggcatgagccactgcacctggccctgaagatatcttttagtcctaaaaggagccaataaaggaaaaagcacgttagaaccagagtcataggacctaggttctgttccctcctttggggcttgactgtgaggagatcaacatctagagttcctcagcaatgaagtgagaagacggtatcagagggccaatttggtctcattcaaataaaaaagctcagaatgcatggctatactatatattctgtcttccactaatcaagcctactgcatggtatgactccacatttgcagacgtgatcagagtgttcctcatgccccctcctctgcctgtttcctctgtctatgatggaacagccttacttctcccttcatgtgcccaactctcttaccctcctaacctcaggctacctgtttttttggcatacagtggcatccctggcacctagcacctctggtacagctcaggtgctccataaatatttgatgacagagtaaatggactgtgttgtattattgtccaccctggtggttctccacactgactaaacatcagaaacagagatctccaggtcctactcccctgcctttggcatttgagtttgtaggaacaggcctatacattcctactgtaaaattccgccacaggtcatgctcatgtgagaaacacaagtctctcctccgtgagttccttgaggaggcagactatggtttctgccatttcattcccattctgattctggcagaaattagatatacaagaaatatttgtgaataagagaatttaactctagagaaaagtaataaataataaatgagaggaaaatgccctttcttctgtttgcagatctaaaaccttggacctttaaagactaattcacattacccataccaagttatagttttaaataagtgaaattatgtaagtgcccaaaccaccagatctgataaaattcagagctcattgttatctaataattttggctaggactactctgctttatttgcctgatttttacaatttcgtgataagatatttgctttcattattactgccttaccataggccttattttaaattgtttcttaataagtgacaatccaccactcttttgagtcatataattctagtattttaaactacagtttctttctttggggtgagggatgtgacgtgctgaataaaggagaactagtgtgaacttcggtgttgccacaccacccactcttatgtatatcgtatttctatgctccagagaaagcaattaagataattgttttttaactaagaaaactatgccatcctgaatacaaaaacctcatcattggccaggcacagtggctcaagtgggaggccaaagcaggcagatcgcttgagcccagaagttggagaccagcctgggcaacatagggagaccctgcctctacaaaaaaaaaaaaaaaaaaaaaaaattagctgggtgtggtgatgcacacctgtggtcccagctgcctgggaggctgaggtgggaggattacctgagcccaggaggttgagactgcagtgagccatgatcacgccactgcactcaactctgggcgacagagtgagaccttgtctaaaaacaaaacaaacccttcatcatttatagcctattagcctgttgacctgcattttagttatctgtggctgagtaacaaatttccctgacactcagctgattaaaacaataaacatttagtatctctccagtatctgtgggtcaggaatctgggagtggctttgctgggtcgtcctagttcatgtcctctcacgaagttacagtcaaggtattggtcatctgaaggcttccgaggtggctcactcagatgcctgcaagttagtgcctgtctgcaggaggcctcagtttcttaccacatggccctgtcatcagggcagcttgagtgtcttcaccacatggcaagagagccaggagagggagagcctagaggtagccccattgcccacgtttaggggaaaggctgtcaggctctactcttgaagggaggaacatcaaagcatttgtggacatagtttaaaactgccacagcctgtaccattagattctgtttgctaccttagatgctttgtccagggtctgaaagcatctgtgatccaagttatttatgtagtttcttctccatgagtagaagctggatatcagaatttctggtttctactttattatttctagggcctactttctttttattctcttgtataagataatgagatacagtagtaaaaaaatcatgaagtattagaataaaaagatatcattttctctgcacaccagactacaaacttttcctgtctagaccataattcagaacttattgtttctgagaagccttcttattgaaggtggaaagaaatttaagaaagctgcccagtttctagatgaactggtgagggccaattccacagcattcacctaggattagaggagcaagtgccagatatgacagagcttcagagaaggcatcttacagttactcaggagcttctccaaaaatggaaccaatgaccatccagcattttattggtgatttttttataggaactttcagaaaaaaaagaaagaccaggtcagtaacagctatagggtgttaaaaaaaatcaacccaaaggcatttataaagtgagccaggcatcgggaaccgtgtttttacataattacctcatttcaagtaagttttctttcaattcttcatcctccaaccagtctttccgtcttcgtgcgtcatgattatagcactttttggtctgtatctgtttgccacttgactgggagtgcccaaagggcagagctgtgaaatgcgtctttgaatccagatgagcaaggcaatgcctggcccttagttgatttttattatttgtggttgagtttaacaagcctataagtaaataccattatcttctttttctctgtaagaaagataacactcagaggattggaaaacttgagtgcagcccatagttagtaagtggcagagtttgagcttcaaagccaggtctatattttctgcttcagttcacatgcacccaggagaactctaggagggaactgtgttgggagccccaagtagtatccttgtagttctcagctaggagaaattacttaggaggcatttctgtctttgcccagaatgaatcactgtagtttaagagactgccaaaaggaaacagtctgttgattggataaaagggtcttgaaaataagctggcttttgcaaaccatatatctgataaaggttaatatctaaaattgataaaggactcatacaactcaatagtagaaaaacagatagcccaatttaaaaatgggcaaaggtcctaaatagacatttctccaaagaagacataaaaatgaccaacaggtacatgaaaaggtgcccagtattattaatcatcagggaaatgcaaatcaaaatcactgtgagatgctacttcatagctgttaggatggctattatcaaaaagttaaaagataaccaatattggcaaaggtgtagaggagggaactcttatataccgttgggaatgtacattggtacagccattatggaaatcagtatggagatttctaaagaaattcaaaatacggcatggtgactcatgcctgtaatcccagcactatgggaggccaaggtgggcggattgcttgagctcaggagttcgagaccagcctgagcaacatggtgaaactctgtctctacaaaaaaatacaaaaattaggcaggtgtggtggcacgcgcctgtagtcccagttatttgggggactaagccaggataatcacccaaacctgggaggcagagggtacagtgagccaagattgcaccactgcactccagcattgatgacaaagcaagatcttgtctcaaaaaaaaaaaaaagagagagagagagaaattaaaaatagaactaccatatgactcaggaattccttttctgggaatatacccaaaggaaataaaattcaccactttgtaaagatatctgccgataattgcagcattattcacaatagccaagatatagaaacaacctaagagttcattgctggacaaatggataaagaaactgtggtgtatatatacgatggagtattattcagccttaaaagtgatcctgacagttgtcaccacatggatgaacctggtgggctttataccaggtgacataaaccacatacagaaagccaaatattgcatgatttcacttatatgtggaatctaaaaaacaaaaacccagtcaaatatacagagagaataaaacagtggttaccagggctgtgggggcatgccaggaaatggggagatacaggtcagaggatacaaagtagcagatgtgtaggaagaacaagcctagaggcctaaggtacaacatgagcactacaggtaataaaattgtgctgcatttgggattcatgtgaaatgagtagattttagctatttttgccacaaaaacaaaaaaatgggtaactgtgcaatagttagttgggatatgttaatttgctttgctatagtaaccattttcctatcggtatgtatcccatatcatcatgttgtatatgttaaatatacacaatacaatgtattcatttattgtttgagatggagtgtcactctgttgcccaggctggagtacagaggcacgatcatggctcactgcagcctcaacttcccagactcaagcaatcctcccacctcagcctcccgagtaggtgggactacaggtgcacaccaccctgcccagctaatttttgtattttttgtagagatggggtttcgccacgttgcccaggctggtcttgaagttctgggctcaagtgattctcctgcctctgcctcccaaagtgctgggattacaggcatgccaccacacctggcctaacatttattaaaaaaaaaaaaaagaagctgtcctattcaggctacaaaagaacttttggtattacctgatgttcttcattctgtaagtgggacactgaaatttcctcatgcctaaaatgctaagtaagggaaagtcctcttttttctttcccatttttccagggattctgacctgggtgatgcaagaattgaacatcgtatttagataggaagttggagctcagtaaatgaggagattgtgtatcaaacccccgaccaagctactgagacttcctgatcactcttaagaggccccaatgcaagagtctaggccctaagctaaagtagtggtggaagagcaggtgcattcaaatatttcatgtctaaatctacaggatcgtggtgacaggatgcacggtggatggacatggagaagttgaggagacctgggagcctgagtgaatggtagctccattcagtatggcaggggacaggggaggaggagcaggtgtggggttcactatgggggcaatttgggctgtgtattcaagtatttaaggcgtcttttggacaattagggaagatattttatcaagaaatgtgcattgaggttagatggctccgtgaaagagcaactgtctggggacatctgggagacagctggatcgtaggcatgtatctgatgatgtccagttcatggattgccggtactgaagagagccaactgctgcagaggactttcttggctgtgtgcggctttgttgggaatctctgctgctgtctttatagcttagtatcctgaatgaggaggggagcaatgggcagcctcttgctagtggatgtggagaggagctaccacattgccctgtatgtaggatgcgggcacctctctctgcccagctctcctatgggtcattacatggagcttgcttttactcattaggatttggcaatcttaaatgcctctttaaaaaaaatgtgtttgtatctgctttgagatgtcattttttttttttttgagagacaaccgcaaattcatgcttatcttctcgggggaaatacctctactaaaaccatagtttggctttttccatatgggtgttgaaacagatggttgtaatgagacctctctaattaagcacttgctatctgactctgaatcattttagatgtgctggcactcttgctctctctctttttgattcaaagagttgtcctgagatgtaacacatttagctgttattatagtctataaactttccattttttcatttgtagcttattctcttttttgtgctaatctgagagcataattaagatgtctgacttcagttctttccttacaaatattgcctaactcttctgtctttaattatccaaaatcattcctatgtaaacaaataacaattgcagattgtactacctacattcttttgttgtgaggatgtaagtacacccttgtttgttaaattacagtcttttaaagaaattggatgtgacatattttgtcattttgtatgatgccatagaaaacaaaggatcacttctgcatttttattcttggtatcccttttatttaatattcattttaagagccagtgtggcaggtgaagtgaggacaggctttggagtcacactgccttgaaaatctcagcctcaccacttcctagtggtgtgactttgggtaagttgcttaggtgcctctctgtgcctaggcttcttggtgcatgaaatgagaatgatggtaatattcacctcacaggattatgggcattcagtgacataatgcaagttacatgcatagcacaatgcctggcacatagtaggtactcaataaatgctaacaatatatatttttatatagtagaggaagctttcttaaccaattcatcagattaaaggaagcttccagaccctttgccgagcagtccagtgaatgcccacgacgtggtgaactgtaactggcttctctctagtatgctcaggcacttctactccaattagctgactttatttgctgccaaacctgtttatgttatttgttgcttgtgtttgttcccaagcctatttgtgccagttgaacttgttattgtaattatgtaatttaattaaatatcaggcaaacagatggaatgtaaaagtataaaaagacagcagctttttcctgaaaatgaactttgaaggctatggaaagacttaacaaaatattactcattaaggtacctgtagatttgtagagactgaaaggagaatggtggttgccaggggctggagagaaggtaggaatgtcgagttggggttcaatgggtacagagtttccattttccaagatgaggagagttctggatggggacaggggacaggagatgggtgggttgcacgatggttgcacagcaatgtgactggacttaaaaatggctaaggtggtaaatgttatattatgtatattttaatacagttaaagcttttaaaaatatgtcacattagctgtggataaaatagctgttaaagattgaggtgtgcgaggaataaaacatctagaaagagtccacatcgagattgtttcccagtggtcgttaagttttcataatttcaggaaaccaagataggaaacttattttaagtttaaaatgaaacatttaagttgtgtacgtgtcttgggctaggctcctggggaacagactcacagatggagattgaggccattggaacttgtcctcctgtgttgatcagaccttggatgtgggctgctccccaggggaggggcataacctcgaacaaggcgaacttctttggctgagcgtgagtctcaggaggttcttagctgagaacaatcagcaggtaacactccagcagctgggggatctgagtggtacactacagcatccacaacagtgtgtctccattttgtgtgtggttttccctttataacagacttttaaagattaactgattaacttctggtccagattgcttcaaataagagtatcttcactgcttatgcataatcttctgaaggtctcattgtatttgatcttctttgcatatgacagttgtcccatctatgatacaacaagactgcgttctcctgaatcctgtaaacttaatcacagcaaataaacgtgtgatgtgttggaagcacaactgatgttagggcctctgtccactcctaagtattttccagtatttattttgagattcatggaaccaacttcaggttttctttttaaatttccaaagactcttttggcattcgatggtatcctttggcaaactctccacttttgtactagagatcatcttcctttcgtgccctatgacctgtaggtctctctctgcatgttctttggtgactcttccgtctgctgcaaataactgccatccctcttccttttactttagccttttgccttagacccgcgtctctttatgatgatcccaaagctcctgacttgaatgatggccaatctccaggacgtctaaatttcattttggaatatagtcttccaattcttaaaacaggagccctgtttatatggttgttttgtttattgttagatccaaatttgcttttcgtttctctcagcttgctttgccccaaattgtcaatgctaaagtggaagtctgaatccctttgccagtgtgaccataaatatagcacaaagatcctatgattaccctatagtgtctgttttccttgagcattttagcatgtgctgaccttttagcaggaatactattcagcctcatttatgcttagcccttcatttagccaagttttgttttttccttggtttcaaattttctctctttttgtgaactgggagctgaagcccttcatttgacttgtgatcttatacattctggaagctcatacatgtaatcgtggaacaaataaagcagctggaggaaatcttttctgaacaaaacccaagtggggcatttgggtgcaagccaagatttcagcagctacagagggagatgtacaaaggctgcctatattacaaagccaataaatcacttctggccaaataggaatgtcctataggtaatggctggatagagggtaagggacctttacacatttaattacctgactacaaaataaagtgtttactgtaaccttccaagggctctctagtaagttaattcctataatataactaaaggtagatgaacactgttggctcagtggatgagcaacaaattggaattctgagtctgttcagcctgggcctaggcttcccactaaattgatgtgtggtcctaggcaagatactgagtgtttaacttcctagggctcagtttctccttccaaaattaggaattataatacagatttagcttactaaatcccaagaagccactaaccaactaactaataataaatgaggccatgtagcgtgaaatcctctattaacttcctcttttccctttttagaggtgaaagttaaatgtcctacagtgatcaaataattaagtaaaatttcactggacattttgacaagattggttattgattcatcaattcatacacacacacatacatacatatctggacttacacatacaaaagcaagggcttagaatggaggtaggtttaaaacaaatgtaaaggagtttcccaagtttttaatcatctattagttcatccaggcaatgttaacaattatgcagagcagcacctctcaaactttatgtgcataagaatcacctggaaggcctttaaaatgtccctcctgggctccatcctcagagtttctgatttggtagatattgtggtagggcctaaaattagcatctaacaagctcccatatgatattactggtgtgcagaccacactgtgggtcgcacagtctagaaacattcggaatgccaaggtaaggaagacacatggtgtctgtaaggcaggtaggattaatattaatactccatggtgtgctaatattaattatactgtatcacagtgtgtgtgtgtgcacaggaccatgtgttctaaaatcatttcagagaacatagtatgtgcagaggcttagagaattgaaactacatgacacattcaggaatgtgaagtttgcatcactgcagcagagagcatgtggctggccgggaggcagggggtagtctagtaggggtggggaggagaggaacatgtggcagaagagatgccaagatctaggtagagctctgatggtaattagggggcttgtgtactccaagagattggattgctttcctaacctgagaacaagagaaatggaacagagaaaataaaagattcactagagttctcaaggtggtagaattaatgatagcgtagaatttatctaaatataatctagttaacccattaatcctgctgaaattacacttcagttgaaagtcaatctcttgggtatctggtttcttcatttctggtcatttttgtgcaccatatgatgacttacgtgttcttaaatatgacctgttttccattattttctaggttctttttctatccagtgaatagtcagccagtaatccttgtcccaaattgattataataatgaacaggtggaataccaagatattagcaataagagtatcttaccaaaaaaaaaaaaaaaacagatttccttgttacaaaagcaatgcatacttattacggaagctacagacaagcaaagaaacctcccacaatcccactcacatttagaaaaccactgcaaaaccccctagacactaactttttagattcttttccatgtagatgtgcattcttccctaccaaaatagattacaccatctacgttttgaaaaccagcacagttcatttacataatctgccaattgttggacatttgtactcttccaatctaattcccattgtttcacatttagtctgttccaagtaatttcccatggctgatgcctaaactgaaagtgaagggacaggagtcagccaggcaaagatggtggagtggagggatagacattctaggttgaagtactgcctgggcacagacctagaggtgaagcaaccataacatttgtgagaaccgaaggatgtacagtaaagctggaccatggagggtgaagggtaatgggagtggacgttcacaagattaaaacattggaactaatagcctacagttggatatccaggggactaattggccaaaatttatttagggaaaaagtagagggaataaaagacaaaaagagaaaaaatctgcagcttatcactgaacgttattccttttcaaccagaatgctttattttcatttttatttatttattttttcttgagacagagtctcgctgtgtcacccaggctggagtgcaatggtgccatctcgactcatagcaacccccaccttccgcgttcaagtgatcctcctgcatcagcctcctgagtagttaggactacaggtgcttgccaccacgcctggataatttttgtaattttagtagaaacagggtttcaccatgttggccaggctggtctcaaactcctgacctcaagtgatccacctgccttggcctcccaaagtgctgggattacaggcatgagccactgtgcccggactcaaccagattgttttaacacagtgttgctttcaccaacttgattcggactaagttggttttggcaaatggctttcaaccaaatgatctatacccaaattaagaggatttgggggcttactggatccagtgccgtgctggagctgacttatgcaggctctcaagacatttctgcccatcttttcagtaatgtcaccttcatagcttgaaatcagcaaatgctacaaatcagggattttttttcattcaagccagttctgcagcacaccactagatgtagctgagtgagagggaagaaatccaaaataaatgtcctgggttttggcttgggaattgaacactgaagtcatatatcggtaccaaacatcataaactttggagtcagaggaccaagatttgaatcctaactgccatttttctgccatttcaagcagagtaattctctaagcctcagtttccttatatgtgaaatggggtcactaatatttaacttacaggataatgatataaattaatccttgagagagctattatgattattactgcaataaaaggagaagcatgagggcattcagttgatattttaatatgtaaagtttgagttactttggggagcttaggtagagaatcctgtaataacaacaatagctaatattattgattgttaactacgtgctttacatacattattttgtttaatcttccaaagaactgtataggtaggtattagtgatatgattgctctcattctgaacctgagaagactgagttttaagttaagtatctttctcaaggccagacagctggtaaatgcagagacaatttggaaggcaagtctgtctgaattcagagtctgcattcttttttttctttctttctttctttcttttttttttttttttttgtgagacagagtttctctcttgtttcccaggctggagtgtaatggtgcaatctcagcccactgcaacctccacctcccaggttcaagcgattctcctgtctcagcctcctgagtagctggaattacaggcatgtgccaccatgcctggctaattttgtatttttagtagagatggggtttccccatgttggtcaggctggtcttaaactcctgacctcaggtgatccgcccgcctctgcctcccaaagtgctgggattacaggcatgacccaccgcacccagtctagagtctgcattcttaatcagtgtgcatatgggcctccactcagcagagacatctgagctacatggtgtcagtttgtgaatgttctcagtggttcaagtcttaggtttgaatgaggtactggaggaatctatagaatcagaaaagcagaaggcaaggatgcaactctgggcaacactgaatttgaaggtgaggtaagaatttagagaaagaggggatgattagcagttttggatgccatcaggagatcaaaaagggtaagaatttaaaaaggttatttggatttggcaatatgaaaaggattggtaattttaacaaaagcagcttgggcaagataaggaaggcaaaggccagattgctttgggttgagaagtaaattggtaatgatgaagtggagaaaactggtataaattccttttgaagaatgaggtgctaaataagctatttggaatccagggagatatttaagacatagatgtatcgggcagaaatagtagaagtgaaggaatgtgattgaagaaagcaagacccttccttaggagataggagagatgggatccaaagcctggtagaagaattatgactggattgacgtcaggattgggctttttaggttgggtgtgatagaagatcaaggaggcagagaactaaagacagtcatcagtataaccaaagtcatggcatcgtaggctgcagactaggaagagaataagtaagatcaggaggccattcatagacttagagaatgtagaggggccaaggtcttgggagtctcaaagatgctgaagagaagttgggagtaaatgaagaactgagttgtgagtacagggagttgtgcacggtattcttgatattgatcaattaatgtacagagaagcctgggtagctgatgatatccctggccctgccatcagagatcaattgttgaagcagagtgaaggtgaattcatcagaattgaagagctgaagggactaagctctttgcactggtatccttttgagttcccaactagtaagactacatctttttaataatactttgttaataatccaaatgtaatgtctaaagaggtccttccccattatgatggaaacattcttcatggttagtgacgttctttcattggtgtccaagaaatctgatagaatcttcaactttttcttagtatgttcatcctgagactggtaggggaagtgtcctgggttcatttcttctccttccagaggatgtacagcttacgctttcagaagcataatgctaataatactaatagctgtcatttgttaagcacttactacatgctagccactgcgctaagcactttatgtggattatctctttatacacttataactccgcaagataggtgcactttctgtgtctattttatggatgaggactctgaagattagagaggttaagtcccttgcccaaggtcactcagcttgtaaatgatggagccaatattcaaatccgggcaatttgcatctagaacttgagatactaactctgtaaaactgtctgtcgatgctggggagacctaagtcagcctcattttggaggttagtgtattcctgtttgtgaaggaagaggaaagcagccaccctggggcccctgtccagagacgcaccactcgacccagtactcccgactgcacatccgtctccctgttgaccatcttcagcctgcttctccctaaagcacagaatcacagtgtcctttgggcattccatcaccccatacagtactgctcacctaagacagtgcccttcactgccaggggcagcatgagatgtcttcccaaagccccgcagaagttaatcctctgggcactccttacaagagagctgaagaatggcatgagagccgtttcattccactgttgattcttggaaataccagagggttgtttcacatagacacgtcactgtgatggctcttggctgttcaaagtgcaaggaggttgctgtgctgacgtcgaaatcttagtttgaaaccttatttcaagaatgctcagaaaagtaatataagaagtatgcaaggagaagaaagcatttctaatgataaaatgagtaacttaattttaagacctccttgaaaatcatattaatttgtttctaaattaatttgctatttgctgaaagctactttcagaaaatgataccttgtcctgtggtatgcctaactctaacttttatatttaaatgatccgtttacttggatgaactcatgatgcatattcagaaagtaccgatggaagagaaatggatgagcacatattttaaaaactgtaatatgttaggtatttctttagcttatgtttattaaccaaatgaagactttttaacccctatttgcaagagtaaaataatatttcacttcatcatgcaaaatgtaaaacaacaaaacagatttttttacttttaatgttagatatattcctaaacaatatcaatttataccaaatacctaatccttataaccccgccccctcccctcactgcctcctccaacacacccacagtgcgagatacagagctggaagtgcccctggcagtctacctcatagtgttccagaaacaacaccaaggagggtttaccttactcctgatcatggggcctgaggccagagggctgatacccaaagccaagtcccagaaggaattacaaaaatgaggccaggaaattaagttccaaccaggactttgttaaggcctaggtgttaacacccagggattgagccaaaaccaggtatcgggtgtggggatgtggctgggaggaagtgactgggaaggctgagagtgaggaaggttgggggaagtgttagccatgcagaagttgcttagcttggatttcagacatagggccagtgccccaggcagcattgtcacaggcatctaagctgggtggtgatggccttccttatattcattcatccacccagcagttctctgtatgtgatccagggccgccaggggtctgtgaggtcaaaactgttttcacaatattaaggcaccattgacatttgcattgatggtgcaaaggcaatggtaggtaaaattgtatgaattatttcattcaattttagcatgaagacagtagtgaaaaccgtagtcgtaatcactgtattcatcacccccttgtcctcacagtttaaaacaattgtcagtctcacttaagaatatttcaaaggaaatattaaaaagtattaattttattgtctcaatccccaaatgcacatctttttaatattctgggaagtatccatacagcatttctgttatacgcagaagcacaaaagattgtctccaggaaaaggatttcatgattgtttaagttgaaatcagaagtggccactgttttactggtacaccatttttatttgaaagagtgactgacagacaaactactgttattcagcctttagtatttggtcgacattttctcaaaactgaatggagtgagcctgtcatttcaaggaaaacaactgacagtatttgttgccaatgataaaattcaagctttcaagtgaaatttagaatttgagaaacttgtattcaccactgtgagcttgacagtttctcaatacatgaaggcttttctgatgagttcagtggtgatattaaatatggtttttatagtgtataatgaaatgtgctaacgtttagaagatccgtttaagtcagtgaataaacattttttgatgaccagtgtaagatgttacaaaatcatgaattttgcttggataaaagatccattgcaagtataagatgccccaatatatgttaacgtaataaagtatgaaaagttaattgatatgttttcaaattctacactgcagctagtctttaagaaaataccacttactgagttacagtgtagcacaagagtatctacagtcatctgaaaagactatgaaaatactcctcccctttttaactatgaatctatgtgaggccatatttttctttatatactacagccgtatctctacaaaggaaattcggaagcaggagagaatctagctataatttattagggaatacacataaaagacttacaaaaatgtaaaatcatgatattcttcttacttttgttttgcaaaatgaattttcttaaaaatatgtttatgttaaaatacaaataacttattttaaaatgaattaatattttaaatttttctcagttttaatattcatttctagtatagtaaatattgttgacataacctatatgaacagaagtttctagagttctcagtttttaagagtataagggaatcctgaagccaaaaagtttgagaaccaccgttctggtacatagagaatattatatagtgggcttgggctggtgtagagatagcattgtgtactagacaggagtggaccttgcccatggagctaagtcatctacagctaaatagataagtcccataaagtgtggtaagtgctgtgataggaaaagcgcagggtgatatgggagcacctcaccctgtttagaaacttccaggacgaattagtgtctctctgctgattcttaaaggatgaataagagttatccaggcaataacagagtgattcctctgggtatatggaaaatcatgtgcagagggccccatggaagagatcatggctccactgcagaaataagaggagtgtagcttgagcacagggtaaagggggatggtgtgacagaagctgaactagaggacagcagccacatcacgaagggctgtgtgagttcaggaggcaggacctcctctgaggggaactggaagatactggggcgttttaagacacgagagggacattatattatatcatatcatatcatatcatatcatatcatatcatatcatattatatcatattaatttattttttgagacagtgggtcactctgttgcccaggctagagtgcagtggcacgatctcggctcactgcagcctccgcctcctgggttcaagtgattcttccacctcagcctcctgagtagctgggattccatgcttggctaatgtttgcatttttagtagagaagaggtttcagcctgtcggctaggctggtctcaaactcctgaactcaggtgatccacctgcctcggcctcccaaagtgctgggattacaggcgtgagccaccacgccccgcccagattacattttagacagatccctctggccatagggaatggatgtctagaggcaggggagacccactaggggtcattgtggcaatcagagagctgatggaacctggactaggatatggctgaagtgttggagagacatgcatacacttcagagagaggtgtgtggagaagtttacagaactaggtaaatggttgggtgtggctagagggaaggataggtaggcatcaagactgaatctaggtttcaggttcagcacctgggagtcatgatactgttcaccagcagagggaacacaggcggcgcaggtttagagagaaggaggaggaatctgacttgagttcctgtagggtacctaggaggagctgcccggtcagcactccgatgcgttgttctgaagctcagaaagagcatctggactagaggcacagaggagagagccgtcaacacacaaactgtaactgaagccatgggctgagtgagaaccctcagagggttggaataagaagagaagactgcctaagagacaaccctgggggtaccaacatctaagggataattaaagaaaggagagtgtgcaactgtccctgaaaaacagtaaacagtgcccagagaagtaacagaatccagactatgtgagcactgaggcaaggggaatagagtcaagaagaaaggagggggcggggtcagcagtgacaagtactgccaagaagtacaaggaggattaagagggtctttttgacttagtaacgaggaggtagttgttgagtcattgactgcttccagaacaatatcagtagaatggcacgctccagtaggttaaagagtgagggagagaggatagcagactgggggtgcggcggggaagaagagagtagttgagggggaggggagatgaaggcagtaggggagagagaaaggatggggagagagggaggttgagattactttcactcaatgggaaggaggcagtagagagagaaagctgaagacataagagagaaggggaaattgttagaatggggtgttccagaagagtcaggcggtgaaaggattggggaaaatatggagagaagccatgtctccaacgaaaaaccaagttccaatcaaggcatgaggtgaaatgagcattagctgagacagatgaggatgtatgatagtttaactagcaaatggaaattccatggtactcagtggaaaggttcaggaggaggaaagtagtaggaatttagattaaaggagaaaaagcacaaggcagtgtgaggaagaagacacgggagactggaaggccagaggggctccccagagtgcccaagcatggcagttttgtgaggagacaggtgtgtacagggagctgtagcttattttagatattggtaacttaattacagcagtctcatctttttacacaatgatgcattttatcacaacctaaaatttattctcaacaataatattctttttaaccaaaacatcattttctgaccaattcaaattattcttatgtgtttctgttgtttacttttatgttcaccaggttaaatcttcagttacgccgctgccattaagagatccctatgtagaaaaatctattcattatgaacacatttattgcttcattgaattgcctatttaaaatgcagagaaccacaaattaaatgtagtgcttttccattttgaaaaaaagcagatgaatgggtactattttcttgaatacatcatgtttgtcttacataattaacattccagattcataagccaacagatgccaatccttgcttattttgatatttgttcctcaatggtcattactgaaagagatgcctcctaagacttgaacatgctgtgttctgcatcagaggaaatgataaggcaaatgtaatggagattattgcttttgggggatagttaagtgatgtccaaaatctatttctctaaggttaattatgcaaagtacaaaacaatttcttcattgcaattgtaaaataaaatatctcaagtatcttcagtataagcctagtctataaaatacttctagattccaagtttatagccctctactaaatatttattgtatttaagacatgggtgtttgttctagaaacatgctttaatgtcatattgcagtttttctagatttctcatattgagaaacttgaatatacttgtgttgaatatgtgtaagcgtagactacagtatagtacaagggcacttttaagtggcaaatctatggggaatgcctagtggatctcatctggaggtcagacttcattttgttgccttttgactcaaccaggccatttgagctgtgatagggtttgggtctgcccaaatctcatctcatatccagttgtaatccccagtgttggagatggggcctggtgcgaggtgatggttcatgggggcggtttctaatggtttagcaccatccccccttggtactatatagcgaatgagttctcacaagatctggttgttacagagtatgaagcacctccccccttcctctctcttccccctgctccagccatgtgaagttctggctccccctttgcattccaccatgattgtaagtttcctgaggcctccctagaagcagaagccaccatgcttcttgtataggctgtggaactgtaagccaattaaacctattttctttataaatcacccagtctcaggtatttctttatagcagtgtgagaattgactaatacaagctgcctgccaaaccacctcacttgtttccctcttgtttttattcttcccatcatgaccccaaagagacctcatgttccatttcttaacacatataatggatcctcctgtaagtatctgggctgtggcagactaacagagagacctccaacctcaacaccagctaatgccccaggctcacagtctgaccactctgttagaaaaagaagcccctctctctggttgtcccatccccattctactttgctctttatttgttctcactcagcctccacctttttcctctctcaaacttgtgaaagatgttcctggaatcctatttttatagtaaatacacccacctccttaactggatggtagaacattgtacctgccttcttgccttaactgaaatttgactcttccctgagagcttttcccaggtgagagaatcctgctccagaagcacagtgctgttcggagtccattgtttcccactctgttgtagaccctactcttctgatcatcctgctatctgactgatttgtcctctgtccataatactgtcatccactaacctcatagtcacctatgtcacatatagcctcccccaaaactcaaagccctgccatcatcaaaactactcagtcctttagattttcatttctttcacatcatcaattctagtgaatttatctgtgttactttagccgcctgcttccttagctataccctggatcattaccaggaaacacatctttgctaaaatatcacattgaaataactcttttttatgagtcaggatctctgatataatgttgggtagtagaaattatagtggacatccttatgtgcttttagcctttttaaggaaatacttctaaagtctcaccatttagtatgatgttgctgtagggttttggtggaagcaaaatgcgtttgtattcccaatctgctcaatttttccattataaatatctgttgggtttctttgaatatttttctacatatgtgaaatgctgttattgtttttctcccttaatctgatatttgcagcattaaatattttctctccttctgaaatttcttttagtttaatgttagcactttcccttgtgtcttctgtgtttttttgactttcctttcagggtttttttggtttttttttttcctttttatctctctgtagtgcatattgggagatttccacagttatacattccagttcatcaaatctcttttcagctctgtcaatcctgctaattatataatttttcattctaagactttcagttggttccttttcatttctacctctttttatttcacaactttctgattttacaatcttgctagtaatctctattatgactgaggatttttaagtctttattcagagtgttctgtagtacatatttcctcggatatgaatctcctcattcattgaactgcttttaatcatggtgcatatccttttgtaattttctttaattaagagcttaacttccctacagatttgccctataaaggttctctttgggaattgtctcaaccccaggcctatgaattcctcagctctgaaacaattcataagttaggcatagcttgggaatcctactgcagggaagtgatttctatgcccatgtgaaatgcagactcagaagctagttatatataggtgtcttatcttcatctctaatcataggtaatttggggccttgaccctcactgaaaaaaaagaaactgatatcacccccacagctccccgccccacccctagatttatgtggagtcatgctcaggattcatattcttttccctttgcagatgtagaaacctcagaccccatgtcttttcagcacctgcccctacctccaatctcacaatggccatagtcttacacgtcactaccagcatgggtttattatcgttttttattcacagagacttttctttcttgtttttaaaaatggttctatcagtcagggccccagcagaaaacaatgttattcagatacctaaattcaagagatttgaatgaagggactatttacagatataaggccaggaataaagcatacaacaaggtcatttgaggtgcccagagactaagaacagcaggctctaaagggcaagggaggaaatgttattacaggagcccaagagagctggagctattgagaagggctgcctggtagaagctgtatctggaggaaagtagccattaccagaaggaagcagggaggctacaggaaagaaatatcccatcctctcttctcccacactccagtttcttggtggaacttctgttggccaaacctaactggaagggagcccaggtaatgtgacccagaagggcacagggcaaggcagaaaattgattggatggatatgcaaatagagaataaatagtataaggcttatgtggtttaaataaatagtgtatctgttatttctgtatgttgcagaggcctaaggattttcagcaagtgtttactctgccatattgaccagaagtctaaaaacccctcctctggcctcttagcagctgactccatcattcaggcacacccctcacctgtgcagattctcaggcaagtgtatcgctctgtcgcccaggctggagtacagtcgcacagtcttggctcactgcagcctccacttcctcctgggttcaagcaattctcctgcctcagcctcccaagtagatgggattatagacgtgcgccatcacagccgcctaattttttaatttttagtagagacgaggttttaccatgttggccaggctggtctcgagctcctagcctcaagtgatctgcccacctcagcctcccaaagtgctgggattacaggtgtaagccactgtgcccagccatgtctatatatttaaacattataaatcaaggtaaactattaaataaaatctgttttatctttctaccctgacagatgtacattaataatgagctagaagggagaggttttatttgggattcatcaatttcctggaggttcatgtggaacatctatggcacaggggagtactgacgtctggtccctagccctgctccccatggtgaagagccttacacactgtgtggacacaccgcccccaacatccatgcttaatccacatccccttcaaacaaccactctgggcagaccctcaggaagaggcctgcaaaggtactaaaagcagcctcagggctgtgtaggaaggaaattctagggtcccaggtacctggaatgtggtctaaaaggtaatgggtatgagctttggatggacatatctcctggtccaatagagtccttgctccatggaaggactctagagcaaaagatgagactgagcctagtcctctaaaatgcagggcccagggtagggtcgcctctgtcctgagtcttatgctgggccccattacacttgattttcatcaagacctgtagtcccttgaccatctgtgttttctcagactgtaaacctcttgtggtactcccttctttccctgtctagcctggagcctatggcccctcatactcctagcaatgccgtcaacttcctagcacccttgtttatccgtcactcctgcctagcaaaatcttagccctgggccaacctgactctccatcttcttgctttacgcttaggttgttgagtgtctgcaataaaaatatacaggttgggccaggtgcagtggctcacgcctgtaatcccaacactttgggaggccgaggcaggtagatcatctgaggtcaggagtttgagaccagcctggccaacatggtgaaaccctgtctctactgaaaatacaaaaattagctgggcgtggtggtggacacctgtaatcccaactactcaggaggctgaggtgggagaattgttcgaacccgggaggcggaggttgcagtgaaccgagatcactccactgcactccagcctgggcaacagagtgagacaacgtctcaaacacacacacacacacacacacacacacacacacacacacacacacacacacacacacgttgagcatccctaatctgaaatccaaaatgctccaaaatctgaaactttatgagagctgatctgacgccacaagtggaaaattccacacctgacctcatgtgactggttgcagtcaaaactttgtttcataaaccaaaattgttgaaaatattatataaaattaccttcaggctatacatatgtttataaagtatcagtgaattttgtctttacatttgagtgccatcccaagatatctcattacgtatatgcagatattccaaaatctgaaaaaaatcagaaatctgaaactcttctggttccaggcatttcagataagggacctcagcctgtatcagcagtgtaaacatgctgggcctctgcctccgggcatcctgctgtgttctctcaggcagctctttctggtttccacagaagcactttcaaacctttgccacttttctcaggctcctgccccattttccctgtcactctcagcaaatggccttgcctcctatatctccaagaaaatagaagtcatcaaagcataatgtcttttactttctgcttccctctgcagttactatacactgttggtaaggatgagggtgatgggggatgatggctaactttcttcagcactaaccactgcccgcttcattctggtcacaatggcaggggtactatttctcctatctcccagccccagacaaatccttccaccatagctttggattctgcccttttctacttcctctggtcctaactgcatcaattatcttctctgtctgaagctctgcattaagctgcagtcacttctctacttctcatatccaaatctctttcagtccactgtgattttatttctgccccagtaactctgctgaaactgccttgaacctctttgttgctatccgtgggtacttcagtccttgcagtattgggcactcttgagcctaccttctaagcatgctctttgccctgagatccatgcaccttcctactttcccgaacagctttccaagtctccttcccacaaatgtcttccgcagagttctgccggaggcggcttcccttctaattccttgcactcccagtgccttgcctggagaaggggctcagtcagtatcaaattacatatgcagatccaattgccggttgcaagtagactcacaaatctttagaagtttaaacaaaaaggttttttttttttttttttttttttttttgagacggagtctcactctgttgcccaggctggagtgcagtggtgcgatctcggctcgctgcaacctccgcctcctgggttcaagcgattcacctgcctcagcctcctgagtagctgggattacaggcacgcgccaccatgctcggctaattttttgtatttttagtagagacggagtttcaccacgtcggccaggatggtttctatctcctgaccttgtggtctctatctcctgacctcgtgataggcccgcctcagcctcccaaagtgctgggattacaggtgtgagccaccacacacggccacaaacttttctttaagggatacacatttccaattataaatgatgtattacttattgcaactggagtccactgaggggaaaaaaccataatagcttatttcagaactaatatggctatatgttagcaacagaagtggtgtagctattttattagaaatacaataaagagattacttagcagctgtctccccacaccatcatttcattttgctctgtagttcttggcagagagtctagagagaaagaaaataaatttaagccacacagtgttctcctagactaaatgatttctgcagttctgagaaagaaaccttaaaaagacaatggatgttccatgattattgaaaagaacattttcaaaattttttccctggataaatttgattaaacattatagccttttccctttcatatcttgtagtaaagcttctcttacttagttccatgttccatactcagaacttgagtgccacacaccagcctaggggccatattagatcttgacactgaaagaattcagcgagaactatttaaggctctcttttcattgaaatgaagaaatgtcacatatagaacattcctttgtttattcattcatcattcatccgacaaataattatgtgaacagtcactccaagaaatcttagagtggatattatgtaatatatgaaaagatgcctgccaaaatatatgctgaatttatgactttattttggctttacctgccagcatttcttgtcctagccttcagactgtgttactcagaagtacctactttttgcacagtcacgagattccaaagatcatatcatttcattccatctgttcctgccacagttactttaataacaatattcatcatgtgacctttatgtgctactctctacttaaatagggaaaactcttgtcggtccagagaagaaagaattgccaaaattaaataaaaagtcaagattccattacctgatgatttgtgtatttcacgttgtttgcaacgtaagtaggaactttaaaaatgatatggtaacaattttaatttttattgttgtgtaagaaaatggatatggctcaaaggaggatagatgagacatgaaaatgttgtggggaaaattctgttaatgctcttgatcttctggcattacctatgccaccaagacagtataaggcagaatttcatacaaatggtccgtgacttttaggatggttcagcgttacagtggtgttgaagagataggcgttgagtagaaaccgtactttgagtacccacacagcctttctgtttttcattttcagtacagtattcaataaagtacatgagattctacactttattataaactaggctttgtgttaaatgattttgcccaactgtaggctaatgtaagtgttctaagcacatttaaataggctaggctaaactatgatgttcagtaggttcggtggattaaatgcattttcagcttacgatatttacaacttacaatggtaaatcaaggaacatctgtatagtgctgagcccagagtaagaattcagtgcttgcagggctggaagagtcactgcctacagaaacatacatgtgcgacataggcgtcatgcgaaatcatgaggagtggtagagcttatggcaaactggagagctcccaagttgcctaaagacatccacatttaaaaatttaaaaacactgtgctagccaagcaaaaacatggccagagatcctgtactgcccctagcttgagtttgctgttgttttgaaacggagtctcgctctgtcacccatgctggagtgctggagtgcagtggtgcagtctcggctcactgcaacctctgcctcccggattcaagtgattctcctacctcagcctcccaagtagctgaaattacaggtgccggccaccacgtctggctaatttttatatttttagtagagatggggtttcaccatgttggccaggctggtctcgaactcatgacctctaatgatcatcctaccttagcctcctaaagtgctgggattacaggtgtgagccaccacgcccagcccctagcttgggatttagatctctaagttatgcctgccccttgcctgccattcccctttctgcatgccttctttctctcttctactcttcaccaccacccgctccatatcttagaccacttgctgcctcagataaaagctgcaatcaaaaaatgctacttcatttcaaagaacaacctcggcaaaatgtgcttgtatttgagaaaatttgcttatatatgaagcaagcatcatttcaaacactttttaaaaggtttcaatcctttcaatctttgttaatttgtactaacttgtaatacatgctctttctttaaaacttctaacaatatagaaataaagtacgattttttccttccattcttcccttcaccattctcattctccaggtaaacactgctaaattatttggtgtctatagatccaaatttttctgagtatgtaaactaatatatacatgcacatacatacatagactatatagagatatctaattaaaatgctgtcgtaccattcagcaacttgcttttttatatagacaacatttcatattattgtagtgatatcacattctttgtaactcctgttctttcagcagtcatatcaatgtgccataatttcaccagtccctattagtgacattgaaattgtttttatcttttctgcgagtattctactctaaactctgtatctgaatgtgagatagacatctccatgttcaaaaccagattcctcatcttctccccaaaacctgcttttcccatggttttctgccatcttaattaatggtaactccatcctttgtgttgcttgtgccagaaacctggaagtcatcccaagttcctttctttttcttaccctccacatccaagctgtcaacaaatctcgactctgaccacctctcagcacctccactgtgtcacccagtgcaaacctccaccaccatctcagcctcttacccagctccaggattctgcctttgcccccatcaatctacttcaggtctcttctccacccaataaataagtccagcaatgatccttgtaaaatgtacatcaggaggggccttctcatctcacctatgataggtatggagttttttcttttttccatttcacctgtgatgtatgtttgtgacctccaatatgtaaccacttactatgttgcttttaaaatgatttttaaaggtttgtttacaaccatagccactatttgcaattatgagtgtatagcactaagcatgagaactagatctgtgaaattttttgccagtttcattaggtgacctctgtaagcatcaaaacctggcattgattgaggttgtttcaggctcaactagtactgttcaaaataaagtaactgaaagcaagtctggtggtagaaggtactttataagctaactaatgcttttcaaagggatatatattgaaggaaaggctcgttttatattacatcctataaggcagtgcttcttaaactctctgtggaaaagaaccactttttataaatttccagtctgttgcaaaccgatactttgtaaaaattaataaaagtgaattactagaaaaatgaaatttttgaaaaagacatataaaataaaagttgtaatttttagcaaacaggaagttatattgcaaaaattactggggtataggaaaaaagatacaaaaattgttcgtgtttgttcattgaaagtatgcgtgtaagcaattaataggctattgcacttgtaagttttcttcattttaagggaaaatggaattcccatattaaatgtctatttgtacactttgaacacaatgtggataaatatttaaagtttttaatgtgacaaatgggattgcttcctacttgatactttacctaatctaggtaaaattgccaataaggctacttgtagggaataaggtatatctaaataatttctacgctttattttaataatgatacaaaagaaaccagtctcacaatggaatggagggagagattttagagcaattttcagtgagctcagtttattcattttaaaattttatctaagatggagccagagccactatgctttcaaagtcttccaatccctcaacagacctgagtgccagcaatatatcctgtaaattataattaaatataattatcttttggtgaaataaatggatcctagatccatggattttttagacatagatcttcttttgatggaaaataaaattcaaaatgctttatcaaatttaaggtgtttggtgtttgctcttcattgatgtgcaatatcagaatcatcactatgtcatttaaaattgttacattttggaacatgtgtcatagcaatctgcagaaactgttcttccaagctttgaactttcatttttgccatttgattctacctgtcattgaaaaacatgttgcattaattccttgcatggaagtattaagatcattaaaactactgaggatatcagatgcataaacaatcctctttgtccaattcatatcttcaacaagttggggccaaattgtcttcttattttgcagaaacatttaagagttgttttgtagttcaaactttctcaaacacagcctattggtcatcatcgtaccccagcatgcagcaacagctggttatgatctgcttccatagtatcatgcaacacaagagaataatctaagatttaacgcactagcctttacctaattcataatttttagtacaacattaagcccactgtttagttccaccaacatttcttttcatagcaggacctcctcatgagagaaacaaaacatagatttacattctggtacaagctccttagtcaggataactcctccagaatatttcctgcaccgtcagaacataccctacacaaaatttaaactccaaaccacatttgttgacaatataatctttcatagttttatacagttcagacttagttatgtatgtcagcaacaaaattgaaaaaaagaactcttccttcatatcaccatcatgttccaattgcacataaacaggaatgtgagtgcaattatcatgctgcaatgaaaaatacgttgccagctttaactgctccatgggttagccttctggatcgttagccagtgcctggatatgctgagctatggtggcactgaaaagtagtgcttgagccaccttctttgctgcagattcacccaatatttccaagtaaatacctttgatacagtcttttcactaatatctccccaactgtatatggatcttaattttggcaagctgaactgcttcttattaagcccgtaaagccctaatgtttatatgtaaaatattgaacatctgcttcataagctatttaatccaatattctttctttcaaaaaattcttgtggtttttaactgaatttttgtaagtaaacaccccataagttctgatggtctcattgcttcatagccagtacatacaaaaaaccgaacactatgtttttagcatgtcaacatcgattacagctttaaactgaactcagcatgttagggatcatagttctggggaaaagcactatgaactctttgggtcttggtttcttcagaatcacttccatgtcatcatttggtttctacccctgtcatactcagaaaagtattttctcacgaaaaaaagtccagtgaagcttgtttcacctccataaattgagggtgaaaataacaaatattattgctctaatcagctaataatgttaaaccacaaagttaaaaattctgattaaaaattaaaacgtataaagtcagtcataaaaataaatgcttacattttcataggtttttatacacttttagggtacagttaacagaccagtcatatcaatacaataagtggttatatattaattagagatcacaaacatgcatctcaggttgaatgaaaaaacacacctattataatgttatgcaaacggctactaaatggctttaggcaaaaatttctactgtcagtactaagcatggaatcaaagtcctgtattccagataactcttccaggtgccctggaaaagagttttatgtctcaaaaagtggctctggtgatcatgaaaacgtttatatgaagatgcatgtcaagagtgaataaaaggccaggcatggtggctcacacctgtaatcccagcactttgggaggccgaggcaggcggatcacctgaggtcgggagttcgagaccagcctgaccgacatggagaaaccctgtctctactaaaaatacaaaattagcggggcatggtggcacatgcctgtaatcccagctacttcagaggatgaggcaggagaatcgcttgaacccgggaggcggagggtacaatgagccaagattgcaccattgcgctccagcctgggcgacaagagcaaaactccatctcaaaaaaaaaaaaaaaaaaaaaagagtgaataaaattgcttcatgaaacatggtcatggaaaaagcagtgcatgttggtccttcaactgtctctgggctccaaactcacccttctatactctgcatggtggggccagacctgcctgacaaaccacatctctcgtttcccagctgcttccctttaggtcctgtcctccggagatacagaggctaccgggcggccagagaagggagaggcgagtgttccttcctgtcctcttgcagttcctgtgaggctcactcctataacagttcctcactccagttgtctgcagttctagtttcgtgcgttttcctatggtgtcctccctcagagacagcagcttcagcctctagcaccctctccaggggtctgggttccagctccacaggaccttcctgcagcctcctaggttctaataacctcagtctcatccctttgtttcttcagccctgaggatggtagaggcttcatgtgttttaatggttactaccttttaattgcagaattcctcttttgccttttttgttcttcaatacctgtctaacctatttcttttatattaaattctctcttttaaaataaccactgtggtttctgattttctaaccgaatcccaactgatataataaatggtaccagaagtggtcccaggtggtctgggaatggtttgattgtgtctttggcccaaaatgcagtgctgagcagcttgtcaatgtgaaatggaatgttagtaatcgggtcatgccgtggcatcatgattaatcaaactatcccctgtggttgattgtgaagaagtgcctgaagctagtaacttaagggaccaagtggcggctgcacttagccattatagtagtaatgatgatgtcagaagtgtggaatgggaggctattctgcctttagtggcattcttatggaaaaaaaaaatgacaagctcaagtctttaaacactcagctcaagtcatatctggcaaatctcaaattatttcacttctttttatctccacctctaccatcctactataagtcatattttctcaactgaagttttgcgacagcttcctgctctccctttcttacagtccatttcttagagggtgaccaagataccataaagccaacacctctgcctaaaacctccaatgacatcctactgcattaaaaaaaaaaaaatctaacctcttcaacttcgtctcaaaccatttcctcccctctgtgttccagtctttctagctctctctggcctgggagttcccacatttatagttccttcttcttagaattcatttcccttggcatgtatgactgttacccatccttcatatttcatattccctaggtccccaaccctccctatttaaagcaaaccttcaaccctttcctctagtaaatatgttatcatcatgcattcatttcttacatagcacttgccactatatatatatatgatacatttcataattataacagggtcaattaatcaagaagacataataattctaaatgtatacatacataataacagagcttacatatatatgtatatgagagagagaaagagagatcttatttgtttgtctcccccaccaccctgctctccattagggcagaaacctgtcagtcttattggctactatattcccaggaccctgctccaatacctatggcatagtagatgatcaatgattatttgttgattgaatgatcctgggaagtaattttctttcaattaacttactattttagttataaaacattgcaagcatacagaaaatattataacaagcatccagatagctgccagcaaaatttaacacattttgacatatggccatacttgcttcacatctcacacttgcactcgctctctttctctctttctctttttttttcgagaaataaaatgtaaaagaatattttcatctaaattaaaaattattagcacaaattacatatactatttccttatgatatttttaatgactctaggctctaactttcagttgtgatataggtgatttgtgggttttcttctcccctcccccatcagtctagctcagggctatcaactttattaatttttttaaagaggcatcttttagtttcgtttattttctctatgattttttcattttccagttaattgacttttgccattgttacttgttatttcttatagttattttagttgacttgctctttttctgtcttcttaaggtggatgttttgatcattgattttagtcttttcaaatgtaggcatttaaaactacatatttccatctaaggactgctttaactgcataccacaattctgatatgttggattttcactgtcatttaattccaaatactttctaatttttcttgaattttcttttttgacccatgggttattatgaaatgtactgtttaatttccaaatatttgaaagttctcccaattttttggttattgatctctaatttcattccgttattcaatttcaatcttttcaaatgtgttgcaactttttttttttttttttttttggtcccagcatctatcttggtaaatgttccatgagcacttgaacggaatgaatatcctgtaggtgtcaggagtggggctctataaatgtcagctaggtcaagttggttgatggtgttggtcatattatttttactgatttcctgtctctgtgttctctcatttactgagagagaaatgttaaaaataaccggctatgataatggatttgtctgtttctccttttagttctctcgatgttttgcttcatgtatttttaagctctgttattaggtacgtatacgtttagaattattatgtcttcttgattaatcgaccctgctataattatgaaatgtctcttattatctccaccagtattttttgttcagcagtaatattgatgtggctattctttctttgctgtgattatcattttttattcttttactattaacgtatctgtgtctttatatttaaagtgaatttcctaaggacagcatacagttgagtctgctttttcatcttttctggcaatcctgatttttaattaatatttagcatatttacatttaatgtaattatttatatcattgggtctaagtctacatcttcacatttcctatttctctcatttgtcatttgttttcctctatcccccttttctacctttatttccagtacttttctttcccttttgtagatccagttttccatttcgtattattttccataagcctaaggaacttccttaaatttaatgtctgctggccacaaatttttatcagtttctgtttgtctgaaaatgtttctattttacttttgttttgaaatatatatatttccacactttaacattgtaattctaactggttcccatggtgtctgatgagaagtcagtggtagtttttatatatttttttctctgaacaagtatgtctttttctctgcttttaagatactgtctttattgccagttttcagcaatttgattatggtgttgttttttatagtgttcttcattatcttacttagagttcattgagcttcttggatctgtagaattttagttttcatcaaatttgcacaatgtttggccatcattcttttgaatgtttttttcttcttcctcaaccttctggtactccaattatgcatatgttagaccacgtgatattgccccacaagtcactgatgctcttttcattcctctgttcgtttctttttctctcagatttagtttggagaatttctatttctgtgtctttacattcacagaagttttcttctgcaatatttaatgtgacattgatcccagtccatgaattattaacttcagatattatgtttttcatctctagaagttccactgggtttttaaaaatactttccatttctgtctttactatatccatgccttcctttaaatactagagcatacttataattaaaagttcttgtcaactaattctattggctttgttgtttctgattctgtttccattgtctgatttttctcctgcttattggtcacattttccagcttcttagcatgtatagtaatgttttgattggattctgagtattattatattagttttctattgctgcatgacaaactgccacaatcttaacagctgaaaacaacacccattttcatttcacttatgaaggtccgcagcatggtggactcattgtttttgcttagggtctcaggaggtcaaaatcaaggtgttggttgggatgggctcttacctggaagttcatgggaagaatctactttcaagctcactcaggttgttaatagaatccagttccttgtggctgtaggtttgaggtactcattttcttacaggctgttggccagggtctactctctggccctggtggatgcccatattccttttcatgtgatcctctgcatcttcaagcaacaatggtatgtcatattcttcttgggctttgagtctcttcgacctcctcttttactacacactggagaaagttctgtgctcacaggtttagattagtcccacctgggtaatataacaatcacaggagttatagctcatcactttcatatgttcaggatgtgtaatcttgggggttattcctaggaattctgcctatcacaattacaaccattatgatggccaagtagcaggattttgatgtcttcttttaaagagtattgcgatgtattctggcaggttctaagtttacttgcaaatcagcttgatattttcaggctggtttataagctttgttaggatagttctagaatagcttttactccgtgactgatttagccctatttctgaggtatggcctttgtggtgtctattgaataatgtaggtattcagtgaggtctccactctcagtagtcagaacctcagcatgcacaagccctctgtgaagtcctgtggccatccagctgatctgtacctgtaagttcttttcccatgggtttggattctcacactctgtgtgtccatacaatatttgaccagactcaaatgacaccgaggccaatttctggagctttttttctgcacagctccttctcttgtactctgccctacaaattctagactctcagcctctcccaaccagtggagtgccaagggtggggtgggaggaccaatccaacctaggtgctgaaaatttaggagtatttgtctgaagagaattttaaaacagtgactcaaagtctatcttcttttatcaccatgtttctaaatacctactcctgccaggggaagaaaacaagcacgcttatacgcctacattctaagtaattgctgaagttactctgagttttaataatacatatataaactttaaattgtacacttttatttcttagttttaattagcagccacacttgctcattttgagaatacatttataacagttcagaatcatttgaactggctttaggtgcagttagtgttttcatctctggtcgcaccagaagctccagtgttttaacaatagattcggtgtaaacaatgataacacagtggttgtaaacataaaaaaaacctcgagttattaaattttatctatatgactacttcagagttttaatttgtgtttaaaatggaaaatagtgagaaagtgggaaatgtcatgtgtaatgtttatgtttgttatgtgtaaattgtagtttacacctggatgattttactaaatttgaatgatattttgtaaagtgatatttattctcctttttggattgttcatgtgtgttttaaaaccagagactaaatcaagaaagtcatgattattgctcattattacatgagtgttgctgaaaatagttttgtcacatagaggaggaggtgtttaaaaagggtgtgctcctggtgtgaaataggttaggttctctgttttcaagtttccctctcccgcacctccatccaaacggtgcctctaggcagaaagctaggaccatcccagggctcacttcatttgtttttcttttcagggaccacaggccttactctctgttgtccaatctctgaaagtgatttttaaaaatatatttttcattctttatggcagaagggctagtgtggtaccctccacactgggttttattatttgtttatattcctatttcctagatttgcctgagttttataagcataggagccatatggtattacagctctccagagaaacagacacaataggatttatatacataaggggagaaagactggttttaaggaactggcttgcaggattgtgggggctggcaagtccagagttcatagggaaggctgccggctggagactcaagtaagagttgttaccgcagtcttgaggcagaattgcctcttctttgggagatctcagtctttgcccttaagaccttcagctaattgaatgagtccacttacattatggagcgcaatctgctttactcaaagtctactgattgaaatgttaatcactgcccagcacagtggttcacaggtgtaatcccagcactttgggaggccaaggcaggaggattgctcaagcccaggagttggagaccatcctgggcaagatagtgagacccccatctctacaaaaaataaaaaattagccaggcatttgatcccaggagttcaaggtggcagtgagctgagatcaggccactgccttccagcctgtgtgacaaagagaaaccatacacatataaatatatatgttattatgtataaaacatataacatattttatatatataatatctaaaaatctaaaaattaccttcatagcaatgtctagactggtatttgatcaaacaactgggcatcatagcctagccaaggtaacacataaaattaaccatcatacatctattactcatttttatacccctaaaactttgagtactgcataggaattaaggaatagcaaataagaggctgcagtttgggaataaggaaataatgtttaaataaggctgcaagtagaggttactgtagctcctgagagactttgtgaaggagttaactgtattatgtgggccgagtgggagtcttctaacgttttgatgagggaaatatgtgatgtcgcctgtctagatggcagtgtagggactgaaatctagtgtgcagcactgagatggtagctaggggaggaatgagaaggacctgagtgagacagtgtccagggaaaggccaacggtgagagtggtgggggcggtggaatggagaagagtggaaggagagaggaaaaaggcaaatgatgaatattttgctggggaattcagcatttaaatttccttaagtttctttgtctctttggtggcaggacttcccaactcctttggagagagctttagaaagatgttattaaacctctaaaaaacaagcatgctattctttgtgaataaagaaaaaaaatcgacagctctgcacttaaacacctgtaatccctttctttactatgacaactgttaggtttttctatagcctcttccagtctttagccttatgtaatcctaggcttttgtatagctgtaataatattgtatatgtggttttgtgtcctactatgaggaagtttatgtctatgtggtctttatatgtattatgtttaataacagaaaagctttatggtaaattgatgagccatagtttactgagtcatattcctattgttggattgggatttcctaacagatttttaccattgtaaaagataatggtataaatgattttttatctaaattattttttacatttttattgtgatataactgatgtgtaataaactacatatatttaataatttaacatacttgaataatttttggtatgtatacacatgaaatatcactacagtcaaatattgaagatagccatcaccattaaaagtttctttggggctgggcacagtagctcatgcctgtcatttcagcactttgggagatcaaggcaggaggattgcttgaggccaggacttcaagaccagcctgggcaacacagcaagaccccatctctaaagaaatgggttttttttataattagctggacatggtggcatgtccctgtagtcccctgtagtcccagctactctggaggctgaccagggaggatcacttgaacccaggagttttaggctgtagtgagctgtgaccatgcaactgcactccagcctaggtgacaaagtgagaccttgcctggaggaagaaaaaaaagatagaaagtttctttgtatccctttgcagttgctcccaccctcctaccccttcccacctccctgttcccccttccctcttctcagataaccactgaacagctttctgacactgcacattagttttcattttctacaatattatataaatggaatcatataatatgtacttgttttggtctggcttctttgaccctgtgtaattattttgagatttatccatgggataccatgtatcaacagttcattccttttccattgctgagtacattgtaacaatgtaccatgttgatgggcgttgggtttgtttccagtttgggggcattaaacaaataaagcagctgtgaacattggtgtgcaagtctgaatggatatgtgctttcttttcccttggatacgtagctaggggtggaatggctggaccgtgtggtagatgtattatatgtctagtttttttacaaaactgcctaatttttccgaagtggctgtacctgttttcatttctaccagcagtgaatgagaattccaggtgctctgcatcctcactaacactcgatctttgtaaatttagccatttttataggcatgtagtggtatctctcactgttgtttcagtcagtatttttgtaatgactaatgacgttgaatatcttttcatgtgcgtattttccatcatatcttctttagtgaagtatctgttcaaatctctcacctattttttacgtggtatttgctttattattgagttttgagagttctttatgtattgctttatcaggtatgtactttgcaaagatttttcttctaggctgtagcttgtctgttcattgccttacctgtgtttgttgaagagcagaaatttttaaaatatattttctttggatacattttcagaaataagattaatgggtcaaaaacctaatcttttcttctttccttcttccctcccttcctccctccttccttcccttcttctccctacgtcctctttccctcttgcttctttcttttgtagttctacttacttgttgtctgtcttccaaagaatttgaaacactatcactgaatcatagtatgttgttccctggaggcttgccaactctggtctttctcacttgtctttacttgctattttggtgagtgtaaagtgcgacattacagttatatttcacttcacttacctggcaagttgaacatttacttaaatttggtatttaaaatatttttccttctgtaacttttaaccatttgtcattggtaattttgaattattgttatagagttataagagcttttcatgtattgtagatgtcaacatttacatataatatttatcacaatttcatatccatatttaccttttatcttggtttactccctaccccaactgcaattttttatttttatttatttatttatttatttattttgagacagagtctcactctgtcacccaggctggagtacggtggcgtgatcttggctcactgcaacctctgcctcccaggttcaagtgattctcctgccacagcatcctgagtagctgggactccaggcaccttccacaacacccggctgatttttgtatttttagtagagacggggtttcgccatgttggccaggctggtctcgaattcctgacctcaagtgacccacctgcctcagcctcccaaagtgctgggattacaagcgtgagccaccgcgcctggccttgcaactgcattttacttgtaattttctcgtgtgttttaaatagtgaatctaaatacctacctgggataaatatattattattttcgtctacctttgggaaattgtatgttaaatttttctttacaatgtatttattctgttttatggtataaagtaagcatctaagtttatatttataatttttttttaagaaggagtctcagctctatcacccaggctagaatgcagtggtacgatcatagctcactgttatccagaactcctgggctcaagtgatcctcctatctcagccttctgaatagctaggactacaggtacatgcctagctaatttttttattttttattttttgtagagacagggtctcactgtgttgcccagtttttggctggtctcgaactcctgacctcaagtggttctccccccttggcctcccaaagcactggggttacaggtgttagtcagtgctcctatttcttttaatgtgggttgctttttgatacattctgatctctcttaagttgccccttattgtcccagttaatgtctgatatgaacttcagaatttttacataataaaatatcctattattattttatttagaaatgtattaaatctacaaattaccttgaagtattgcctattttcattttttcttttataaaatatttatacttttattattggactgatatattctaccttggtttaattaccaagtaggtactcaataaatgtgtattaaatacagatatattttttccttgttataagagaaatctaattttgaaacaaaaagtttgatagttgttgttgaaaagcaatgttattatttttagagcatgttttatatgataattatccttgcattattttacttctaaaattcttagtagagccctttgagttttctgggttacataatcgcagctgtagcaattaatgatgtttctttcctattaatttttcttttttgtttttcttgccttttcaccgtggcaagaccctcttctagtttactaaataaaatgtaaaataaagagtatctctgttttgagtttgctttaggaaacatgccactaatatctgtatctccactaagggttttgctttgtttagttttcagaagttaaagattaggaatgtatgctttattttataaaattcccttttaagccttttaacatacaagtaatggtgagggccagcaaagtgtgctaggagtgaattaactgtattatgagaagaacatatttcttttatggttactttgcatgttagttcacaaatttttaatcttttgctctaatgtttcaaagactttctttttaaggaaatgttggtactttgtcatgttcctaaaggaaaaagtcaaattatccttgtttgctgacaacatatttagaaaaacctacagactccaccaaaaaactattagaactgataaatgaattaagtaaagttatatgatacaaaatcaacttacagaaatcagtaccatttatatatgccaacagtgaacaaactgaaaggaaatcaaggaagcaactccatttataatagctaccaaaaaaaatataaaatacctaggaagaaatgtaaccaaagaaataaaaaatctctataaggaaaactataaaacactgataagcgaaattgaagaggacacacaaaaaatagataccccatgctcatggattggaaggattaatattgtgaaaatgtcagtaccacccaaagctatctacagattcaatgtaatgcctaccacaataccaatgacattattcacaaaaataggaaaaaatgctaaaattcttttcttcttaatttttatttttccagttgaacccgagaaatgagtcaaaaccctaatctttaggatgttccagaagtactcactttcttccatcagtttatttcctcaccattgcccaaaactcaaatttacagcaatctatatagtactaattagaaaggatttcggccgggcgcgatgactcacgcctgtaatcccagcactttgggaggccgaggcgggtggattatgaggtcaggagttcgagaccatcctggccaacatggtgaaaccccgtctctactgaaaatacaaaaattagccagcgtggtggcgcgcgcctgtaatcccagctactcaagaggctgaggcaggaaaattgcttgaacctgggaggcggaggttgcagtgagccgagatcacaccactgcactccagcctgggcgacagaacaagattccgtcttggaaaaaaaaaaaggatttcataatgaaattcctttaattatgataccagtgctcctattaaaatcaggttttgtgaaagacttttttcttaagcccaacccagcctccgtggggggaaatcctaactaagaacttaaacaaatttttcacatgtacacttatgacaacatttttgaaacactaatattttgaaaagtttttgtgccttcttttcccacccccaaattgtggggacgttctcttgggctattctgcagggctctggggaggatgttcattgtgatgtcataattgccgcatattccagggacagatcttcacgtcttattcagcccctaattctgcgtgactgtgaaaagtttaagctaactgcacaccaaagtcatcctaatcctacagtttatcccatattcccacataagctggaaatgatcaagcagttgaaatggggagtcccaatgtcttgttcttggtactgcttgcagtgtgtacacagctttgagttggcagtgtattacaaattggcgttcctttctttgtccaatgggaccagcctgggtttttggcaaagaccctcaaaatctccgaaagcccagagttattagctgggcataggactgtgccatgaatccagagacctgctctgctatgctaggtaggaaagcagcttcgtgcatctgagcctccattttcccatctgtaaaatgaaagagtggggctgggtgatttttttttttttgaaagggagtttcgctcttgttgcccaggctggagtgcaatggcgtgatctcagctcaccacaacctccacctcccaggttcaagcgattctcctgcctcagcctcccgagtagctgggattacaggcatgcaccaccacgccaggctaattttgtatttttagtagagacggcatttctccatgttggtcaggctgctctcgaactcccaacctcaggtgatctgcccgcctcgccctcccaaagtgctgggattacaggcatgagccactgctcccggcctgctgggtgatttttaaagtcccttgaaggaaaaatgactacgtgtcgttgttctggggagaggcttggactctggaagcatggtgggcaggtcagtagagccctttgtcccagcggaccagaccgtgtgttgctggcaggcggcaggtctgaagccctcaccacagatcccttcagcgagggacagaaaagcaaagggggaagaaaagaagacatgaaaagttctcacttcaggacatttgttctgtacagtgctctagaggttgtagcgctgaacaccaagttcagagttattttatacctgtggttcgattcaaagtggaaaaaaaaaaaaaggttagttttttttttctccccccagggagctattttcagtaaaacttccatatggggatatatttattactaaagagtgtcaaacgagtcaaatagtcagaccatgtagtcactgaaagagagcagcagccgaggaatgcgcgcagacaccgggcaccctggaactgcattccttctccgcagaagtcaagcacggttgtttctctaaaagttctgcccgtaacatcttttctttcattcctttcttataaactcacattatgtaaactctcgaagtgtgaaatggttttccttggttggccatcactcacaaaatgattttatcaaacatgaattttccctcagctatcagctgcacgcaatgggaaactcacaaaatagagaagtggttgtgtgctgagcacataggcattttatagcgggtggagggtagaaggtggggcagggggtgggaggtggacggttgggaggagatctggctgaagtaacaaatgctcctcatagaatatgttggaaatagagaaaggtctgaagaaagaaaaacaaaacaaaacaaaacaaaaaaacaaaccaaacaaccatattcataccaaaccaaagataattatcattaatattttggtattgattcttccctgtttctctctgtttttgttaagatgagtgtgagttttatataccatgcttttcaatcattttgccattttcctttataaataaccctacaataaacaaatttgtcttcacttttatcttcttaggagctgttcctagatatcaaggtatcgtatcagagagtatgaagttattttatcatttttacagctcctggttcttcttacccaattgcctaataaacaaattctgctcccctcactgtatatgcccttctcgtcctgttctcaccaatgaccgagtattatttttcaaatgtttacgaatctaataggtggaaagagtatcttatttttttatttctccaattgctaataactttgaacatttttacatgtttattagccttttctgttctcttttctgtgaattatctattcataccatttgcccattttctcttctatagtgaaaacatttacttgtttctatttttattacaactgtttttccagcttattgttttcttttattataatttttgatgtgcaaagattttaagttttcatgtattcaaatctctgatcttttccttcacaatttcttcaattgcttttgtactaagaaaattttccttgcttccatattcttggttggtttgaattttaggacaatctaacatgttaacgaatttggaacttattttggtatatagcatggggtgatgatctaagcatttttgtttctaaatagccagtttttccatgatcctttgttaagtaatccccatttatatataatgcctttatcactttgtgctgtactgattccttttacatacaaggtgacctttccaggacatttatcctattcccttggtcagcttattcttactccagggacacacctttccgcccctagttctgacaatatgttctaaaacctggtgtttcttgttgtcaaatttgttctcagctcttcttgcctgtttattttccagatgaatggtaaaatcatttttgtgaagttccaagaactccctttggggttttgatgaaaattgcattcagcctataaattaattgggaaggatctggcatctttacaatgttcagtcttcccatccaggaatacacacgtggcttgtccctgcacattttcaaatatccttttatatgtctcgaaggaattctgtagttttctttatataaattcaacacatttcttattaaggtatttctagttatttcatattttgggtactttttaaaaatggaatcttttccccctttagtttagatcactatttttaatatcactttttccccacggattgccaaattctgacagaaatctaagtgaaaagcatatttgttcctttccaggcttataagctcagagatttagaactggaaccaaccttaaatctattttctttttatatatgataacactgaagtcacgaaaggtaaaataaagatcatattactcattaagagagtggctgtagatgaataatacttccaatgtccatgttctttgtgtcaaagacttgtaaaacttaaatatccgaaactaaattcatgatcatctcctttgtattagattcctattgccacaataacaagttgccaccgacttggtggctttaaacaacacaaatttatcatcttacatttctggaggccaaaatccaaaatggccatcattgggctaaaatccaggtgtcagcagggccacattcctgctggaggctcaaggggagaagccatgtctactgtttccagcttccagaggcccctgccttccttggttcatggctttttctccatcaacaaagctggcagtttagcgtcttcacatctctctggctcctctgattcttgtacgccctctcctgcttttaaagtcccctaagattacattggccccaccttgataacctaggataatctccccatgttagagtcagcaaccttaattctgtctgcaaccctaattttccttccccacataatacaacatattcacaggtgctggggatagcacatggatacctttggggcggggtgttattaagcaaagataaacttccaaaatttatatcaagcacatcggcccccttcttgaagcactttgatgacttcccatcgctctttgcatcacgaccaaggtccttacatagacttccaggacctgaatagttccagcccatgcatcccagagcctcatttggctccatgctcatcctcactctgtgcctggttacatttgccttctttcagttccttgaatgtaccttgctctgtcctgccacaaggaccttgcacatgctgttccctctgcttggagaactcttccccacctgcacctctcttattagctccatgcttctcagatttcagccaggtcctgcttccctgacctgctgcccagttctcgcccctatgtcccaccctctcctagaaccttctgtcactccttcagggcacttagtacactggtaatattattttgcttgtattaatagaattatttaattttgcttatagaattctctcccaggattggataaaagctcaaagggactcttgtcttttctgctcacccatttatcttcagaacctactgtgcgtggaccatagtgggctcttagtgtttgcctggtgaatgagtaactggactcaggaatccatttctttttttttttttttttgagacggagtctcactttgtcacccaggctggagtgcagtggcgcaatctcagctcactgcaacctttgcctgtcgagttcaagtgattctcctgcctcagcctcctaagtagctgggattacaggtgcccgccaccatacctggctaatttttgtatttttagtagagatggggttttaccatgttggccaggctggtctcaaactcctgacctcaggtgatccacccacctctgcatagttactcaatgtgttcagtgatacatttataaaagtgaaaagactggattggctccaaagtccaacaaaaaataatttattataagtccatttgataaaattgcatatggccattaaaaatgaaaattataaagactataacaatggggagaaacatctgttttacatttaaatagcaggatccaaatgttcttatgctgacggaaggaaaagtgccaacattttcacagcaattggtgtaagatcatagggtggtgagttctttctcccgtctccaaactctcccactcacatgctcgtatgttcagccgatacttattgaacaccactgtgtgccagacactgtgccaaatactgggaacagcacagtgaacacgatataggtggcctctgcccactgcaagttcataggcaggtgaggaggaacactaatcacagtcatattgatggtccagcattcatgggctgcagctgtattcaagaaaacatgggttccttcaccatagtgtgtaccataggctacagaaaatacttctaaaatccgggtcatcattattagggtcctaaaattttaaattgtggggggaaattgtagggttaatatacctgtttcctttagtctttaggccttgaaggagattttctaaattgtctctgcagtctttaatcactgtttatcctcttttaaagaggtggtcattgggacgccattgacggggggagggaggtagaaccctttccctgcccaattcattctctttctcagacatttggaggttccccggcccccacttctaagaactaaaaatgccgagttgtctccaacataaattcacttagttttgtcttcttacacttctgcacttggtgactgtgcgtctgtgcttgagcataatgtaaatacttaatttgtttaataaatatcctgaaatagcctctttgagttgttactagaagggcacgaaccttttaagtcacttagccagcacagatcaacacttaatgtctttaatgatgagcgtgatcttttttagtggctgaaatgctccgtaatcaatgatgtggccctgcctggaggcaggagaaactagataatgggcagaaaatgtcttgctggattgggccagtaatttgaatccctgaaattggtattagtgtggcaatttatgggagagcagtttcttcccaagggtagggagagctccccaacatcctaatgtcccttagtgatttacgcattattgaaatccctcgtggccagtgtctgttcctggcctgaaacctctgaggactctttgcctccccaactcactaaggcaaatggcacaccagtttcagcacaacggtcacctgtcttgggagtaatgcttagtgctgggcagagggagagaggtggacagggtcggggaatgaggatgtcatatgcaatttgtaagacctccctcacggtatgttcctttttcttctcccatctccataccaactttgagaattaatgcagggatagaaaacaaattctaactgttagctgaagaagcacttccaggtttgagtcctcaaatgtcccctctgaactttcacttggagtccctgagttttaatcctaggatttgattgatttgcccatattcacactcctcatgcatttcataattttctaaatgcttgtatatggccctctgaacctttatctctttagactgaaattctcttgttaaaagcccttttggtcattccatttggtgtgacttttttattgtgagtggactccattaatagagtgtttttgataatttgagggaattgtttcattatcaaatgttattcattttttatgtcatgtattattgtccacagacccagaggttttaaatgctaggagcatgttgtaaatgaaaacataaataatttattatagtcatgctgaactaaggccaaatttcctagtggctcagtgatgcacatcgcatcaatgagaaatgggctgagatgtaaaatcttattttcccaaatggattattgaaaattaaagtacaagctgttaaaagcaaatcttaatttttatataagttcctgcactctcatttaatggaaaaaaaaatctatcttcacagaattttaaagtaatttttctataaccaagatctatacagtaaattactcacttactggtgagtatttgctaacactgtatgagaatatccttcaggatctggccatgtcacagcccctagggtgattataaggtcctatacaggccttagaaatattacgcttttaattagatggagcaatggctagtcttcgttcctatatcattatattattaacattcattgccaggactcccggttgcatctcattgcaagggaggctgggaaatgtagtctagctgtgttccccggaagagagggaagtaaattttgttgaacacaaagcaggctctaccatggagtcaaactccacccatccccagatggatagccaattatcccggcttcttttcctgccaacctattccatccccactcgtttgaattgcctcatttgatttttgcagaattcctatatatacatatttctggacattattcttattgattcctgagtaataatcatactcttttaattaccgaattgaggatttatcttttgttttgataacattgtttttaaaaatattttgaattttatggcatatttattttcccagataaacttttgatttatcaaatttcccaaagaaagtaaacaaaaaactctacagtccttctatcatgtattattaaaaatatatcccactcaaaatattatactattaaaataagcattatttgacaactggtattttctgactctgaggaagtatgctttttaaaaggcaagcttccgtctaaacaatggctaacaatgtaattaggagggcatttacaaatggcttgatatttatagttcacatttcaacttcaactctatttgttgcattagcaaaatgaaactcattaagccttattcttttagtccatctctccaagcttctgaacccactaatactcagctttcttgtatggaaatatgtaatctttcctacattacacttgaaagttcagctcattcctaaacctccagtcaaggagatgaacttgttgctttcagagaggccacatctgtgcactgagccattatgccatctgttaaagtggtcagagttcattttattgcctcctttgtggaaggacttgtactgtaaaaagcctgtgttattgaaaacataattttcttcatcattatgctttctttctagccagatcataacctgctagaaatctattgagcatagagggaaaagctcttcagaatagctgttcttaagagattaaatgattgccatctctgtcccatttcttttatctcataatcaagttcaagatgatactgggtatctcagctgaagtgattatatatttgaaatagaaatggctttctctccattcatatttcatattgttgatggtaggatcttttttctttatatttatatatgcttatgtttccttataaatgtccacggggtcaaaggttcaaactacttttttttaaaaggctaaacatggctaacaggagttgggttacattttccaattttctgcatacaaagatactagttgtataactaagatctggcttagattcatcaaaattgagaactgaaccaaatcttagcaatcatctagcctagccattcagcttgacaagtgaggagcttcaaagtcatagcagttgagaaacttgcccagggcttggcagcagcctagctgagcagagagctcgctcctggggggtttctgctggaccacactgtctccctgccatattcagagtgggcctgtggtagttgcatatttacggcatggggggaagaatggaagatcttagtgactcagaagtgtaggaaacagatttgttatgattagttcaaagatgttcactttgacttttgtactttatcctgaaaactgtctgatctgtgctgttttcttacattgtcatttctcttccagagaatcaaagttagaaacacgatcatatccctgtttattagcagctctgttaaagcacttgatagagaaggaatatcaaattatttcctggaaatatagcccagggccttgggctatatgttgattgcatttatccacatgtctacaagtagtcaataatccgaaatgacatactgaaattatattttcttccttttaaaatatgtctagctgtcaatgagattcctcattcttaaaatttagtaaataggaaaaagtgagtcattatttatggttagtcactttggtaagctgtgactgtattttacatccatttttccttttttcttggactggagaatttattccgtcacttgttagggaaaatatatattagttccctcaatagcctcttcagtgcattaagaatcacaaggcaccataaacagaactttctgttggatacagcaagcaagttactctttagattgcagagctgaggagaataatccagaatcttgagctagcatccgaggagaaatctaaattatttatggtttctttaaaatggaataatcatttcaaaaatactatgttcattgagtatctgctgtctgtccatcaagttccaaatactgcaaggtttggaaaagatttcagacagaatcctttgtatgtcaggatgctttcatttccaagtagcagaaaatccatttcagactgccttaaacaacacagggaatttattgggtcagtgactaagagtcttgacataggggaggcttcaggcatggtttgtttaggctccagctcactgtgctgttctctgactctttccctcattgtatatagctccagtctcaagctggtaattaacacttaaaagcctgtgcacaaattatcgaatcaatgtaccattggagcatagaactgttgtggaaattgcacccttatggtaggaaaaggctgttggaatagcaagcctcacctctgcatctcagatgtccacattgaaagagcttctcaacttgcaagcaaaattcctagacttcattatgtttgtaccaattctttaccaaccagtagtagccaggggaggaatgacatgtgttaactggcttaagccagtcaatccttgagccagtcactgtggtaaggagagtgggattacagtcattggttaaggccagtgagctcccacttctagagcttggggtgggggtctgttcccccacaatcacacagctgctacatggcacagagcaggtaagatggaagttggggaagacgcaaacaatgtccatggaattgttaggctagtaggctgagccgagtgctaatgaggccactgttttgcctggcttatgtcgttctttattcctggcctgatctggacattctcttacccttcacagttcatcctaaacagccaggtccaccacttgcttatggtcagatgataactatacctctgcatccaaaaggaccctgtaagaatcttatattcagggataccttgtcctcactctgaaggagcacttaaagtccaataatactatttactattaatggactaaatattattaataagacatgtatattagacagtaaaaagaagactgctgcagtgttttttttctggttaaccctggcattttaattgcttggaacttcaaacttcagagctcttcttaaaggcaatatttaatttcctcccaaaaaaagcattttgcaagtagaggaatagtctgatctctttgaagtagtgagatctcttttacttgagtgagaatctgatatgacgtgctattgctgatggcaatttaaatgctctgtgtgaagtttcatctctcaaaataaactttccattgtgtcttaacctgggttcttcttgaaagcagagcctgatgggggcttgtgtacaggttgttgtgaaacagagaatgagggaatgcaagtgtctgtcaccaagctcattactactatgagcgattggagcttgatcccaccagaacctctgatgagccaagagaatgacctcagagttgtctacgtaaagcttggtattttcctgccataaggatgcagtcttcacaacagtcctgtgctcctttggtacattgattcaataattcgtgcacaggcttttaagcgttaattaccagcctgagactggagccgtgcaaaatgaaggaaagagagaacagcagagtgagctggagtgtaaactggtcaaggggttctacctgctctgtgcatgaagaaggccttaacactccttttcatgcttccacgtttggggggtagggggtgccaccccaggtgtcagagcagtcccaaacagcaaaagatactgctactggctcgggtgaggctttcccagcaatggctggagtcaaaggaggttgcatagcgtgggacgggcacaaagggaccccagtacacaccgaagagaatgcagcacatctgccaaagtcatgttggagcctagaaaagaccagaaatcatctgcatatctctttagtctttcctgtatatccgaatggcttttcttaacacatgtctttaaaaaggtaaaattaataaacacattaccagctgaattgctgtagagccctgcaggactctcatcaacaaagaggcaagcacgccagtgggaagaagcagcgggctcctcagaagagaaggctgcttgcgggagaggctgtcatcattacatcttcaattggcgggtcttctcatccccagcaggggctccttgcttggagggtaatttttactttcactgttcagtcagtatgacagctttgtccctaatgtagtggcagttttgactttggtttaaattattccataaagaatcaaagagaaaaagctgctctctcccttttcccccaccccaaaaattccactaagaaaacttttctcacttaaatcttggcctccacattaaatttctcattcacatttcaggtgcatcaaatatggcatcaactttcaaaatctcatgtgattatcacagtgactcaaaataattactatctgtcagtgcgtttgttgggaacacagatatgtctggcacacgccctattaccaccagcaagagtttgcctctccagtggggtcttctctgggctcatttcaaaaccttagagtgttgggacaatcatctgcatgatctgagaaacatgtgcctcagctgaccctgaaatcattttctttttaaagaaaaagtctttaaagcaattatattagtaagtgtagatttagctggaatgttcaaaaggattgccttaaactgtgattcctctggctcaatggttgtcaactggggtgattgtgtcccccaagggacacttggcaatttctggagacatttttggctgtcacgattgggcatgaggggtgggagagggtcctaccaacatctagcaggtggaggccagggatgctgccaaacgtcctgcaatgcccaggacagccccctctctgctatatcagagcattgtctggtccaaaatatcaatcgtgctgatgttgagaagcccagcgctagctgttgtggatttatacaatttgaaataaggccaattgtttggaaaattcagactaaattgaaagaaaatattttttcagttgaaaaagatataagtaatattaaggaatatcttaagacagaattacccaaaaccctaccatcttcataagacaagtttctgcgtagcatataaccttcagcttctgcccaaaagaatataaatgtttataaaattgcaattatgggtccgaccgcagtggctcacgcctataatcccagcactatgggaggccaaggcaggaggatcatttgaggtgaggagtttgagaccagcctggtcagcatggcgaaaccccatctctactaaaactacaaaaaattagccggacttggtggcgcatgcctgtaatcccagctactcgggaggctgaggcaggagaatcacttgattctgggaggcagaggttgcagtgagccaagatcataccattgcactccagcctgagtgacagagcaagactctgtctctaaataaattaattaattaattaaaattaaaattaaaaaacgaaaacattgcaatgatgatgcgataccattctgtattcttgctcccacttaaaaatatcactttcatagtctttatgtcattttaatagaaaagattccatcgtttcaatgtagtaaaatttaaaccatttcctttttctttctttttttttttttttttaagtaacttgggtaaaagcaagtactctagtctgaagcctggctttggagacttagacatggggtactcctgaataattttacaagaaaaatgattttccaagaaataaccactttcagaacattctaagaaattgttatgatgtcaacattttcatacaagaaacatttactccttgtgagaaacattgactatttacattttttttttttttgagacagagtctcgcactatcgcctgggctggagtgcagtagtgcgatctcagctcactgcaacctccagctcctggcttcaaccagttcttctgcctcagcctccccagtagctgggattataggtgtgcgtcaccatgcccggctaatttttgtatttttagtagagacggggtttcaccatgttgcccaggctggtcttgaactcctgacctccagtgatccacctgccgcggcctcccaaaatgctgggattacagtgtgcaccactgcgcctggcctataaccactttttaatacaatgaatcaaaatatttttacttttacaaatttgaaaactgttggaattcaactgaatggactgagtccagttctgcaaatttggaatgtatcctgtgtcatctgaggtcttcctgtactttgaagtccatagagtattgcctggaacctccattctacacctgggggattatgaagcacttcccaagattcttgcaaattcctagcaggcttatggctctgagttctcatttctctgagagaattcagtggatggatcatcctgcctttcccttcttgcttttcctgctctctgctgcacgttcagacagagctcatctcctgactcaatcttcagcccctgactcaacactgacaccccaaagtcaccatcccccacagtgtgtgtgtgcctggcactcccttggtgaagataggggagaggttagaacaggtaatacaaacagtttggaagtacataggaaacgtaacagtcaattgaaggacttttgatcatcgcatcattggggaatttcatgactgttcttatatggcatctccctgtgcctgtaccctctcttgtcttggcttgtcatctccttcctcccagatggccctaaattgttcataccaagtaatacagagcagtacttctttttttttttttttttttcttttttgaggtgggatctggctctgtcacccaggctggagtgtgaactcagctcactgcagcctccgtctcccaggctcaagtgattctcctgcctcagcctcccgagtagctgggattacaggcacatgccaccacgcctgtctaatttttgcctttttaatagagatggggtttcaccatgttggccaggctggtctcgaactcctgacctcaagtgatccacccacctcagcttcccaaagtgctgggattacaggtgtgagccaccacacccagcccagttctgctctcttgagtctctactcccaaaatcaattccaggtctcccttttgcatctcaaaaacaaacacaccaaaaaagcctttaatttcattgggcctacatttctagaagcagttgttgttagttaattatcctcttttacatctgcataaactttaattcctttgaaaagccatttctgagatagtctgtatatgtgtctatacctacgtccctgtgtctggtaaaaggggagctgcttaactggattgaagtgggtggtctttgactatgggttagaccatgtgtacccagtgttctgcattggttcacaatttcctgcttcttaactctaaattgttcagcctgacattcagggggttccctcgctccactgccccatgttttgagcctcattttccacagcttgtctctcatgtggtctcctctgtacctagtctatgttttgcaaaatgtggttgagcatggaaactgtaatcgacttacttacgggtccctgaatgatgggtctaaggtgtttctcaggcgtgcgtttgtttgtttgtttgtttgtttgtttgtttgtttacgagattgagttttgctcttttcgcccaggctggagtgcagtggcccgatcttggctcactgcaacctctgcctcccgggttcaagcaattcttctgcctcagcctcccaagtagctgggattacaggcacctgccaccatgcctggctaattattgtatttttagtagagattgggtttcaccacattggccaggctagtctcgaactcctgacctcaggtgatccacccgcctgggcctcccaaagtgctgggattacaagcatgagccaccacgcccagccacaagcgtttttagactcggtaaaacaatgaggtgatagtttctttctttaattccctagtacctcctgggaggtaatagattttctataatattatcagctgtttcctcagattcatttgttccacaaattcattcattcgacattcatcctctgctgtggggcaagaagtggggccacagcagcaaagaagacaaaggtcttgccctcctaaagtttctttcgagtcagggttggggggtgggaggtgctgaattttttagtgctgagggtttgttgatgacaccaaaacaatgcattctagtttcaaaactagagcaaactcacgttagggttgaatgctgtaacagaaacaagagggctttttaacctgatgacatttccttcctctcctcagccagtcactaattctacccacggtacatcttctctgtcacagtgatttgagtgtgggtgctatgagaccttccttcttcagaataattctgtctgcaatgaaaaacagtatttgttagcttttaaaatgatagctctgaacttgaatttcctctgcactctccgtgagatgaccagacctgcttgtatatatgcgatgacgacgaaaagtcagaagacattaagtatttcagcatgtctcatttgaaatatgaatttaaaatgatgatgccctgccattcattatgtgaataaaatgccaccccacacgttatgaataaactttccagttttaacagtgcttggttttactatactcattttatgatggaaagctctagcaaaggcagcaagaaaaattaggagttaatacaataacaggcggggtacaatggctcatgcctataatcccagcactttgggaggccgaggcagggggatggcttgagctcaggagttcgagaccagcctcgccaacatagtgaaaccccatctttaccaaaaaaatacaaaaattagccaggcgtggtactgggtgcctgtagtcttagctactcaggaggctgaggtgggaagattgcttgagccggagaggcggaggtcgcagtgagccaagatcacactgctgcactccagcctgggtgacagagtgagactccatctcaaaaaacaaaaagttaatacaataacaatgaggtcgtttactgagaaagtcaggcaaagggatttgcttctctacaagcattcagcatctcaataagtgaataagcacactcgcacacacacaaaatattatcagaagcagtttattctaaacattatttttctaggttattcacttaactcaccctctgagatttatagttcaaccataccagttcagagtggaaagaaaaaaggccgtttatctaatccaattccttgggaaaaaatacttaggcaatattaagaatcctcaattatctaatttaataaaagggatgatttatattctgtagttagtaacgtgatactgattatttctaatcccttagaagagatctgacactatgcttttggtcctgtgtagcatgaaatcatcatgtatattttaccaaaagaagtaacaagaataatggcctctgcagtctgcaatcattttatatgaacacactgcaacatggttttgccctggggcagagaagtagggatttttctctacttcaaaagaatgaaaaattatcatcactctatccagaaccattatagacttcagagactttggcatgaaatattcagaaagtttattttagaattcaatattttaaaagcctgctttaaaactattacagtgattagtggctctcttgcttgggccagtctttgctttaaaaagtcctatgtcatggttgatacgaatttgatgtttgaacaaaatataattggcatcaactgcagaagctacttgtaaggcattgttttagaatgcccccaaagaggagttgggaccactactcaccagttatgctttcaaacacacttttttttttcttaattgagatggagtcttgctctgtcacccaggctggagtgcagtggcgtgatctcggctcactgcaacctctgcctcctgggttcaagtgattctcctgcctcagcctcccaagtagctgggattacaggggcccaccaccatgcctggctaattttttgtatttttagtagagacaaggtttcaccatgttggcctggctggtctagaactcctgacctcaggtgatccacccaccttggcctcccaaagtgctgggattacaggtgtgagccactgcatctggcctgcatatgtttttgacatatcacagaaagacatgtgtaagataattagaaagagccgtttctttttttcttatataatctgtgtatttggcttcatctctttaaatatgtggaatatattatttctgtaagttttaataaataccctttctttcctgcaaacctttattatcaatgaaaaaacaggcatcaatctcagccttcaagtagataaaataggttcctctctcacacagacatgcaaataaataaagattctaatgtgctctcggtgcataggtgttaacgagaataatgtgtaaatgactttttgtttcattttccagggaagtagatcgagattcagatggtcacgtcagctttagagactttgaatatgccctgaactatggacagaaggaagcctaactattgtgaactacttttggtaactctggggagatcaatagattgtaatgtcagcagactcgactctactaatgatgtcatgctacagacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcatgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacatgagcaagccctctcgggctatatacagaggaagaacagggtgatgagggtactgggggcaagagacatgtttgcagaaccctttaggatggtctaggcttgggagtctcactgtggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcactttgtcacctaagctggagtacagtgcgcgatctcggctcactgcaacttccgcctcctgggatcaagtgattctcctgccttagcctcctgagtatctgggtttacaggtgtgtaccgccacacccggctaatttttagtagagaaggggtttcaccatgttggccaggctggtcttgaactcctgacctcaagtgatccgtctgcctcggcctcccaaagtgctgggattacaggcgtgagccaccatgcctggccaataaaaataaagttttaaactgtcaaataagaggagcctaacaagatgtgacaactaaatgtcatttggtatcctggatgagatcacggaataaaaaataaacattggccggacacagtgactcagcctgtaatcccagcacttcgggaggccgaggcgggtggatcacgaggtcgggagatcgagaccatcctggctaacacggtgaaaccccgtctctactaaaaatacaaaaaacaaaaaaagattagctgggcgtggtggcaggtgcctgtagtcccagctgctcgggaggctgaggcaggagaatagcatgaacctgggaggcagagcttgcagtgagctgaaatggtgccactgcactccagtctgggcaacagagcgagactccctctcaaaaaaaaaaaaaaaaaaaaaaaaaaagacattaagtagaaacaaatcaagcatggactttagctaataataatgtatcactattggttcattaattgtaacaaatgtatcctactcatatataatgttaatagtaggggaaactgggtgaggtatatgggaaccctctactattttcacaatttttctataaatctaaaactattctaaaattaaaaattcatttaaaaaataaagtcttattcaaaacctgttaaactaaactttatctaaaatgaagaaaacattgaaaatcaagtaaaaataaaatcttatttcaaatacaaa

SEQ ID NO: 573 - DNA, 380659 bp, Homo sapiens
ggcgcggagggatccggaggcgagccgagcgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggtaattgcgggctagcgagcgggagtggggcggcgcggcggggctgggggctgcggggcgccgccgcgtccctgccggagtgggggcgcccccgtcccccgcctcaactccgcgcccctttgtacagcgcgaaacccggggtcccctccaagttggggagcggagtgggggcggaggctcgagtcgcgggcgctcaggcccgctggcggcgcgctcggcctgtgcgccccgttcggtgcccgactcgggccggcgcccaggctccggggcgcgcgggagatcgggcggcttcggccgcggagccaggctcattgttcggcaggtccggggcagggcagcaaaagtgggaggaggccgagcctggggaggaggacgccggccgagagcgagactagttgtcggggtttctgttttctgtttaaaaacgccccttggatgagctgggggtgctttccgacctcctgggcccgccggggacgtccgggcggcggcggccgcagacgcgggcctgcgagcggcgcgttccctgcaacttgtcagttctattgttgccgagcgagtgagtcacttcgcatctccgctcgccgccgctccgctcgctggacgccgaattgcccctcaccccgctcctcgagaccccagccgcggccgggcccggcgcgcggagcacccggcggcggcgcggagcagggggcgccgaggaggtggcagagactggctcggaaacttgggggagaggcggcgagttgcgggagccgccgcgtcgatctcgggccgcggcgaggaacgcgtggattccgggacccggcgcgggcactgagccctcccgccccttgctcgcgccgcggtgggagcgagtcggggtcctggaagtcatcccggcgcccccagcgctcttgcgtaatcttccccagtacctctctctgttccctcacacactttgggcctcggtggtctctcgctgagcccgtttcctctgccctaggacctgctagaagtggccgaagatgaatccccagcaacaacgcatggccgctatagggaccgacaaggagctgagcgacctactggacttcagtgcggtatgagagctttccatggcatcttggggttctgctgaggtttttgtttgtttgtttgtttgtttcttttaaataaagggtgaggggaagcaacgtggagactaggcagcgtgaactccatctgctttctgcttaagcagtagttctcagggctggagtccagctcccccaagttggacacctgaactttgatgtaatgtctagacttgcacatttaaaactttaatgccagaggggtcatttgatttaaccagttaaaaggagaacaatgtaattatgacctttggttgagtcaccctcccaccgcgatgattattggggatcttgtactttatatgaaaaagtgttgtttttttcttcagtactcctcaccattttcctctccagtatcagatgtagtttatggtacctgaaagatgtcagcgacaagaaaagtagtccagagctagaatttcgagccttctgaaacagagtacttttattttatacacacacacacgtgtgtgtgtgtgtgtgtgtgtattatgttcttaacatgggaaatgacttaaaaacatcaactgaaacctaagggcccactgcttttatttttaatgggtttaattcctttattaactgctgttaggaggcagcacctatacctgctttatacaattcagttataatccttactgtatgtagtaatttaatgggccataattctgactgtgtatattgagatataatgtaaatgtaatgaaattcacttagttctgcagtaaagatcatgtgtaatactatactgtttaaacttaataatcttggactcttccatgtaaatgatcgggtcttcagaacaaaatgtaaccattatttccaattaattaggaaatagtatcattcagtgtatttgcctctctggatctgaatgtatctccaattttattttaacttccctctgaaatttaataactgatggatgacttttggtggacttttgtttgcaaggaatctagaagaatttcaggactaacagatatatttgggttattttgcagatgttttccccacctgttaatagtgggaaaactagaccaactacactgggaagcagtcaattcagtggatcaggtaagatgatgtcttaaactaaagactcatattttggtggtgtgatacattttagtagaaaaatagaaagcataacatttaaatattattgaatatatgtatataaaagatggaattgagtcaagtgataattagtaagatttattaattttaaaagatgacagttccctcagaaatctgtaggaaatcagtagtttcgtttacaattatttaaaatgttagtggggtaaattttcaaaatgaatagaaacttagatttatttttaaatgataagtattagatgactgaatcctttcctatatccagattacattatgataatgtttagagtaagttaaagtagatctacacactagtgatcttgtctttaaatttactttcaatacatttatgactactgtgctccattttaaaacatcccatttttcttaagtatgcattttttctttttttaacttttaaaaactcataatttaaaaatattttagaaggaaggtccattccagtgtgcaaaagctgtaactttttatttaatttaaatttatttctttgtgcttaagagatgaaaaaaataactaaagccatgacagcatcatcttaagaaaaccaactgtcaaatctctgggctgaaactcagtaatgcctctttgatgggtgctttttatttcccctggtaaaatgatagttggtttcttaaaatactgtgagaataaaacatcagaaaataaggttaatttcataaccacctaaacactttataccactttacattctaaaaagtttgtttttaaaaattgtatactaatttattaaaattcatttttaattatgaaattagagcttatggggaaagtatagcatgtccttaatcatcttaagtaagtgaaatgaaggcattttttggattttaagtagggtaaagactagtattattcttgatcaaaaggacatcatgaaacgataggcaagtcccaactcttctctcacctccttccttttactggtaatcatttgaaaattgttactttttggggaggggggagaaaatttaataatcttaaagttgtagaagatggctgtatttctttactggtgttgatacatctcatttttgcaactaataattcattctcaggaaccttcagatttactttgactaatacatagtagatgatgcttagtattttttaaaaatgagtcttgatattactgttgcctactgttccagcttaagttatggtaaatatatataactggacagtcactgatacaataacatgaactccaggaacttgctgttagaagtgcattctatttttagaataaaggcaattacatttatttcactttttaaacttaagaaggatttatgtagtctgtgaaattaaaaagtatgtgaactgggatatagattataagcatggcattggagcaatttttggacttcagtacgttgcattgcacaaagaaaaaattatttttctacattgcgaatggtcaccatatttgattatttggagtaggaacttttagttttaaaagttagatttgttatccattgaaaggtttgaacttacacacctgtagtcagtggacttagcaatatttatctgtgtgttttgttttaaatgctacaaaaaattgtaataaaaaagctgtgacttttaattagtgaatggatttgaatttggggaagagaaaatgccatgtgattttttttcaaatcaagatgtactggtagatataatttttctgtggccagttcttaaagggaatgtctaaaagaaattggtatagtaacattattttacttatatattttatatttatataccttattgacatttgaataaccttctgccctgatttcaaaggatattatgtaatacactctaatgcctatgtatttgcagctattaaggagctaaagatctgactttccttttgaagagctgctgtagtaaagattagggttttttgtttgttttctgttttgtctttggagtaacatttataaaaactacatgccatttgacttatgaaaactagagtttatagtcaggtattgtaatttcctttcttatttgtcctttttgaggaagactcaatttcacagtgggctgtttttgagaaacgatatataatactttcagaagcttttttagctgaaagaatatatactatagcatgtgatgttatctttaatcttattcctgaagcaaaacaaataactcatcatggctgagttatttatgagtgtcggaagtcactctggaaaagataaaggtgtgtttactactactaatttgtcttgaggatctgttatgttattccttcatcagggtgttaaaattttcttcacgttatggtgagagtgaatttgttcacttggtatgataggctctgtgaagtgttcctaaagtgaccttgagagaaacttttctttctgtaggagtgaaaggtcaggcactctaattagggcagtgtatagaaacaaagggcagtgtatagaaggaaagttggttaaaaggattgacaaaatggaaatggttcagatgtttaaatccatgtcctcaacttcggggtttgagtgtgtatgtctagattgtgattttgggttagtttttagtagattgtttgtatgatatctgaaaatttcctttgtttttgaatccaagtagtaagggatgttgtcattttgtaagccatctgtagatattgagcatctctctggtgtttctatctagaatgtcattttaactattaagtaaagcttcactttttcttattgaattcagacgtttgtaacagtatagtttctttttgcccaaaattttcagagataattgtaggaagtattttctggctcttaatttttaaaaaggaatacagtttttcatttttcagttactgatctttttttgtggggcggggggttatttttagatgtacttacaggctttttgaaaatattgacatagggccagaaaaatgaattctcattaaattactcttcagtatttctatttttagatagttgtagattcatatgcagttgtaagaaactatacagagattctatataccctttacccagtttcctgcaataatagcaccttgaaaaattagtacagtatcacaactaggttattgatagtgatacagtcaagatgcaaaaactgttctgtcaccacaggaattcttggtgttggccttttgtaactgcatccacttttcaagtaattaaaaaaatggtaagattactaaatgccttctttctctgttaaacgtggagtaagcttttcaaattgctgtagcattacttgaacatatcaagaacaaaatcaagagaaaaccaaaattgtaccactgtaggtttttactgaactgtgatagaaataggaatggtgattttagagaggaaaccaggtttgacctttcacttaaggtattttaaggttatgagtagggtgtggttcatattatgtacatattagtgttgaaatttataatagctataatttgtagtaaatacatacttgttaatattgagccatgttagacatttgtttcaggtaagctgtagttattaatgagagtaaccacagagtcagcaggtgtgtggggaaaaatatattttaggacaaatatggtctgctattaagttgctcatttaaggtaaaaggtagcaagggagtcttttagagaaaacctgtttatgaaaactcatacttggaaaacataaaaattagagacaagattacaaccatgagtattgtatacttttcaggacaattcctgaacaattgaaaaacaaggtcgggtgtggtggctcatgcctgtaatcccagcactttgggaggccgaggtgggtggatcacatgaggtcaggagtttgagaccagcctggccaacatggtgaaaccctatttctactaataatacaaaaacttgctgggtgtgatggtgggcacctgtaatcccagctactcaggaggctggggtgggagaattgcttgaacctgggaggcagaggttgcagtgacctgagatggcgcagccagtgtactccagtcttggcaacagaatgagactctgtctccaaaaacaaaaaaaaaccacaaacaaatggtgtccaccgcccccccacccccccgccccaaccccgtagtcattgcttataatggatttgaaaaacaatttgattagatcacaacattttaggggcttgtttattatatatagtgaggcatacctacaattactgtttttgttttcattagccatttaaacacaaattcaagtttctgtcttcaaggtatcctttgctatatctttgagtttttaaacaagccttttgaaatgagaagataaagatgaagatatccaaccttgactataaacaactttcaaattttatacttaattgggcaataaacaatgctgtcttattaaagccatatagtcttttctgctcttaaacaattggtagtcttttcctggaatgtcattgtctgcctagtgttgtcaaagacttgggtaatcttgctgaaagaaagtaaaagtagcactattagaaaggctctcctgaaaaagaaaaagaagtgctatttgtggacaatgtgtggaatgcctttttaaaagatcatttaataagactgcttttgggtatcacttgaaagtatgtttatggatgggaatgttgaaattgcaaatctaaattgtttgtgtttagggaagataatgagaagacaaacacttaaatatattcaaaagactaatgaatgacagtctgctttgttaaatagttgtgccataagtatctcatttttatcagttaactatttagtatttacctatgcattcttctagcagtttttgggaagatgggaaatggagaaggtcattgctcagaaaaagtggagacatttcgttggcgtggtggctcacgcctgtaatcacagcgttttgggaggctgaggcaggcagatcacttgaggccaggagttggagaccagcctggccaacgtagcaaaaccctgtctctaccaaaaatacacagaattagccaggtgttgtggctcatgcctgtagtcccagctactggggaggctgaggcaggagaattgcttgaacccaggaggcagaggttacagtgagccgagattgtgccacggcactccagcctgggtgacagagggagactctgtctcaaaaaaaaaaaaacagtggagaaatttattattttgatgggaagtaaaatactgaggtaaacttctctaacatagaaaatgtcaacaaacacacattattgtagtttaaattgagtccataagaaagaggctgtgctgaagagtcagggaactggcttaaggaaaactcaaaaatgttgagtttagagttgacttgtgatggagatatggacaatgaattagggaagagaagaactggtcttacagctgaggaatagcatgaggagagacctggaaatgggaatttagcttgatccaagggcctgtacagttcagagagagagaagctggtttttattaatcaccactccttaattcctgggggagctcatatttacatattattatctggagctggactacaggtgttcagatccagaaattaccagtgaatagcacagtgatcttgggtatgttcctttacttgtctgcttctgtttcttaatctataaaacaggactaataatagtcgttatccttataaggttgttaggagtgttcaatgagttaatacatgtaaagttccaagaatagtgcctagcacatagttagctgtggtggagtaaattgttagtggtgagacactaaaataaggaaggcatttatttactttggaggcctttatgctaatctaggatgagctggtgaagggttagatttggtgttagtgtagggaataggaaggaaaaataacagaagtaaaggattgttagaatttgagggattggctttctgtaggtaagagaaatgactcaagattgcagttctgacataattggaggatagtagtgctggaggtagtaaagatgctgaattgttttttgcattttatatttcacatgacctgggactcttctggctaatttggagatgtatgagggaagcatgctcggtaaagatgttggttaaaaagaagaccgtcttttttctgcatataaagttaatacatagtcataattgaaaagaaaattagagaacagaaaaagcaaaaggggaaaaattagctttatttcagtatccagagaaaattgatttatttcctttttgtctttttttcttatagttccgtttgcaaagctggtaacttaatgttagttcatttatgtcctgttttttgtttcacttaatcttctaccattaacattttctcctgttattaacttggcttaaaatagttgcatgctcttaaatggaatgaatatagcataacttaacaaatccattcttttattacttgacctttatggatttttgttaatttgctttttgatatgataaataatgtggtactgaccacctttttgtgtatgtatatgtttttgcccacattctgatttcttttggttaggagatgcaaattttgttttttgtgcctacaagttaataattaaaactaatgaattcccttagggaaatgaacacagagggagataaattatcaggccagggattgatgttaatggtggagttacatgtataaaattagtgactttggttgattatttaatgtaataatacaaaattttattagtatgtgaatggaatgcattatgacatttggagcacatttgtgcttgtatacaaatgtgttgtgtggtgactggagggaattcctgtcattctttgacctgtgcttatagaaatggagtggagtctaattggagtcttgtcagtgagagagcccttgaattcctgactttttgtgagagagacaatatagtgtattggaaagaattgggctcaggagccagacaactggattggaatcgatgacttgcagcttactagctggatggccttaggtgagatatttaaataatcagagctatacttttttcatttgtgaaaagtgggtaataatgcccacctacagaatccttgtgaagattaaataaggttatctatatatttttttcctataaagctgcttaaaaaatggtagctgctattattgtggtaccttctaactagcattctcggtaatactagtgattatattagaaatcattataaagccagtattatagctagtgtttattgaactcctattatatactaggcattgtgataagcaatttatgggcattatctcattttactttggataaaatgaaatgttttgtctgtggtgttggaagtgaggcaatacccctacaagagcaacaagtcagagttgcttttagtgccataaaattgtgtatatgaagtctgagaagtaatcaggcatacaagtagttttgaaaagtcatgaagtacccaggaaccttaacttttcttttttagttgatttattcttaatgttattattttgtagactatactttgtagagtgcagaataatgaagagaatgtgtacaccttttgaaaatccttttccatgcttaggcatcaccgccacttgaatgtagcattttgtccatattctttctccagctacttgaaattctttctggagtgaggcatagtctaaataattaagtaaaataaaaattacttgactggaaaggatagaacgcctgggaacaggttggagagaatgttaagagtctctagggtagaacgtattcactttttttcttaatggcagagaagaaggaacataaactcccttggtagcctgaagcagcacgttgcaagtgagtggaagaaattgtatcttaaaaattcatgtacattttattttctacttgctaccacaaacatatctgtagtaatttaaatatgttttcattaatcattgagtaaaactgaagttctaaagttgcatcatttttgggttatggcattaccttcctcctgttttggtttgtatctttggggataagggtcagggtggaatggaatgctggccaatccttaatgagaagcccaactctagagcatatctttagctgtattttttcatgcaccttttcttgctcctatagaagcctgtaaaaagggatcattacatcagggggaaaaatggttttggtagaaagaaaactgttattttcataaactgaagcacagatagttttgttaataacatgactgttatttgaaactttcttgtttccagccagatcattctgtaatttttaaagatacccttgacttgaaaagaaaatgtaatttttatagagagagctttggtttttttttgttccatgtttaaaatgtgctctcatgtgttccaggttaaaaatgtgctctcataaagaccatggtgagtcatccaagctactgtaagctgcttggggacctaaagatcacatttaaagatcccacagaaaagaaaatgcattagagattggttactaatttttattgcagtgggtggtgactcagggatgaaaccttcaaaataatataataaaacaatttgagataaggtacaggacagaaaatactacctttttttcccttaaaaaaccactactaccataacttactgtattttggttattaaaattgggataatttggcccaagatgtcattttatcagctctgtggtgttaggaaggtgcctgaatttgaactgagggagtttctctaaatttgtggtaatctatggaagatcattctagttgccaaatggaagtctctctggaggcggcctccctcaaaagttgtcagtgtatttgcttctgttagttttgcctgtgagctatttccaggctttaaaaatgaacaagattgactcataattactctttcatcacttcattggtagctgatacagtgaacacaggttggacttaatataatcatggctactccagtcagtgagtgaatgtgctgctgctgtcggcaagagttgtgaatgttggttgggcatggaaggtatctctgctgggagggaattacagtcatccagcttcttggtcccagaggcatatgttgttgttttgaggtggttggggatgaataagtggttggtttgtacctttggagtgtaaaaaatgctaggctcactttaaacagtagcgtggtttgaccacaggtcagtttagaaaatctgagcttatatgggcacttgtgccaagggtaagaatctttgagttctcctgcaggatccttttaggtttttcctatttggaaaccccactatatctagccaactttgtcatgtggtccggaggcccatttacttaatctacttggtactgacatactcggattttagaaaatgttttttagtgttattctcagttgggaatagagttaaagggaaaagtgtttcatgttgaatctcttgataggaacatataagttaaaatgattgtaactttccaattaggtagataattagaggcattgcaagactgttctaagtatccttaatatcttttatctaagtatcagctagttttttttttattctaggtgatagcatattttatttgtcaagatccccttttcccagttagagatccacagtcccttatctgcagttttgaaatccaaaaagatctcaaccacagttaacttcagcatgaagtattttgatggctaaatctgatcttatctgaagggaggccattgacattctctattttcctagttcctgtgtggttgccagtagctgatttgtagcgtgtgacatatatacctatatactatgtttcctttctaaaatctgaaaaactgagttctaaaacccacctggccccatggattttagaaaaggtattatggagatctgtctctctctctctcctcctcctctccctcgttccttcaccccccaccccagggattgttttcaactcacagtaagaactttttgttctcaaaagtctcaactagagacttcatcattttaaatacagaaaaaaaaattgtggtggacttgtttatataaagcaaattcttcttggaatataagcttttcaggctgagttttattctttgagtagtccacccaatacattgatttagggaatcaagatctgttttgaggagagagaagctttctcatcttttgggccaaggagtgtgctgatatttctctggtcagttaaagcatgcagagaaattttcagggtaaaaatcaggagtgtagaattcttttcatttggtccccattttgtatatataagaagcattatatgatctctaccataaggaagcctcagccctgaccatacttttttgaatttttactgagagcaaacagttaagaaaatcctaatcatcttcaagaagaaaaagtagagccaagatactttgctgtagggaacagacaaaatcagtctttggtaaactttattctttccttttatattggtgaaaagttttcatagattagtagcatgatgcttattcctgaaatatactcattacaggcatcttaattaaaaacaggttatgattctgttgagtgtaaaattttcctcaggagcttgttattggctcagacccactactgtttaatataaactaagaaagtagtaatgaagtgtgtaataaactagtttgctgtagtctgttttgagaggtagaccagtaagccattgacttttctggtggctttgcaagcctgttgcttgtactgttgctagtgttattgtcttaagaaccatgatacaatgttgaataattaaatccacttaaagtttgtaggggtttgagatgctgtactgcaggaacacaaaacatgccatagtgccagggtctctcttgccttcatatttgtataatccctcttctcaagcttaggaacagtgcctgtagcgagcagactctattctcactgagtttgactctggagacttgccaaataagttataatagcagtaggactttgtccactgaatgattgggagaaggggaggaatcttattgttttaaaacaaaatcagtgatgataagagtgcttcataaatatttactcatatgctatttacttcataactcttgtaggaagttggtaactgttcattttacagaggaaatagagaaatcaacagtgaaatacatttgcctgtggtttcttattgcccctcagaagtagcaaactctaatcagttgtagttgcacctgcactgataccaatctacaagagcatggtttgtcttgaggaggaatttagtatctctagaaatctttgaaatttgttataataagaagtcttatctgaagccaaggtgacaagaagaaaaaaagaagtcttaaatggggtactgttgatattctccaaaagtgcttcaagatttatttatttaattattattattattattattttgggagacagagtgtggctctgtcgcccaggctggagtgcaatggtgcaatctcagctcactgcaacctttgccttccgggttcaagcgatttttgtgcctcagccttccaagtagctgggattacaggcacctgccaccacacttatttttgtaatttttggtagagacagggtttcactgtgttggccaggctgttctttaattctgcccaccttggcctcccaaagtgctgggattataggtgtgagctactgtgcctggccgatttatttttattaaggagaaaacagtataattaaaagcctccataaaatagttaattaaggactttatttttagtatttcaagacattaaatataaatagctacaacctcagatagctttataaaagtgtaattctttttttgtgtggtcttattgttaagctgtctttagactttgtgagttgggaagaatatgaaatttgatagttggaagatattggaatattcacagctaccatttagttgaggtcagagaaaagaatggttacttcatagtatggaaaatttttattatttcccctttttcaaagatttagtgtttagttataaaaacaagttaaagtggatggaaaatatttattccaaaagtagtttaaaaatgttatcaaacatacagaagatactttaatagaacagaacttttaattcattaaatgaaaggtaataatgctaatattgaaagggttaagattagttcattttgtatttttatttacttagaagtagattgggctgttgttttgttaaagagcatctgtaggtatttgagcgagtacctactaatgctctgttttttgttctgtgtagaatggtttgtttaaggtagtggaaaataaagatacattgtggtatatttgaaagaggagcagtttggagattcgaagtcttgctttagtgttggctttattatttactagatatgtgatcctagggcagaatattttaacctctctgagtctgtttatcttatgtctaagatgaggacaataaaaatactgcctgagggtgttgtgataatgagcagattaaaagtttttatggaaattctaaaatgtggaggtttgtggtctgtacagatattagttattaggtggcatagcaagtcttgaaagggattccaagcttttcatatacatatggagagagggaatcttcatataaaacttaaacatttctgatggtcagttattgaagattaaatcaggtgactgagaggaacactagcctatggaactccttataatttttaatatgtaatttacatattattttacatataaatatatatttcatcagaatgaaatatatataatatttgtatataattcatcagaatgtcagaattctgatgaatcatcagaatctcttataaattcatcagaatctcagaattgtttggatgagtctttttggttaaatgggggaaattgaagcactaaagtaaaataaatcctcagacatagtctttgtgaggattctgttaattgtattccaaaccatagagcccccatattagtgcccttcagtcctttattctcagctcagtttttaaaatgcttgttgaggatctgctgtagtgacaaagttaaccccaggcttaagtatgaatgtgtgacagctgaatagttcctaggaatagtctgcttctactttgtactgataagcagtaatctcaacaaaattttagtgacactaaagagttaacgttttaaagagttaaaaagttcagatacacttttatactcctgagtgaggaggagacgatacaaagaggaggttatgaaacgctagagaaactcttgtctgctgtaagcttatgcttgaaggaagaaagtctgacttagtcatatccatgaatgacaggacttggatctgtctgctgatgacgctgctgtttcctggttcttcgtgattaggactttgtgatgaagatgctcctgcagcatccagtattgtccctttccatttagagtgtctgtctgggtatataaaatagctgtcttaccttatattgggaaatattgggattttacatgacttcctaagtatcttatgcgattgtattgtttacaagtttttacattattttgaagaagggaattgacaaatccaaagtaaggagactactgggttcctttggaacccagtgccggtagagccattgaggtagctttgatggaggtcagtgtacttgtggccttcataggagctatttgctgattgttcttcagaataagacattaactgggtttgggagaaaagggtcatggaacgatttgacagttgcgtgactggactcaagaaaattttggggcttctgtctcagcttctctctttgtaataattcctaatgctttcttgaagatctatcttaaattgcaacgatgagaatagctggtaggtgaaacagcaaaactaaagaccttggaaacggatagtgagggttcttgaatataacttctaagaatcttggggccaagtgaggtagcttatttttctctgtagctaattgcttgctgtgtaatctgttgctttgctactggacattgcagtagtctccttacttggtcttcttgctgccagttgctctctttttccaatctgtcttagtctgcttgggctgccataacaaaataccatagatttggtggcttacacgacagaaatttattttctcacagttttggaggctaaaagcctgagatcagggtgccagcatggtcaccttctggtgagggctctctttctggcttgcagagggataccttctcactgtgccctcagtgtatgtgtgtgtatggtgggagggtctcatatgtgccctttggtgtctctctttttttaaaaaaattttttgtttccgtaggtttttggggaacaggtggtatttggtgacatgagtaagttctttagttgtgatttgtgagattttggtgcacccatcacccaagcagtatacactgaacacaatatgtagtcttttatccctcaccgccctcccacccttttccctgagtccccaaagtccaaggtatcattcttatacctttgtatctcatagtttagctcctgcttatgagtgagaacatacgttgtttggttttccattcctgagttaacttctcttaggacaatagtctccagttccatccaggttgctgtgaatgccattaatttgttccttcttatggctgcacagtattctatcatgtatatatatacagattctatcatgtatatatatacagtttctttatccactagttgatagatgagcatttgagctggttccatatttttgcaattgtgaattgctataaacgtgtgtgcaagtatttttttcatataatgacttcttttcctatgggtagatacccaataatgggattgctggatcaaatggtagttctacttttagttctttaaggaatcaccacactgttttctgtagtggttgtactagtttacattcccacaagcaatgtagaagtgttccatttttaccgcatctattatctttttatttttttattatggccattcttgtgagagtaaggtggtattgcattgtggtttggatttgcatttccctgatcattagcgatgttgagcattttttcatatgtttgttggccatttgtatatcttcttttgagaattgtctattcatgtccttagcctactttttgatggggttgtttgttttttcttgctaatttgtttgagttccttgtagattctggatattagtcctttgtcagatgtatagattgagatgattttcttgcactctgtgtgttgtctgtttactctgctaactgttcttttgctgtgcagaagctcttcagtttaattaagagctacctctttatctttgtttttgtcacattgcttttgggttcttggtcatgaagtctttgcctaagccaatgtctagatgggtttttctgatgttatcttctggaatttttaaagtttcaggtcttagatttaagtttttgatccatcttgagttgatttttgtataaggtatgagatgaggatccaatttcgttctcttacatgtggttttccaattatcccagcaccatttgttgaatggggtgtcctttccccactttagtttttgtttgctttgttgaagatcggctttaagtatttgggtttatttctgggttctgtattctgttccattggtctgtgtgcttatttttatactagtaccatgctgttatggtgactatggccttacagtctagtttgaagtcaggtaatgtgatgccagatttgatctttttgctcagtcttgttttggctgtgatggctcttctggttccatatgaattttaggatttttttttccagttctgtgaagaatgatcatggtattttgatgggaattgcattgaatttgtggattgcttttggcagtatggtcattttcacaatattgattctgccatgattcatctgtgagcatgggttgtgttcccgtttgtgtcatctgtgatttatttcagcactgtttggtagttttccttgtagacgtcctttacctccttggttaggtatattcctaagtattaaatttttttggctgctgttttaaaacaggttgagttcttgatttgattatcagtttggtcgctgttggtgtatagtagagctactgatttgtatacgttaatttgtatacgttaattttgctgaattcatgtatgagttctaggaactttttttttttttgagacggagtcattctgtctcctcggttggagtgtagtggcgtgatcttggctcactgcaaccttctaggagctttttggaggagtcttcagggttttctaagtgtacgatcatatcatcagcaaacagcaacagtttgacttctttactgatttgggtgccctttttctttctttctcttgtcgggttctctggctaggactatattgaatagaagtggtgagagtgggcatccttgtcttgttccaattctcggagggaatgctttcaacttttccctgttcagtattatgttggctgtgggtttgtcataggtggcttttattacattgaggtatgtctcttatatgccagttttgctgaggattttaatcataaaagaatgctgtattttgtcagatgctttttcccacatctgcatctatcaagatgatagatgacttttgtttttaggtctgtttgtgtggtgtatcacatttattgacttgcatatgttaaaccatccctgtatccctggtatgaaactcgcttgatcatgatggattatctttttgatatactgtttgattcggttagctagtattttgttacagatttttgcatctatgttcatcagtggtattggtctgtagtttgctttttttttctttttttttttcgtttcttttctttttttttttttttgagacagatagctagtattttgttacggattttttgcatctatgttcatcagtggtattggtctgtagtttgcttttttttcttctttttttttgtttcttttctttttcttctctttttttcttttttcttgctctgttgccaggctgcagtgcagtggcgcgaccttggcttactgcaacctctgactccctggttcaagtgattgtcttgcctcagcctcccaagtagctgggatcacaggcacgtgccaccatgcccagctaatttttgtatttttcatagagacggggtttcaccatgttggccaggatggtcttgatctcctgaccttgtgatccccctgcctcagcctcccaaagtgttgggattacaggcgtgagccaccgtgtctggcctgtagtttgctttttctgttgtgtcctttcctggttttggtattacagtgatactggcatcatagaatgatttagggaggattccctctttctctgtcttatggaatagtgtgaataggattggtactaattcttctttgaacgtctgttagaattctgctgtgaatctgtctggtccgagacttttttttttttttttttagtggtaatttttttattaccatttcagtgtcgctgcttgtttctttgattagggccccccttcatgacatcatctagcctaaactaactttcaaaggccctatctccattggggatccatcacattcagggttaaagcttccacatatgaattttgagaggatgcaaacattcagtccataacacagtccatttcatacacttaaaacctcttcttctgtgatttgtctcaggacctactttgttccctgctgggtatcaaaacaattaaaagtgtcaccttagcatttatgttctttaataatctgatggagacttaccttagccagtcttatattcactgcttttcaatctgaattgtgtggttctgtgacactggtctctcctcacctgacctcctacttccagttattcttcactctcaacctgcaatactgtttgccattcttgtgcggtttgaattttctttcatttacgaaatcttccccagccttttcaggtgataattttgtaaaaatgtattccattaaataaaactgtctttgtatttgtatacattgtatacaaatgtatacattacaaatgtagcattcacttattttaaggactcttgggtggaggacagtactaattcttttttttaaccactgaagacagagctaaggtcagtatggcagctatgcctagtagattttgagtgcaactaattattgtataatagctggtcagcctcctgagttttaaccctataattaaaaaaaaagtctgatgcctgcttttgatgaatattgaacaaagtatttctgttgggaaattctgaggttttacttaccctaacattttttagaatactgtcatttggatttttttgttgtttactatatgtatattagacagattataaactctgtggaagcaaagatagtgctttacacttgtgtttctgcacagtaccatgctttgaggttaataaacacttggtaactggctatttgatttagggttggagatgtgtgataggttggtggaaagatttcacattccccaaattgcattttctttcctagcacaagctgcatggtgaggctttaaggaagcaccgaaacttacgttgattagctgagtggagacgtgaggtgttcatttttgagaatgttcccttgtgttcttacttactctgctcaaggatgagcaagaagtggccaagtagtaaagccatggaggttgtatgtgaaaacagctggttctgtagaaccacagtcagctctagctctgaaaagcaaaaagaagtgatactttaatagcgtgttttttttttttttttttttttttgacagggtatatagcacttttggtctttagtaatgtgagactgaggggaaaatggcttgtgtgattctgggattcattggctagaggagctctgttttatgaggactctaggaagccagtagctggccaacactttggaaacaatattttttctaaaacgaccttgatttttagtccagttgggccagggaggagaggttatataatctagtattatagtcaatgtgaggaagcagtcataaaagcagaagaagatagtcttatttaatggaattatgagttcattttcctggtcaatttgtggtagaggtgaaccttttatttaatactctaaatcgtctttggttttagaatttggggccaaagctgcttttgttgattgtaggaaatatgttgtcttcatattttgaagttagactgcacatctagacatgatgtctttagcaattgtttcttcttcttctttcttcttcctcttcttcttcttctcctcctcctcctcctcctccttcttcttctcctcctcctccttcttcttctccttcttctccttcttcttccttttcctcttcctcttcttcttcttctccttctcctcctcctcctccttctcctccttcttctccctctcctccttctccctctccttctccttctccctctcctccctatccttctccctctccttctccctctccctctcccctttcccctcctccccccttcctatccccttctctccccccccttctcctccttctccttctccttctccttcttctgagatgaggtctaactctgttgcccaggctggggtacagtggtatgatcatagcctactgcatccttgaacttctgaactcaagggatttgcctgcctcggcctcctgaggataacaggtgtgcgtgaccatgcccagctgctcttttttttttttttttctttttgggtagagacagtatctcactatgttgaccaggctggtctcaaactcctgacctcaagcagtcttctcacctcagcctcccaaaatgctgggattacatatgtgagccaccgtgccaggcctttaaattattttttattattttaggccaggtgtggtggctcacatataatcccagcactttgggaggctgaggtgggtgtatcacttgagcccaggagtttgaaaccagcctgggtaacatggcgaaaccctgcctctacaaaaaaatacaaaaattagccaggtgtggtggcatgtacttgtagtcccagctattcaggaggctgaggtgggaggatcacctgaggccaggaaaatcaaggctgcagcaagccaagatcgtgccactgcactccaacctggatgatagtgtgggaccctgtctcaaaaaaattttttttttttttttgagatggagttttgctgttgttgcccaggctggagtacagtggtgtgatcttggctcactgcaacctctggctcccaggttctagcaattctcctgcctcagcttcctgagtagctgggattacaggcatgcaccaccacacccagctaattttttgtatttttcagtagagacagggtttcattatgttggccaggctggtctttaactcctgacctcaggtgatccgccttcctcggcctcccaaagtgctgggattacaggcgtgagtcacgtgcctggtcttcttcttcttcttttttttttttttattaggaattgagttgactgctctgatatggagagacctgttagtcttgtatatagtgcccagccggaaaaagcatctcttgaaggttagggcattttgtgaggagagctctagggctatatcagtctggaggtatgatctctgataaagattataattctcatctcagtaatcttctttagaacaaaacattcttcattgtaagcttctcattaactgaaggccacctgatctgagattttggctcttagaatactcttttctgtgtctcaatcctcatatggtttacctctgaaatatagaatatattttcttgtgtagcctggtagagttggttttgttttgtttttcaaacagtaacttttattgattgtaaaacttccagatttctgagatgccgccttaccagtcttaaggttgatttttggtactctgaaagtgcccatttgctctgtgtgaaaagagcaggtttgcatttattcagtgattctaagatgagataattggtatttttatgatttgaatggaggctttgtatttttgaattttgtgaaacaaagctatgtttgtaaacacatttcaaaaaatataaatgccactttttggtgaagatactgaatagcaagaaagttcagaaaaaggagcttttgttaacatttaataataatctgactgttttcattgactatctcattgatgtttaaagagtacctgatgtttagaactttttgtattaaaaataatcttcaggctgggttgtgttaggaaaatattttctggtatcaaatgcttctttgccagtttggagtttttcagctattgtcttggtttagaagagggtattataaacaatatatttcaatgtaaagatagttcttgggaaactgtaggaaagcatttgcttagtgcctgatgtaagatgaacaagttgctttagtatcgtatgtgtaacagaactattttgatatggctcaactggtttaggtgtaaatagtataaaagcattgaggcaaaatctaaagtaagtcttcagttttttaaaattaaagtggttttaattttatattcctttccatttctttctttaaagactttattggctttttaatgaaattgtcagttcagatatgaacgtattatttgcagaggaagtgctttatatctatttgcagtggctttcaccaaccttctaggtgacatgggaagaaagtgtcaaatttaaaaaatttgaaagcctgtatcatgtgactgaaaatgttttaactacttctgaaaaattgcaagaacataagcctaagctaaaaaatttaaacagtatggaaggatatttggtgagaaacacagtcattccttcctataccttattcccactccttggcagaggttttcctctgttcagtttctcctgagagcttttcgtctatatgtaaatgatgcatagcctcttattttttacacaatagggaacaaatagttctgcaacttcaccttttcatttaacaagaggataataggggatcactatgtgaaggacattattgagcccatactgattttagtaggatctgtgattttctaaaatatgtgtaatgatttgacctaattatacatgattctacatgcatatgacttaagctaaaaaaaagaagagcattagcatttcttgacaatcataagatttcagttttaccaacttatataattattctccttgtttagaaaacagacaagtcctactgtaataaaaagccttcaataaaatgttagttccttatgtataggcccttgtacagggcacacttttatatgaattatttaacatactcttcataataactctttgaagctgattcagttttactctcattcttgcagaaaaggaaacaggcttcaggaggttgagtaacaaagctagtaagtagcagaattaggtttcaaagctgatccatgaaataatgcagcaatagctagttcaaattgtttaaaagcgagtctcatggacagtggtttaatatcctgttaccaaatatctcacttatttaatataaaaatttggtaaagtcattattacaatgtatttgatggtgggattggttctagaaagggaactgattcttgcttaatccatacccaacattgtattagtgtcacctggggagcttttaaaaaattattcctggatccccaaccccaggcattccagcggcatgaagctggtgttgaacctaggaatcgtaatttttaacaagctacctacttaatttttaggcagccagtctggctgcagtttagaaccattgaagtgtgtgtcttttatttcaaatttatgaatatgaggtcttcattttccacttgttttctttctgaagataatgaaccattacctaatggaaacaaacatgaaaaacttgaaattttatttaatgtgttcaaaacagaagttttcatttgttgagctatgtattatattgtgttaaatggattttattatttccatagggccatattataacagacagtgaattaaactgaaaactttatcttgtctcttgcagaagcaaatactgtgaaaatactttgtaaaaccactttgtaaaatgtataggttggaacagaattaagtgattgagactctgaaggctctggaaatgggttgtcagttttattttcagccgagagcaagataatacttatctaaataaataattgtgggttagatatgttgtcttgtaattgctttaaacgttgagcctagattaccaagctgctaagacaagggaattaaaaaataagtcacttagtggcctttattttgtatatacatattttttgcattttgataaacctgtataaaattagtaaaaaattactttcccttctttaagagttctacttgccaggagccagagtagaaagattggctggcagtattcctggcattgtaatttttagtgcactagatattttcgtagaatattgattgttctgtgaaccttcttaccatggggacagtgaagtcagcaagtcacactacattaaacaaacactgagtaacattaactgcaaaatagtatgagaaatagagaaatatgatacagactgtgtaaaaaatggtaagtataagtgtttggaggaaggggttaattcttccatttgatatattaagagattctatttccatataaattgtaattaccttgtcgatttctattaagcctgctgggatttggggaatattgatatcttaacaatactgagtcttgcaatacatgaacatatctcttatctatttaggtcttctgtaaattttccttggtaatattttgcactttcaatttataggtcttacactcattttgttaaatttatccctaagagtttttacgttctttggttctattatatgtggcattaaaacttttccaattgtttgttgctggtatataaaaatagtgattgatttttatattgacttattggtatgaaattattcacaatattccattattgttttattgtgtttaagatatgtagtcatgtttcttcttttctgcctgatactggaaattgtgtctttttgcttttttcttaatccgtcttaagagagagtttatattaatccatgtattttcaatttccagtgttcttcatttctttgtgtatattcaggtattcatcttgtctcattttccttctgcccgaagaattttctttacattttttatagtgcaggactgcaggtaataaattctctttatttttgcttatctgagaggttttaattttgcctttgcttttgaaggatatttttgctagatatagaattctagattgacctttttttttccttttgatgatgaaatagtgtctttccattgtattttggctttcattatttttcaagtctgcaataatgatctttattcttttctatataatatttttcctatagtagcttttagattttctagttttcactaatttgattgtgaggtttgccatggtttgaatgtcccttccaaagctcacattgaaatttaattgccattgtaatggtgttaataggtattaataggtatattgttaagaagtgattaggctgtgagggcttcatcctcatgaattgattaaagtcataatctcaggagtgcatttgttacctcaagaatgagttataaaagtgggtttggccctctctgtctctttcttgcatggtggttctcttttccctctgccttttgccgtagtatgatatagctacagcatgaaggccctcaccagatgctagcaccttaatgttggacttccaccctttgggactgtgataagacatttcttttctttataaatttctcagtctcacgtactctgttgtagcagcataaaacagactaaggcaaggtttctctgtgtatgggtgtttgagatgtatgtttatagttgttcatcaaatttgaaaacatttcggctgctctatctttaaatattttttggtccactctcttacctttccttctaggacttcaattacacatatattagcactcttgatactgttccacgggttctcttaattttttaaaatattttccttctctttacaagtcagttttaatagtttctcttactgtgtcttcaggctaccgatcttttcttctgcagtgtctaacctgtttattccatccaataaacttttcatttcacagagtgtatttttttatttctagaaactcttttgtttttagattgtcttgcatttctttcctcaagatattcctgtttttcttttaagtcattgagcaatttataatagttgttttcaagtttttgctggtatcacctttttattctgggcctatttctactgacagatttttcttctggttatgggtcacatttttctgctgctgcacatgccttgtagattttgatttagttctagacatagtgagtgttacattattgagtgtttggattttgtcattttttgttttttagagatgtaaggctttttttctggcaggaaattaagttattagggatcaactcagacactccaagagttgtttttaagcttttgtgagtgagtctaaagtaccttttttttttttttttttttgagacagagtcttgctctgttgcccatgctggagtgtaccatgatctcagctcactgcaacctctctctcctgagttcaagctattctcctgcttcagcctcccaagttgctaggattacaggcgtatgccaccacatccagctaatttttgtacttttagtagagacagggtttcaccatgttggctaggctggtcttgaactcctgacctcaagtgatctgccttcctcggcttcgcaaattgctaggattacaggcatgcaccactgtgtcctgccttagagaaacttttttgctaagaatagtttagctctattgctaagcattctgaggtctttactgaatgctttgggcattcaacgtttaggctgtattcagactgcttccagctgaaaacatctcccaatcctgtttgagctctgggaattgttgaatttacaactctggttgtttttcgcctgccattgtggagttttactgtgtgtgtgtgtgatttgctcttagtaatatagcgggactccaaggtgactccatgcacgtttctggagatccttctctgcgtagcttcctcctctagacctctgctgtgcaaattccagctgccttttcctcccagaactctaatttctgtcccctccattcagtatgactgctctgctcaaaaatcccttttcttctgcacagtaatctacaaattgtttccagataggaaatcaggatgatggtagagttcacctagtttcttttttctcagggatcacagtcttgtattatttgttttccagtgttgggaagcagtcttttgatgtgtgttttctaattttttaattgtttgcagtagaaggtttatctagtcccaattactgcatcatggctcaaatcagaaattctctttccttttaggaaggtaaatatggttaacagaaaatgtgtagtggaagagtagaggcagggtgcttgaaggagggcagtattaatgaagccatgacagccacatatatctggtcaggtattacaatgcaatgtaagtgatgcccctgggggtcactgtatttgggtgcacagcctaaatggtggccttgcatggagcagagctgggtgagaatacaagtgagagcctgcagatgtaattgacaggaacttatcttaatttagttggctctaaggcagagtatatcatctgagatgatgtcagggtttttattttgtgtgacttatttatcacttttgtaagggttattaataagcttcatttataaggattttgtgaagtttaaatgagatgatgcgtacaaaaatacctttttttttttattttttgagatgggatctcactctgttgcccaggctggaatgcagtggcgtgatcatggctcactgcagccttgacctcctgggctgaattgatcctcccacctcagcctcctgagtagctagcacctgaaaatgctttttaaatgatggtgcagtgtacaatgtgaagtattatttattgctaaagtccatgctttgagtctttacagaaaagcctgcataaggttgctctgatgtcataatgatcggaaaaaatgatctaaaatcaccgtaacttcagaacatcagagttcatatttagggaaaagttttcttttctttctttgaagaatttagtatgtaaaggttacttagcctcagggaaatctttgtataaaacagtcctttaaaaacaataccttgactgtagaagagaatgtttaaactggagtgaataccagtgaagtaacaaatatcagtaaagtttcgagtgagttgaagaaaacaaaccagtgatctcaatggcgcaatcacctcagaatgaagctggggcctgaagtttataatggaataagcttagaggttacagccagaagtacagaggtaccaaaagtttttagacctctgtaggaacatcaaaatgtattgcaagcattacttgcctattcaccttccgacatcttccactttcactcatcttgctgtatcactagagggaagaaaatgcttactgttttccctggtaaggacactaaaagtcacactctttccccagagaaattatagcctagaagaaatagacaaggccacatatcagattacctttaagttaactgagtttctggcatgatttctcttgattccaggcagatttttttgggtgactatgcatgagggaaaatatccaatttcatgacttccaagaaaggtcactttcatagacctctgaaaaggcaaaacagttgttaactataaaaaatacattgaaattttggattttgtcttgattacattaaattgttttaaatgtttatgtttttaggtgttctgagctatttattgcattgacttgttgcattactctgtacgctaattaagcacaatttgtatatttctgcatttgctggtatttttaggaatatgtcttaatgtgcagttttatcccagtaattaaaaaaagttaccaaaagcatgacagtccactgaatgtaaactcctttttaaaaaaactttgttttatttaatatttattctgagcacacagagcattgttacacacattcagtaattttattatatgaaaattatagatgtaaaactcagtctgcaaaaaggaaaaaggcttgaaactcagttatgtatgaattaaaagcatttcctttaggcaaggatgatttagtagttttcttatatacatgtagttaattgtcatggtgtttcttggaagagaaaaacagtgtaagaagaccggcttttgaaaaacttgtttaaaagagttgagctgtaagctttatttaaccaacatttacttaacatatacttaacatataatttgtgccaggctctgtgcttggtttcagggatggaagggtgacatagatatggcccttctggaagagctaatttgtttgggaaggcagtcatgtgaacagataaatactaatacaacctggaaagttctttaatagaaatggttaaagtgtcatggggttatagaggttaaagcagctacttgtgtctagagaattggtgcatgttttgctagtgtgctagacaaaggcatgtttagtggggaagacaggaaaagggaaaggctctagatttactttacagtaggcctgtgctagtaagtacagtagccattagcaatatgtggttaaatttttagcaactatttagcataagtagcacatatttagtgtaaactttaaatgggaaaccatcaccacaatcaaggtgattgaatgtatacatcattctcaagagcttctcctgtgcatttgttaattcctcctctctgtcctccttcacactcccatccctactcccacataactactgatctggtttttgtcgtggtaggttagtttgcattttctatactgtgtttttttgtttgtttgttaattttgagatggagtctcactgtgtcacccaggctggagtgcagtggcatgatatcggttcacagcaacctctgcctaccgggttcaagcgattatcctgccttagcctcctgagtagctgggattgcaggtgcacgccaccatgcccagttaatttttgcatttttagtagagacgaggtttcaccatgttggccaggctggtcttgaactcctggcctcaggtgatctgcctgccttggcctcccaaagtgctgggattacaggcgtgagccactgcgcctgggtgcatttcgtgtagttttaaataaataaatcacacagaatgctctgttttgtctggcttaaatcggcataattattttgagattcatttatgtaccaatagtttattcttatttcttaattgtaattcatatatcacaatttgtttatttcctctcctgttaatggacatttgggttgtctccaattttgggatattacaaataaagctattatgaccatgttttttttttttttttttttttttttttaagttagagttttgctcttattgcccagattggagtgcaatggcgtgatctcggcttaccacaacctcttcctcccaggttcaagcgattctcgtgcctcagcctcccgagtagctgggattataggcatgtaccaccacacctggctaattttgtgtttttagtagagatggggtttctctatgttggtcaggctggtcttgaactcccgaccttaggtgatccgcccaccttggcctcccaaagtgctgggattacagatacgagccactgcgcccggccattatgaccattcttaatgcaagtctttatgtggacattcatatggtagatatatcttcaactcactaagaaactgccaaagcggttgtatcattttacattcccacttatagtgtatgagaatttcagttcctctatatactttctaatggtttgtatggttattcattttaattttagccattagaataggtctgcagtgctgtctcactgtggttttcatttgtgtttttctaattactaatgatgttgagtatcttttcatatacttacttgctatcttttatcttgtttgctgaaatatcttcatatctgttgtcaattttaaaaattaggttgtttgttttttattattgagttttgagatttctttatgtattctgggtacaagtcctttacgagatacatggtttacagatattttctactaggtggattgtcttttcattctctaaacagtgtcttttgaggagcagaagtttctaattttggtgaagttcagtttatcaggttattcttttatggattgtgcttttggtgttgtatctaagaaatctttccttaattggtcacaaatgttttttcttatgtctacttgtagaacgtttttttgagaccaggttttgctctgttgctcaggctggagtgcaatggcatgatcatgtctcactgcagcctcgaccatccaggctcaagcaatcctcccacctcagcttcctgagtagctgggactacaggaatgagcctggctaatttttattttcttatttattgtagagatggggtcttgccatgttgcccagactggtcttgaactcctgggctcagaggattctcccaccatgggcttccaaagtgctgggattacgggtgccagccactgcacacggccttacttttagaacttttaagattttctttcacatgtaggtctgtgatccattttgagttaattttgtaatatggtgtgacgtatggattgaagtttttttgtgtgtgtgtgtatgatgagccactgttccaacaccatttgttgaatagattccataaattactctttctcaagtgaattcctttgcatgtttgtgaacaaaaatagtttattgtttataaaaaaggcttttttgtgtatatacacacacacacacacacaaatacatgtgtatgtttttctgtattctataatttagtccattgatctcttgtttttatgtaatatcatactttcttgattcttgaagctttgtaatcttgaaatcagtttgtatagtcttccagatttgtttttttttttttcaaagttattttggctattctaggtcctctgcattttcatataaatgtcagtactgttgtgtcagtttctaccaaaagtctccagaatttttattgtaattccataaaatttatagatcaatttggggagaattgacatcgtaatagggttttctgatccatgtagatgctgtagcattccatttatttaggttgtttttagcctttctcagcagtgttttgtagttttcactgtataggtctcaacatatattgtcagatatatctctgtttcatacttgatactgttatatatggcattgttttaaaaattcaatttctgattaatttttagaatatagaaatacaattttatatagcgacattgtatactgtgcagactaaactcactaattctggtactttctgtagattccattccatgggataatcttcataaatggtcatgtagtctgtgaataaagataattttacttcttgctttccaatctggatgccttttttaaattgcctgattgtactttccagaaactccagtacaattttaaatagtggtgagaacagatatccttgtcttgttttagatcttagaaagcattagtcttttacctatgagtatgttagttgtaggcttttttttatagtaccttgtattaaattgagggagtttccttctattcctagcttctaagagattttcctagaatagatgttggattttgccaggtatcttttctctgtctattgagattgtcacataggttttctttgttaattcgttagtatggcttattacagtggttactttttgattgttaaactaagtttgcattcctcagataaaccccatgtggctatgaggcattattctttatatgtgttgttatattagatttgttaaattttatttagaatttttcatgtgtgtttatgaagaatattgctttgtagtttttttcaatgtttttgtctggttttgacatcagtgtaatgctggatatgtaaaataaatgcagaaatatttattttctagaatgtttgctttaacaaatttttctagaggagttttagttttctggaagagttttcttatagttggtatgtttctttttttctagaggagtttgattataattagtattattttccccttaaatctacaactgtttggtagaattcaccaatgaaaccaactaggtgtagagtttttcattggaggttttaaactacaagtttagtttctggaatagttccagagccacgttctttagataatctgtttcttcttgattgagctttgataatttgtgtttctcaaagattgtttatatcatataagttgtcgaatatattagttatttataacattaacttattatcctttttagtatctgtaaaatctgtagtgatgttactgctcttattcctgaaatggattgtttcttcttttcttgatcactgtggctaaaagtttatcagtttttttttttgatgttctcaaagaaccagcttttgagttccttggcctttttttttttttttctctattttttcccccatttctttgacttctgctgtgactttattacttgcattctcttgcttagtttggatgtaatttagttgttttctggtttgaggtacattatgaggtcatcaatttgagacctttctttttttctaatataggcctttagtgctataaattttctcctaagttcagctttagtagcattacagcaattttgatatattggattgttattttcatttagtttaaaatatttttcatttcatttttctttaacttacgggttatttagaagtgtgttattcatgctccacatattttggggaaatattctttctagagatatttctcttactgatttctagtttaatttgattgtggttcacatctacaaggatctgatctttgacaaacctgacaaaaacaagaaatggggaaaggattccctgtttaataagtggtgctgggaaaactggctagccatatgtagaaaggtgaaaccggatctcttccttaacaccttgtccaaaaattaattcaagatggattaaagacttaaatattagacctaaaaccataaaaatcctagaagaaagcctaggcaatactattcaggagataggcatgggcaaggacttcatgactaaaacaccaaaagcaatggcaacaaaagccaaagtagacaaatgggacctaattaaactaaagagcttctgcacggcaaaagaaactaccatcagagtgaacaggcagcctacaaaatgggagaagatttttgcaatctacctatctgacaaagggctaatatccagaatctacaaggaactcaaacaaatttacaagattaaaaacaaccccatcaaaaagttggcaaaggatgtgaacagacacttctcaaaataagatatctgtgcagctaacagacacatgaaaaaatgctcatcatcactagtcatcagagaactgagataccatctcacgccagttagaatggcaatcattaaaaagttaggaaacaacaggtgctggagaggatgtggagaaacaggaacgcttttacactgttggtgggaccgtaaactagttcaaccattgtggaagacagtgtggcgatccctcaaggatctagaactagaaataccgtatgacccagccatcccattactgggtatatacccaaaggattataagtcacactactataaagacacatgcacacgtatgtttattgtggcactattcacaatagcacatacttggaagcaatccagatgtccatcaatgatagactggattaagaaaatgtgggacatatacaccatggaatactatgcagccataaaaaatgatgagttcatgtcctttgtagggacatggatgaagctggaaaccatcattctcagcaaactgtcacaagaacagaaaaccaaacaccgcatgttctcactcataggtgggaattgaacggtgagaactctaggacacagggtagggaacatcacacacccagggcctgtcgtagggtggggggctgggggagggatagcattaggagaaatacctaatgtaaatgaccagttgatgggtgcagcaaaccaacatgacacatgtatacctatgtatcaaagctgcaggttgtgcacatgtaccctagaacctaaagtataataaaaataaataaataaaaataaaaaaaagcatttgtggttagagaacatgctttgtatgaattgagtgattttaaatgtattgagtcttgttttatggtttgaaatatggtttgccttggcaaatgttctgtatgaacttgaaaatgtgtgtgtcttctgcaaggttttgtggagtgttttctaagtatcaagtgattttagtttgtagtgttgttcaagtctttcatgttcttttttattttctgttttggagatctatcaattattgaaagagggaaattgtaatctgtaatgtgaattgtgaattttgtatttatccttgcagtttcatcagtttgtctttacatattttgaatctctgtctttaagtgcattaatgcttagtagtattatatgtactcttcatcaggtgactgttttatcattataaaatgacccctttttttctgataatggcttagaaatccacattgtgtgatgtttatatatacacttcaggtttcttttgatatgttagcactgtacactttttttcttgtttttacatttaactgcattctacctaaagaacagtttatttatttttaccagcatataattgggttctgcgttttttatctagtctaaagtctttgcttttaatttggaacatttaatgtaattattgatatgactgtgtttgaatccattatcttgccatttgtttctttttatctcgtgtgttctttggttcccttttcctccttttatgcctccttttatattaatagaatattttttattctgttttgtcatctttattgccttattagatataacttgttattttagtggtttaatgatttgcagtattcagtttcaatttttatcagtggacttcaggtgatattatgtcatttccatatagttaatggagttaccattccattgctcctcttatctttctgtagattcatatttctatctggaatcatttttcttgtacttcaacaactttaaccttttctgcagtagtgatctgctggtaatgaattcctttcagctttttcatgtctgaaaatgcctttattttgtcttaatttttaagaacatatttttcctgggtacagaattctagatggacaattttttctttcagtatattaaattttgcttgtcttgtttttgtaatatccagtgagaaatctaatgatagtcttatctttattcctctatataaagtgtcttttttcttactgcttttaagattttttttttaaattacagattttgagcaattttattatgtgacttgttacaatgttttcatgtttcttttgcttggtatttgctcaactttctggaactgtgaatgctatggtttcaatgttccattcaaaattcatgttgaaattttattaccattctgatgatgttgaaaggtgtgatgtttaagaggtcatgagggctctgtcttcgagaatggactaatgccattatcatgggagtaggtttgccccctcttgctctctgtctgttgtcctctttttgcctttctgtgttatgatgcttccatcatgttacaatgcaataagaaggccctcgccagattctggctccttgatcttggatatccaagcctctacaactgtgagccaatttcttgtcgttatgaattacccagtctttggtattgcattatagcagcacaaaacagactaaaacagttagtttatggttaccaaattttgaaaatttttggaagttttttattttttagataatttactgggcctcccccaccttcagaaactctaattatatatatatagaagaacacttgaagttttgccacagctcacttcatttaaaaaattctgttttctcttttgtgttttatattggattgtttcttttccatgccttcaaatttactagtttttcttccacaatgtttaattagccattaatcctgttcagtgtacttttcatctcatacattatggttttcacctttgcaagtttgatttgtgtctttttatatcttctatgtctctaaacattttgaacatatagagcacgtaataactaatttaacatccttgtctgttgattctaacatctctgtcagttctgcttagatttaattgattaattttgtccctctatatggtttatacttttttcttttttatctgccctgtaattttttattggattccagacattgtggattttatcttgctgagtgccgtatattttttatttctaggaacttttagagatttgttctggaatttagctaaattactttgaaactacttgatcttttctggtcttgcttttaaagatttgttaggtaagtctggagcagtgctcagtctagggttaattattctccactactgaggaaatgtgttttgtgtgctctttcagtgccccgggattcctgaaattttccagtctggatgttgagaataggcactattactggccttgtgtgaatgcttggcactggtaccttttatcttttagagttattcagtctctagcttcaggtagtttcctcaaatgcacgtgccagttagtactcaagttgaactttttgcaggagtttttacctgctctcaggttctctgccctgccgactctatgagatccgtagtcacgttctgatctcagtgagtctgtcagtctcccatcttctttccccttcctgcaccctggcctgcaaactttcttagcttagtaagtttgtgtgtttgtggagctcatctaatttgtttcttttcccttagagatgactgtcctttgttgcctgttgtccattgtctggaagatagttatttcatttattttctccattttatccttttttcacatgaagtgtaaatctatttctgttactctgtctttatggcaggcagaggttctaactatttacatttaaattagttaaaaaaatgcattcctcatttgatatagccacattccaaatgcttaaaagccgcatgtatctagtgactaccatactggagagtacaaatatagaactttacccgtcactgcagacagttctgttggattgtgcagcattggacaatatatacagtttgcctgtatatgagaaagagagagagagagagagtgtgtgtgtgtgtgtgtgtgtgtgtgtgtgtgtgtgaagtgcaataaggctgacaggcatcgtggctcatgcctgtaatcccaccactttgggaggcctgggatgcagagacaggaggatcacttgaggccaggggtttgagaccagcctgggtaatatagtgagaccctgtctctaccaaataaataaataagtaaaataaaataaattcagcttttaattttggggatgcctggtttatactacttatctagtggattgtgaaactggaaatgagtttcaacctcagtgccctttatatgtatattaggctgtcttctacagcagtgagaaatctctggcttattgggtcataccttattttgaatttttttgtttacttctggtggcaggtatcatttggatgataacattgttgtccctttttaagtcagactttgtctacattcttgaagtattcttaggtccaacacagtgtctggcacacagtaggtgctcaaatattaatacttgtttatttaaaaatatttaaacatttactatgagcctggcattctctttggtatatatggatgaaaaattgatttctgctacgaatataataacctgtgagtatccattgtttccatggagaggctacagctttctaacagtaggatatatctgcatctcaaaaacttaaactagattttcagtcactctgtcacctgaggtgtggaatggcaaagctgagcaaccttaaaatcttgagaaaaatagtgctctcccttccctagtagctgtcagctgtttcatgtggagagaacaaagtttctctttgatgacaactgttgaggtgctaggaatgttggttaaccacctaggttcatgaaaagctgaagcaataattcagtttttgtaggagaaacaccttacatacatattaaacctttttttctcaaagagtctaatccaatgtaaattgagaaattggggacagtttaatcaatattgaagtttcttgttttgactcggctttttaatctacttacagaggaacagtttttacattcggatatcaaatgcttattttgttaaaatggttctatttgttatttacaaataaaaataataaaattgtttagaaattggtcatgtattggtaatggtacaagcaaaacactccttatatattgaattagaagttcacaggcatctgtgtcaattgctttggtttacaaaaaaattagcaagattattgttccaattttttgacaacttgaaaaaaatcaaaagaaatagctgctgtaaacttaggttggtgcaaaagtaattgcagtttttgccttttttagttaaaaaaccgcagttacttttgcaccaacccaatactatgttttacagataaaatcactgtcttctgagttgtaagatttgaaaatgcattcgtcaaataagtaatttatttgtattctgacttagctcccaaataatttgaattggacatatttactcagtatagaaatcattaaattacagtttcctaatggtgagataaatttcttttttaggatagtgatttcattaataccttatggaatttggtttagtttgagtcatttttgcagtaaagttctatttttgtaagtaattttgaaagtcctacgaaatgtttgctgcaagttagtcatacagagaattgctttgatatttcaggtattttgatgttatgtccaaaagtgcttttgttgacccaaggctactgtattgtatttttttttttttttttgagatggagtctcactctgtcacctaagttggagtgcagtggcataatctcggctcactggaacctctgcctccccggttcaagtgattctcccacctcagcctcctcagtagctaggagtacaggcatctgccaccatgcacggctaatttttgtatttttagtagagatggggtttcaccatgttggccaggctggtctcaaactcctgacctcaggtgatctgcctgcctcggctttccaaagtattgggattacaggtgtaaaccaccatgcccggcctactgtattgtactttatcccaattctttgatatataaaccctttccctctctttaatcatgattcttttaaaaattaatatttggattctcaaccttgaagaattagtttaaaaaattaatttattaggccgggcacagtggctcacacctgtaatcccagcactttgggaggctgaggtgggtggatcacctgaggtcaggagttcgagaccagcctggccaacctggtgaaaccctgtctctactacagatgcaaaaattagctgggtgtggtggcgggcacctgtaatccctgctacttgggaggctgaggcaggagaattgcttgaacctgggaggcagaggttgcagtaggccgagatcccacctgggcaacaagagtgaaactctgtctcaaaaaaaaaaaaaaaaaaatcagttcattaaataagtacctacagtatgctagctagacactgtgctgattgctttgagcataacgaaggtgtattggatatggtcattatagctccatacatctgatagatgagagaaaacttgtatgctgtgctaataattgcaatagaaatatataccgttttggatttgtaaacatcttagaaaaaatacctagaaaaaaactcttaatgagcaaatggattaacatgtctgctttccatttttaagtatcaggtatccaaccatattattaaaataaaaaccaccagagtacagtctccatagttagatttgtataagcaaccgcaaaacgatatagtccagtatctagcacagcatagtcaaacacatagtattatgcatatggtaaatgttaataaatgtttgtggaataactgcctatgaaaacttctttttgaggcttgtattagtaatgtaatttaccatagataactttcctcatgtttcaaactgctggtcattaccaattagtgggttgagaaaacactttagatctcatacagcatggtaaaaaagtagaatagaatggaagctatgagagtgtatcacatgtagttagaggattgttttttatgacattttagtttgttgtataaatgttgtatataaatgtatgttatgtgagtatatgcttgtgtacactaggtggtgatataaaatatgtttaatgggccgggcgcggtggctcacgcttgtaatcccagcactttgggaggccgaggtgggtggatcacgaggtcaggagatcgagaccacggtgaaaccccgtctctactaaaaattaaaaaaaaattagccgggcgtggtggcgggcgcctgtagtcccagctactcggagaggctgaggcaggagaatggcgtgaacccgggaggcggagcttgcagtgagccgagactgcgccactgtactccagcctgggtgacagagcgagactccgtctcaaaaaaaaaaaaaaaaaaaaaaatatgtttaatggtgaattgtggtcaaataacttggaaagccacagcttcagtagttaattttagctacttttaaagtgtgatttctctttactacttagtaaggtgtgaaaacgattgaatttgtgtaactgatgtttgatgggtttaattgttgtcagtgctgcttagcagagtgctctgtgttgcagtttaaacactactccggattttcctttattagataaaagtctactataacttttttttgttcttagtcgcctttagtctttagagttactgatcttcaattcatgttggacagcttcctttgaagagagaaaacagctttattggcagtggggacagtcaacattactatccatgttaaagaaaagatcccagaaacatgaagaaaaagactagaatgtaattatgtaaaaagcaaatcaacaaaaagcgaacccagaccaccacagttcaaataagagaaaatgcttccaattagtgatgtaacctacttaggcctcagttttctcattgaacagaaagaaaaggttgttactagatcatctcttaagttactttctgatacagaattgcaactcctgagacatctttatgtctctttaagctgtggaatcctaccagatatttagaatgataatgtgaacagctcgactttcaagaattcagttcggtgagaacacctaatgaagtggaaattagtgtgttatgtgtgcatttaatgactttattgtagcctgtgtctagactgttgatttgatgaagtttatacagaagaattaaatgctcatgatttatatatttaaaaaatctatgagttttcctggaagtgagtgtttctttgaagcagatttaatgtgttaaggtcttttttttttttttttttttttaccttctgtacaatcattttctgaaattgtaataaaaatcaagtacaaaagataatccagcatttaaatactctttattctagccttttctattatagtacttgtttttgtttttttattgtcgtggtattttgtgttaacttgaagactaattgagcatacagaaaattttttcaacttgggaatgtggggcaatataacttgaaaagagatgaaaaaacaatttctttgggtcagaagtattttacatctggaaacacacccttgaactctggctgtggtttttccacatgtgccatttattagcagatacgttctttatgaaattttgacagtatatgctgctttttgtctgaggaaagcttagttctaggcagaatttagctttgttgtttttgattcaggagttaaatctttagtcaagtgaaaatataaggatggggacattcttaactaaagtgccaggcttctatggtttttatctttgctttattttttaggaagagtgttttgagatatgtgaaaagagggagctctttgattaagtttgatttggactcagtgttttatttcattggctttcatactttagggcatctgctttgtaatatgaaaggaggttcctacccacaaccttctctcacccttttggatgcacctacttatttttaagtaatctttgttctttatgaactgtcaaatactatttgataccctgtgttataacgagtagaaattggtagttgtgctaggctatgccctgtgtctcaaggaggaattggggagattgggcagcgttcatgtatgtatcgtaacttggttcctgggagaacatgagattgctatggcaacaaaggttctttgaaggcaaaaattttggcagagtggttgggtcttttgaagtgctgggtgtgttgacaggaaaggaataagcatacatctgtagactagcagtcaaggaaaataagcatttagtattagctttaacttgaggtcaaatatattttgagctgtaacttgagcgcaaatatgttttgagttccacctcagtgctaattttccttcagaacttttatttgtatgaggttttctcttctcaagtctgctgtttcaagaacaagtttcgaagaatgtaccatgtaatgttttagctggcctaaaattgtctaaagttttggtagaatcagtgtggtgtaatgcattctgatatgagttgcttctaattttaagagtagataaaaatcattacaaattactcagcttagaatttggtatcgcttaaaaactggtgacaaaaataaattcccagactctgtgatctgcctgctgttttcaagatccttatcttacctcaccaactttctctctctcttttccattctcaatctcaactttcactcctggttttgctctgtggctgttcatgcttgcttcccagccattgctcaagatgtatctcctgcctggcatgtcttttcatttttcagcctctctaaacactactcaagttttacttttgtcatgaagtttccctgacttttataaccaacagggatttcttccttctctaactcttgattaacatttatgtattaaatcatttggagcttaataagattttacacatttttgtttatgtgttgtgtgttgaacttattgccttagtaataagtttgtggtcagaatttttgtactcttgtgccttataataaaggaccaggcacatagttaatacctggtaacaactagttgattgatggttttaattttaaatggatcagtggtaaaaatcatattcaaataatagatcatttatttagctttttaataagttgtataagtagtcaccatagataatgtcctgtatcagggatactcttatttttaatgtttggtcccagagccagtgataattttgtatagatcttttcccaaccactattcatttaaactgaagaatccagaaaatgatttaggtgactgttttttcagttctctcaagaatgacacttaagtggtagtattctagatgcttaggagatgcctacagtggatgactaaaggcactagcacttaattcttatgtgaaacctttcttgagaatgggacatatagtatcatttctatgttatattcagtttcctcatatttggcttgactgaatctatgtattaattatattatgctcttctatttttttttcccaagaagtaaatattggtaaaaatggcaaggaaagtaattctagggacctggtagaagttttgctattttgatttattagaaaatattgaaacagtaacccagttttgagcaacactactgtatgcaaatgcaaaatacagttctcactttttagacccatttattacaaacttgggaagtttttggtactacaaaaactttttgagatttttctttccacaatctgaatgaagaggaaggtgaaactagctgctgaatcaaatatttttagaatttttttcatcctgtttggaaaagaatcattagttatttgcatgtatattatatctggaaatggtaataaatattcattgaagaaatagttaaaatacagaattaagttcaaaatcaccatttgctctttgcttttgtttactgagcaggtctagggaaatgtctagggcttagaggagtgccagggttttttgggtctgataaaactttagggatattccccatttgcaggatagttattctcttattgcaagtcgagtgaaaaaaactcttgcagttatccatgatgggaaatggtttgatggttaataattaacatacaattagtcactggctctgatagcataagttatatttatgtgaattttcttgaagaagtaatattttatattagtgatttttgattgaaatctttagaaaatgtattgcaattgtattttattttctaaaacttaccaaatatatagttttacagggatacagtcatgaatatttgttgtattttgcatcatgagaccatatagtgataatttatagtcttatgatgaaggttgaaaggaatgtttgattatatgctaatctttttacactagtgtgcatttatatgtagcattttgtttccttattaactatagttatttcttaatttgtgaatttttagttgccctattttttttggcttctatttaggttggtgcaaacctaagttttgctattactttcaatggcaaaaaagctaggttttgccattaatttcaatggcaaaaaagctaggttttgccattactttcaatggcagaaaacctaggttttgccattactttcaatggcaaaaaccgcagttacttttgcaccaacctaatatcatgctgtgtaatctaacctgctaaaaatggaccccctaagattaataaggtagctaagccttgttaaaatcagagattgtgttgatatatgacaagagaccatgggaatggtttttgcttttcttgtggagaagaatgcatgagctttgttgaaactctttttctatcttatttctctgttagtctctgggtatagttgattgattgcagtcacttgatgtccgactaccagatacacggactgttgttatttttccttcaggtgactttgatactaaaaacactttcacttattttttttctcacatagcaaaatttgagaaaatataaaagtaaatggcttatatatattaaatgtgtttgaacctgaactgtagtgtcaataattataaattaaggtatcaagaacttattgaatagtagaagtatttttggaataaaaaagttggctgggcacggtggctcacgcctgtaatcccagcactttgggaggcctaggtgtgtggatcacttgaggtcgggagtttgagaccaacctggccaacatggtgaaaacctgtctctactaaaatacaaaaattagccaggcatggtggcaggtgcttgtaatctcagctactcgggaggctgagacatgagaatcgcttcaacctgggaggcagtggtttcagtgagtcgagatcgtgccactgcactccagcctgggcaacagagcgagactcggtccccccgtgcccttcccctcccccaccaaaaaaaaaatattaagttgacttggtttcataattattgatggtgattagaaatatttaaatgaactggattaaattataatataccttgctagtgaacattgttttgactacctgtgagcctgtcctggtgtgaagtaatttttctgtaaatacaaagaaaaaaaaaaacgctgaagttgggattttgattattgagaatagagactggattcgccaattgagaaatacttgtcaaggacattttttggtattggatggaacataattagcttactgatttgatggttctgtgtagttcctgaaactcttggctcttgtttgcctttctttaactctggctccttctccttcttctgtttgtgtatctgtttaattcattgagtgaggaggacaggcagaactgtgtctgccaaggaccggatgtacttctttccttgctcttggttttttgctcacttttatatgtaaggtattagtacaaacctaaaggagagaaagtagaggatcagatcattgggacttgttctggtttcaagaaaaaattaacaaattgccgaggatggaggggctggggttgtacagctcaactgcactaggatacaaattgaagatcaagtatcaaggcagatgctttctagccattggaacctttcttatctgggaagaacttaaacatagtaaccatagtagaatttccagaaaagtgtgaatgttgtttttttttaagcgagttaagtagaggaaattgtcttttagctagataaaaaatatcattttagcttctcattggttgctaattatgtttgtttgtttgtttgtttttttgaggcagagccttgctctgtggcccagggtggagtgcagtggtgcgatcttggcttccctgcaacctccgcctcccaggttcaaatgattcttgtgcttcagcctcctgagtagctgggattacaggcatgtgccacaacgcctggctaatttttgtatttttagtagagatgggattttgccatgtttgccaggctggtctcgaactcctgacctcaggtgatccacctgccttggcctcccaaagtgctgggattataagcgtgagccactgcgcgcagtcaagaatgtaattttgatttttgttttgtggcttgtgtttcataagaaaaagttgaaaaagctggctctcattattttcctttgcatccattcatattacctttttttgttttttttttttttgaaatgggggtctcactgtgttgcccaggctggagtgtagtcactgttcacaggtacagtaatagctactgcagccttgaactcctggactcaagcagtcctcctgtagctgaaactacaggtgcatgccactgtgcctggcctcatatcacttttatagcactaagctaagaggaataagattgcttttcagtcaatttgagaaacatggctatttggtttgtacaacatggctttggcttttattctgagtgaaatgacaagactaagagacagtgacatctgactttcattcgtgaaccccaaatatctgagacaggtctcaagtcaatttagaaagtgtattttgccaaggttaaggatgtgccagtgacacagcctcaggaggtcctgatgacatgtgctcaaggtggctggggacagcttgcttttatacattttagggagacatgagacatcagtcattatgtgtaagatgtacattggtttggtttggtttggtaaggcgggacaacttgaggtatgggcttccaggtcttaagtagatgagagacaaaaggttgcattcttttgagtccttggttagccttccactgaatagacactttagtctggctcagttaatctgcattcataaacaatagggcagaggaagcagttatatgtatttgtctcaggtgagcctcagagggatgactgtgttctgtttgtcctttgtcaacaaggaatttccttgtgggcaaattgtgagggagatatgtagctttttatgtttgtaactatcttatttaggaataaaatgggaggcaggtttgcctgacacagctcccagcctgacttttcccttggcttagtgattttggggtcctgagatctattttcgtttcataaacttcagtaggatcactctggctgctgtgtagagaatagggtagaaagaagagaccagttaggagactacagaagatgtgattaaaatttggatatatatcggaggtagaactgaggatcttgggcccgtgctacagaaagagaatagagctgttattaattgagaatgaagaaaactggaggaacaggttttggtttcttttttgagacatatgattcggaaaccacgtttagatacactatactattagacatccagttggagattttttttttttttttttttgagacgagatttcattctgtcacccggactggagggcagtgatgtgatcttggctcactgcagcctccacctcctggcttcaagcaatcctcccacctcggcctctagaagtgttgagattacagatgtgaaccactgcacctcgcccatttggagatattagtggagaattggtctggtcttgatctctgggtagagatgtgagtgggagttatcaatttgggagtcatctgaatagataatgcaaatttaatctgtgggattggagtgagtgttgagagtataggatgaagacgagatcagaagactgtgtatgcagttcagcatttagaagttggggtgatgagcaaaagacacttgagaaggcatatccagacatataggcaacctaattaatggtggctgtgtgtgtggtttaactttccttttaagagttagatggaaggaatcttaagctacatttagtctgtctcattttgtgaattagatttttaaaaaaggtcatgtggacagactagtggaatagaactaaggtatagacctaagagcatattgaaacagtgtatggtaaacttggcatctcagagcactggggtaaaggtggactttttaataaatggttaaccatttggaaaaaagattacagctgggagtggtggctcatgcctgtaatcccagcactttgggaagctgaggtgggtggatcacgagttcaggagttcgaggtcagcctggccaatatagtgaaatcccatctctactaaaaatacaaaaattagctgggcatggtggcgcgcacctgtagtcccagctactcgggaggttgatgcaggagaattgcttgaatccgggaggtggaggttgcagtgagccgagaccacgccactgcactccagcctgggcaacagagcgagactccatctcaaaaaaaaaaaaaaaaaaaaaaacaagattactatctttggcccattaaatgaaacaatggaacagagatcccaatgtaaaagaatgaaactacaaatataggaagaatatatggatgaattcttctgcaacctgtgtaaggagagtttttctctatatctcaaatcccaatgtaaaaagaggaaagactgatacatttgactatgtaaaaattaaagataagacttttgcatggggaaaaaacagtaattacaaagtcaaaagacagatagaaaattggaagaaaacagctgggcgtggtggctcatgcctgtaatctcagcgctttgggaacctgaggcagaagaaatgcttgagcccaggaatttgagaccagcctgggcaacatagggagaccctgtctctacaaaaaataaaaaaaaaaattagctgggcatggcagtccacgcctattgtcccagctactcgagaggctgaggtgggaggattgcttgggcctgagaggttgaggctgtagtgtttgtgccactgcactccagtctgggcgacaagagttagaccctgtctcaaaacacaaacaaacaaaaaattgtaagaaaaacatttatcacagaaataagggctatccttcatgtataaagaatctttgaaaatagagggtgggctgggagccttggctcacgcctgtaatcccagcactttgggaggccgaggtgggtagatcacttgaagtcaggagttcaagaacagccaggccaacatcgcgcaactccatctccactaaaaacaaaaaaaaaaattagctgggcgtggtagtgggtgcctgtaatcccagctactagggaggctgagatagagaatcgcttgaacctaaggggtggaggttgcagtgagccgagatcacgccactggactacagcctgggtgacagcgagactttatctcaaaaaagaaaaaaaaagaaggcggaaaaagaaaacagcaagacacccaacagaaaaataggtcaaagttatggacagttcccaccatggcctgaactactgtttcaggtttactttagaatgccctgggctgagaggaggggtccatgcagttagttggggggcttagaattttatttttggtttgtgctagacaaagggataattcatattctgttggagtgggaaagtgtaagatttcaccatgctactcagacgctactaagaatggcacacaatttaaaacatatgaattgtttctggaattttccatttaatatttctggactctgagaagtcttcccttatctgtagtttcactttctggggattcagttacccttggttaaccaagatccaaacatttttatgaaatgtccaaactaggcaaatgtgtaaagacagaaagtagattagtggttacctagagttgggtagcgggagtagatggaagaagggggtatgaccactagggatatggggtttttggaggaaggggtaatgaaaatattataaaattgcttgtggtaatttgatggttgcacagctcttacgaatatactaaaaaccattgaattgtgtattttaaataggtgaattatagggtatatgaattttatctcaataaagctgttataaaagaagtgagttacctatgcttagtgatttatggctcaaaacgtttttctccatcactaaaatgtctgtgattcattcctgtacattgctaatgagaatgctaattagtacagcccttttggaaggaacttcggcagcatctaacagaactgcatatgcattttcttttgatccagcaattccacttctgggcattcaccctgaagatttgcttccagcaataaaataatatgtattatttgtaattgcaaaatacagttatatctaggagacaacctagttgtcagtacataggaaagtgattatataaactatggtatagccacaaaatgcagatgtgaaaaagaacaaggaaacttctatgaattgatagtgattttaggattgtgtgattaagtacagcaaacaaagtgtaaaagagcatctataccacacttgcttaggtagtaaagaagccaagataagataatatacatctgtctgcaaatgagccatagaaaagataagccaggaaccacagacacagttagtaggtttagggtagaaataatgagggatgggaatctgatgaaaggaaatggaggaggttgtgacagtactgagtatacctttgtatatagttctaacttggaaccacgttaatgtttctcatacttaaaaaaatcacagagaagaatcaaaatagactaaagcagagacaaatgaactcatctgtatttcaaatgagtaacatagttatggaggggaggggaacagactaacacaacttttgaacacagtgtttggactatatagcttcaggactgaagacaaaagtaactttaaaaaatattgaactctagtttttaggctttccgttttcctggagagctatgggctagcaaaccaaaactatgttctgtggtataccaggattgagcaaataggtaaatattttatgggtaatagaagccaggtttttgttggaggagggagttttaaaagtagaaagggagaagactcgaaggaagagatcctgtaatcttccactagagttcatagtatcaatgtaaactcatttccctcccgcctccctccctcccatctgtcagtcgatcaacaatcaaaatagttatagatgagacaggtgtgtacatatatgaatgtgtatgtatgagtatgtatgcatgtgtatacattaatttatttccaagctgtatctggtaagaggtacatacaaagcattgacatctgagaaagtcaggagtgctcaaagaataatagggatgagcaaaagggcacaggatatttgtaggactcccactggccttatctgtgctactgtcagcatcaaaataaataataatagtgatggcttataacattaataaaataagaatctatgagtacatacagatgtaaatagatgaagagggcaatgttcctcttttgtagtcgaataacaactaatgtatataaaaggaacaatagatttagaaaatcaccatttggcaaccattatggtaataagtgattcatgcattggttagtaattgattaatggatgttaaaaactaccaaagtgaaagtttgatgagtaacaagatacttacatagatagattgaagatactgcctcacaagatactatttccagagagaaagttgtaactttacagtggagaaattttgctgacaggattgtaaccatgtgattaaagttttatcaccagtaaagggacaagttgacaagtgtctcctgatatagagcactgagaagacaccatcacttttgtgttattcctgccaaaaatctaaaacctgaatctaatcatgagaatgagacaggctcacgttaaaggtcattctacaagataactgagaagtactcttcaagtatgtcaatatcatgaaagacaaaaatttaggaattactcagattaaagatgccacaaataagtgcgttcagtgttcgtggcttttcttttcctgtgaaggacattattgggacaattggtaaaatctcaataaggcctgtatattaaatggtagtattgttttggtgttaagttttaagtttcctgattttgaaaattgtattttgattttaagaaaatattctttttaggaaacacactgaaatatatagagtaataaagtatcatgtctgaaacttcctctcagatggttcagaaaacatatgcaggtagacaggaaaacagagaggaaaaaatggttatagcaaatgtgattctttgaaaaagaacaggataaagtaattgtggtaaaatgttaccacatgtgggatttaggtgaagactctatggggattctttgtgctagtcttgcagcttttctgtactcttgcaaattatgtcaaaataaaattttaaaaataaaaagatactttacagaaggtttaatgaaactgcatatgtttttgagagaaggaagaataacaaaattattaaatatccactttgttagattctttgagagatactgtgcaaagtacttctgtgtactttagtatttacaacaatcctgctttaatatttacagcaatcctagaggttagatactagtttgtaagtttttatataggaggaaaataagaaacaaatgggttggaagactggtctgtagttgaaaaagtaatgaggcagagttaggattccagccctaaattgtttgacaactaatttcgtatttttttttctctaccaaccttttacttagatccgctttctaagtgatttttatgaaaaagttttatcattggttaaatttgtgtggtaaggcattaccaaaaaattcatttagaagctatctttgcttttgtagttaagccatttacagaatgtatttgtttaatacattttaaaaaatcattagccatgtggctcttgagtttcgaatagtggacctccttaaaatatatttggtttaattttataaatgttttcccatcattttctttaatgaaaacatttgcaatattcataaaatgttagtaagggacaatatatagcaaacatttttagcttatgtacaaagggcaacaacatgtttatagtatcttttgtgattagtagattaagttcattttgacattggaatttatgtactggcatttggcttatggccatgatctaataataagggtatggtaacaggtctttaaaatattagtaatcaaaatgcttttatctgtagctgacaaaatgtagtctaaagcaagaattaaagccatattagagtgattgaatttgctgttaaaccttgcatttaaaatagttaatgataaactttctatacaatggcattcctgtactttgagaaggaaaatatctgtgaatgatgggtcttttaatgattgttaataactagccacataatgattgaaatttcttttagcaatttcaaattattagaatctcattattctaaaaaaatgaatttacctaataaagcctgcctagctgtattatctgtgtgaatatgttaaaaaataaaatatgccagtagctaagcatatgctaaaaactaggggttttttttgtttgtttgttttttgtttgtttcctgctatttaatgtgaggcactgctaaacttttatatcagacaaccaacagatagccaattacaagtaataattttaataaaactttaggttttaaaagtcaaattttctttgtatctaaattgagcttcctacgtatttatcgctaaatataatcagatacttgggcaaatggctggttttatatctgaggcaagaaatgtacaagagaaacatggaacatcttgtcacactagataataggaagcttcaaacactactgggcttttgcagaaggactcagggtccaatttgaaaaactaatagcttggctaaaaatgggacaacttgagcaggaataaagatgatatttgcaatggattgagccacaccgtatatgtttaaatggatgagttcataatgactctttataagatcactagttacactggtggaggatgctaatgaaacagtcatttttttttaaagtggaaaatggaaggaaagaattgagcattcattctgtcttttctataagaactgtaccgttggacaactaaatagtagataaaaggaagtttcttttttttttttttttttttttttgagatggagtcttgctctgtcacccaggctagcgtgccgtggtgcaatttcggctcactgcaacctctgacttccgggttcacgccattctcctgcctcagcctcccaagtagctggaagtacaggcggccgctaccacgcctggctaatttttttttttaaatatttttagtagagatggggtttcaccatgttagccaggatggtctcgatctcctgacctcgtcatccgcccgcctcggcctcccaaagtgctgggaggaagtttctttttatagaactattacagctaatacatgaggaaggaattataaaattataatgttacaaatttgtatttaagccctaataaatcaatgaatctaggcattgagcatcatgaatactaatattaccagaagacagctagacacatttgcttcctgatgtaagacagtaccacgtgtgaagtggtctctcccacccagacagttgaatcttaatcagatcaaacatctaaattcacctagtaacttaagggaaatactgaagatgaaaatagtaaagaatagcaaggagatacaactttgctgttagtagcaagaaaaattgagattgtgggacactgtatagcacagacaactagtttcttcctccctccacaaaatctcaaggaaaaaatgtgaggggacatattttaaaattttaattaattaaaataaaaatttagatcctcatttgcactagccacatttcaagtgctcaatagctatatgtatctagtggctaccatattggacagtgctgatttagaacatttccatctttgcagaaggttatattgagcagttacattagtttcttaaggctgccataacaaattactacaaaatgggtgacttaaaataacaaatttgttccctgacgcttttggaggacagaagttcaaaatcaagatgttgcaaggtactggcaggacatatgggggaaaatttttttgtttgtttgtttttttaaataaaaggccaggtgtggtggcttatgcctgtaatcctagcactttgggaggccgaggtgggcggattgcttgagtccaggagttcgagaccagccttggcaacgtggcagaatcccgtctctactaaaaatataacaagtagccaagagtgatggcatgtgcctgtaatcccagctactcggaaggctgagacagaggttgaggtctcagtgagctagaggttgctgtgagccaagatcatgccactgccctccactctgaacggaattagaaaacagttaatttaaaaattcgatattctgtgtgtgtgtgtgtgtgtatgtatgtgtggagagagagagacacacacacacagagaggtggagacagcgtttgtagctttgtgtgtgtgttttggctgttgaaattgttttgaatccagtatttttgagctgaagtttgtaaaattcaacaaaaggaaaaagtaatctgtttttggcaattgagtattggctaaacgttagaaatgtgtttgttcatgtttttaatatcttatgtatactgatgttaggatacttctatagagcttctcaaattgtagcacatatcagaatcacctggaggatttttaaaaacagactgcttgacttcatcctcagagttttcaacttactggcttggagatagggcagacagaatttgcatttctaacaggttcatatgatctgatgctactggttgcgggaccactctttgacaaccgctgcacaataattaaaaaaattaaaaaagataaaatatgtacggtaacaaagatctgtcttcgatgcatgaagaagctattctcataaatgtatattaaaaagcatgcatttgtctgttagagaatcatttggaaccttatgtcttgtgtttgtaacttgcacagcttcaatactgcaatgatcatttctacttttctctgaacaaaactcggttcattgtactgtatcgagtagtagtagtatgtacatggatgagagaagttcagagttagtgaaaatagtgaaaagaatacataatataaagaaaaaccgtgattccactaatagttatccagacaaaacaataaatttttagggaaatgtgtttgccagaattgttttaaattgtagtattaatatttatatgaacgagaatgaagttcagagttagtgaaaatagtgaaaagaatatgtaatataaagaaaaatcatgattccactaatagagagttacccagacaaaacaatacatttttagggaaacgtatttgccagaattgtttcaaaaagcaagggatgataaaaactaaattcagcattgtggttactcctccaggagagaatatttttattccattatttgtctatacctcacatacatgatacaaataattcttttgtttttagtagtcaataagaatagttaaatactaaagcaaaatactcttatttccttgatagaaaaatatcttatgaagaatgaaagctctctttggctctttagtggggcctactatcccttaggccagatattgctggcctaagtattcagcaggcccaactaaaaagcccaagggagctttattcttcataagaaattctaaagatagaatttctgcaatgatgggaaattttctttttaatttgtcttgtcaaatgtggctgtgactgagcaactgaatttttaattttaattatgtagttttaattgtgtaaaatgtgctggtggctacctcattggacagcacaactctaggcagtttagaacatagcttatcacttgagttatttagtctgttaattcttttatagaacatgcagtgtttggatggccgacattttgcttaggtcactcatttttgttttcttgtttactttgactcatacctttgtttcttatgtttaacaggaagtttgatttactttcttatgctttacattctgaaaattgagtctttaggataagaagctactggacaaagtttattgtcaacagtaatatgtacccataatgttatttgaaattttcataaaatcatgtttttttggtcagtttttaaattacttttcatcttttcattgactttatttaaaatatctctcccattgactttcctgagcccccaaacaaaattatttttatttaatttagtctataccttgagtcattcagtaaatattacttgcttgttgtgaaccatgcattcctgagagatgggcaatgatagtagaaatagatcctgacttatgatatgcttataaactatggaaggcaaacattctgttgtagcatgtttgaaagtgtttttaggaagcagaatgtgtctgagagaaacacgttgaatggtcatataatagttaaagaaatacagtaagagagtatgtgaatcagaaggggccaatgaaaaatgtttatagatttttagtattgctttccttagaagaaaaaaattacagatttctaccttgtatgttctttatttggtcacttgatggtcaaggagattgtgcatcaaagttcttagcagtattattcctgctatctaaatgttgtgaattcttaatgtatgacttctgtgacctgtaccctgaaaatcttcattacttgtattcatttgcagaagttttattggatactctgtgtaatgtaactgaaaatttcctgttaatcgtaacagtggatttgtgtctgtattgtatttccttagtatgtccagctttgaaggccaggtccagaatgtagaatagatgaagctattatagatttatatcctcatagtttacatatgtatcagccattgttcatttataagtcaagatttttgttttggctgagcacggtggctcatgcttgtaatcccaacattttgggaggcctagatgagacgatttcttgaggccaggagttggagaccagcctggtcaacataaagagactgtctaccaaaaaaacaaattattttttaaattagctgggggtagtggcatgcccttccgtctcaggcttccagttagcttggatgttgaaatttaattgctgttgtaacagtattaacaggtgggaccttaaagatgttattaggccatggatgggattaatgccattataaaagggtgagtttggcccccttttggttcttgcccttctgtcctctgccgtgtaagaatccgggcagtgtgcagagtgcaatcttggaagaagaggatggccccacaatacattgaggctgctggcgcccttactgtagacttttcagcctccagaactgtgagctagtaaatttctgtttataaattacccagtctctggcattttgttgttgtagtacaaaacagactaaggcactttgctcatgctgcgcctgctgttcatagtctttatctgacaccttagacttagcatttcctcaactcccatgttttactcccactactgtgacagccagatcagttgtcatgtcatctgtgcacacagcctccaatttcagttgtcttctcttttcctgtaggattttgttcattctgctagtcatgtttggctgtttactcatgtggctctcttctctcagatttgtgctttccgtgaagatagatattatttgtatgtttatttgggatgcctagcataacactggacatgcagtagatagttgttggataaattattgaatcacctaaattctcaatactcaagactagaggttgatatttgacatttatggaagattaggtaatcactttcatagatttatttaggtttagagcaggaagcctcatatttctgcattttcaataataaattccggactaatgatgatttatctaacaacatgaacttgtaatagtcatgtgggggacactacatttatcagaggctactgaaataataatcttgcttcaggagagtctttactgaaagtttactatatatcttggtttgttatgtgctgctataacagaataccggagactgggtaatttatgaagaacagaaatgtattctttcacagttctggcggctgccaagtccaagatcaaggtatcagtaggtttgatctctggttctaagagatgtcttgatgaagccatgcattgatgcctctttgctgtgtcctctggagagaacggatgttgtgtctttatatgatggaagagcagaagcaagagaacaaaaccacttctgcaagccctttttatagtggtgttaatctgttcatgagggtggaactcttaagacataaacatctcctgttaggcctcacttctcaacactgtggcattggggattaagtttcaacatgagttttggaggggccaaaaacactcaaaccataacacttatatacaattggtctttgaacaacatgggggttagaggctctgactccccacacagcaaaatctctgtatataacttttgactcctccaaaacttaactacgaatagccttttgttgaccagaagtcttactgataacataaacaattaatacatatttttcatgttatatgttttatatgctgtattcttacaataaaataagctagacaagtgcaaacattaagagaatcattgggaaagaaaatatatttactaagtgtaagtggattctcataaagatcttcatcattgtcttcatgctgaggaagaggagaggttggtgtggctgtctcgcagaggtggaaggggcagaagaggtggggagatagaatgggaggcaggataggcaggtacacttggtgtagcttttattgggggaaaaaaacacatgtgagtggacccatgcagttcaaacttgtgttgttcaagggtcaactgcagcttttcttgattctaaatttagatataatttaccaattcattcatttaacatttattgactgtctacaaagctccagagactcaggtaggctttagagataatagtggggagcaagaaacacataagctcttggggcttattttaaaaaagaataaagtaggtaaagagtgactgtgatgaataattcaaaactctaaagtttctttagttgatatgactgaatttaattttagacaatcacattttatgtgtttaattaaggtaattaaaatgctccaaacaaggttgagaattcttacgctttttaaaaatataggtaaattcaaaatcttttaattttgatggtgattacatgtaatacagatttgcagaaaaatccataattatagaattggtgctgactcactttccagtgacctgataactgtctgcatcatttaccattgtgaatgaattacccaagtcagttttcagacaaatttgcagaattaaccttagtaactgttgaacacattgctgctttaaacaacatattgttacattttttaaaagaaaaaaattaaatttgtaccttgattctgtaaaccatactttaatctttcaaggaggaagaatgcgttctctgtagaaaatagattaaatagaatcttctctcctagtgatttaaattggtttaattaaaaacaaattctatatctgcaagagaaacagttgctcatctaattcaaaaagtaactgctaattgagaagtcatttatagtctgtcttaccatacattatctgatttccttgtagtagatatacattctgaattgcttttgaagtagcatcagagtaggtagtaaatatgtggtaggtgttagtttgggattaaaatatgtaacaattctgcaaatgaattatataaaatggtcatattgagggactacacagtatatgaaggtcagatgacatatttggaagcacattgagagaaacaaaatattcttacacaaggttgttgttagaaatagtagtagcagtgagaatatgggacattcttaatgattcagaattgctggcatgcctattttctgtgaaccttgatatgtattcaactctgtcctgttacctttgtctcccgtagtcattctttgactgctgctgctgcctgtagtccactgtaagcctctcttggcaaaagagagattggtaactattagagagagaagttaaagacatgagccttattgtggcttgtttgcttccttccttctttccttccttcctttctccttttgtgaatggaactgatagaaggttgcatttctttttgcaagaaagctgtagagggaaaataattatataaacctgttttttaaaatacaaagatattactgcacagttctttagcctcaaaccttgaaattggatttgccttggaatccaaaatattctgaattttaaaaactgtattagtggtaaatactatatattatgtaacatttcctagagagatctattgcagaaccctataatcaaatatatcagcaattctgaattgaaaaatactaatatgcatttcagttcaggtcaggttttaccgtcaaataagttatgtaaaactttagtctttagaactttgtggattttaggattttgttcaaggggctaggcacggtggctcaaacctgtaatcccagtgctttgggaggccaaggcaggaggatcagttgagcccaggattcaagatcagcctgggaagcaaaatgagactccgtttctacaaaaataaaaatgaaatcagccgggtagggtggcacatgcctgtcatcccagttacttgggaggctgaggtgagaggatcacttgagcccaggaggtcaaggctgcagtaaactatgattgtgccactgcaattcagcctaggcaactgagtgagaccctgtctcaaaaaaaaaaaaaaagaagaagaagaattttggatcaaggattattgacctctttttgtttagtgtttcttaggatatgtagaacctattcttgtgaagagagaaagatacgttgttcttctgttttcacctttatgaaccatatatgtttctggttgaaattatgtgtataaacacgtgaacacatttatacattatacatatatgtgcatacaactatatacaaatttaggaaaagcatgtgcatggtgtgtgtgtgtgtgtgtgtgtgtgtgtgtgtgtgtgtgtgtgtgaagggtggagagggagagaaaggtggatggttgggacaaggggagtggttaaccgggcctgttagcattgtttcatccttgtgctagctcaggtttggtacctaacatggtgtgaaataagaccttaattgcactttcacagctgtgtttagcacgtaagctgatcatgaacaaattctcttgtcagagataaaagcttgaaattccaagactatgtaaaatcacagacaattagagtgttctgtgtaccgtacaaaataatggtaaaaaaaattcaaacggtcatagcacagtatagtttaaactgctgttttactaattcttctggagtgagaaacattttctgtagtagttaagcacccaaagaagccattttaccttgcctgttaaaaaatgtgtgcaaggtctgtggttcaagattgagaatgaaggatgtgtgagccaattgaataggtaataggagttcaggtaagcagtttaggtaatggtttaaattggagaaaggccagaccatagggattaacaccctaccattatgaaaagtcccataagatctcagatgacctcaagaggcttgtacttttgtttgttaagaacctttgtaagattgtgctaagacaccgtgaaaaatactgaggctgtaatgttgcttaaccatctaagtaccagtaaatgtggtagaaattatctttctactcaattatagcaactaaaagtcaggccctgaatcagtcagaggaaatgaactcttgggttggaatgcacataatttctttttatatatcaaaatgttcagtatttctttgaggtcccagatctgaacaaacattatttcatgagaagatacacttttatttccttccagtgcttctacaatgctttttctccaatcccgtgttctttgctgacaacagcaagtgtgtgttctttgagaggtcaataaatgctgatttctgcaagaaaactcttaggaagtgagcctagacattgtgaagaggaagtacaaagaatgaggcaattaaatgaagaatattgcaaaggattattttaaattgtgagtcagaagccaaactaattttgactactaaaattgtgagtcagaagccaaactaattttggctactaaattagttacttccctcgggcctaccaatcttcatatgtataccatggcttattttgacttagctggttaatttatccagatacgtagatggtagcaaattggcattatcaaactctactttttcataccaaagagcaaaataagtgtgcttataaccgtagttcctgtctttataaaaatgtatgaataaatttgagccatgtaaattaaggttacagaacagatagcatttagtgaagaaaagctggtccttagagtatatcattatttaccccatagtacctacctaatgaaatctagttttaatgattctttttaggacaccaaagctcatgaagcctattacaataacgtgtttaattctgagtaattgtttttcctatttaaatgaagaactcagtgactaaaaatttatttcctgcaaattttcttagatgatagaagttatacgtagtaaaaccaacaggaccaactgtgaggctgaaggaatttcagttaagaggttttaatttttatcaatttaaactgtgttttgaggagtggacagaaagggaagagggatattttgagatcacccagcagtttttgatcttttgtcagttcttttgtaatgctatagatgactacaatttgaaacttgaaataagaaattttttgtattgggtgattcacaaactgttgggttttctgaatggcttaaatcctttaaagaaacagttttaaaaagacatagcatgagaacaggatcataattattctgtaaccagcagtctgtgttggttacagaaagtatgcttttgtttaacattataaataaattaccttatattgctgcttacgtttctggtttttggtgtgtatgttatcaatgttgaccaaaattaactgaatatggtgacaaaaccagagaaaaaatttgagcttctgttgataaataaaatgtaaatgctactttttgaaataaaactttacacttataggcttttatgtatgatctgtgttttcttgaggaaatgttgattaagtagtttccattttggtattacagtatgtcctgttgtaagtagctgactgtgtaaaaatcttttaagtcaaaaaagcagctcagcttaaacccctactatttattatggcagaaaccagaaatagaaatcttccagaagttttataatgtattacattcctgcatatcttttggagtaaaattaaagttttaaaaagaggctgttcacaacagaagttactttatgtatccttatgtatatccttatatacacagtatcttttaaacacaatttactaaatacttgtctgcattttttaaaaaagaaaaccctagcccaaaatgaatgacaaaattgtctcgttagatttgtaagatgtgttgttaacctataaaataggtgaattaagtataattctgacaaaattagttacatgtaatacatagcaggatgtacttgtttgggatgaaacaaaaaatcttcaaagttttctatagtgttttctgttaaggaactcgtttattgatttattgaagatctttggctgtttttgataataaaagaatcttggtctataatattactaattaataaataagtttttgaggataacgccaatacttgaattttgatatctacttgcaacatgcagtaatgcaatatttagtgagcttaattagttgctttttttttttccaccctgagacaagagtttcgctcttgttgcccaggcctggagttcagtggcgcaatctgggctcactgcaacctccacctcctgggttcaagcgattctcctgcctcagccccttctgagtagctgggattacaggtgcccgccaccacgcccggctaattttttgtatttttagtaaagagagggtttcatcatgttggccaggctggtttcgaacttctgacctcaggtgatccacctgccttggcctcccaaagtgcagggattacaggcttgagccaccgtgcctggcctaattagttacttttaaatgttactaacagaatctgaggagcgtggtttgtgtcctcagaataaatgtttaagctttgagtgtctgcctgtgtcatgaggaaaacagggagaggagaaaatttcttgttgctgctattttatttgcatttaagactagtcattgttaggtaactatggaatcttcactgctttacagttttggtgcatgtcaggttcaataatttttactttaaaaagttatttttacattttaatgagattaaattgtttaccaattaacattgtactataaaaggaacagaaatgtgactggcacttggaaagaaaagctgtcatctgtagactgatgtgtggtattctaatttaaattcgtggtttggcagaattaaatttggattttaacatcatccagaagtaaaagttatgtgcattttcaagataaactcaggaaataaaccatataggaaagactcatttttgcttcagaacacagtaaagatgaaactttgaaaatgctttctaatcattcagtgtaaacctatttaccaagttaaactggtcatgtgatatttcatatatcacttgtattagtatgtggtcttatgcttataaagttaatgtgcttaaaaataacagctaaaacatataggcagtgattattaaacaagaacattaaaatacgattcaaaattgtttaattgtaccttttagcagaaataccattttaaaagatagtaacattttattttctgtcagtaaaaatatagtcatgtgtcacttgacagggataagttgtaagcaattagttattaggtgatttggtcatatgaacttcatagattgtacttacataaacctagggggtatatagcctactatacactagactatgtggtatagcctgttgctcctaggctacaaacctgtacagcatgttactcatcttagtatacagaatactgcagacatttgtaacaatgtgtatctaaacatagaaaaagtacaataaaaatgttgttgtaatcttatgggacctgtcatatatgtagtctgttgttgacccaaatgtcattatgtggtacatgactgtatttttgtttgaactgtttagtgactgtcaacaagaaattgtactgtccaatatgacttaaaatgttagttgctatagttataaagagcacaaagagtgtgcatatttaggattttggtcacagtttttgcactgtgttttgaaagaaacattgaagctaatgtgaatgtagtagacaattagtatttgaattgaactttaaagtgtattatgtgtctgaaattaattccagagtagtgaccttgaaagtccagatcagcaactctgacttcccatgttcaaaacaaagggccttttcttatttatggatggtaaaagatgtaaaaataccatcttaattcttaacagtgtgatgtataggtaatggtgaataccacagtgttactgaagctgtatcatataactcaatagctaaatttaagtaattgatatttttggtctatattttcttttaaaagtatactataatcgtgtttaaactgtttactggttatagcaatgacaatttactttgcaaagtatataaaaaataaagattttaaaaataacattttccaagagatgactatttattgacattttgatgttgatttcctagcttttttctctgcatatattacatattatgcatatttataccaacatttaaattaggatcatactgcttctgtaatgtattagattttaacattagaaaaaatattttaagtcctgcaagcagagaatggtgtttgcattttaaatggttatagtttaaatggttatgagaccctacattatatcctcatttttcctcttgacctgcaaagcctaagatattttcgtatctggcattttaagaaaaagtttgctgaactcttctctaaaggaaaaactgtgttctcctacagattctgtctgcagcattctctccttgcaggacttaaaacaaaacaaacaaaacaaaaaaaccaggcagctgggtggatttagaaatcctggctatagtttgcaaacctttgctttagaagtttgtttgcttatattgtgtttatattttacagtgtgtgtgtgtctgtctttctaaatctttcttgacattattgcctcaaaggcactgagacagcgtgtgttaaaacccaaggacacagattgtaattctagtcttattgctgtaggaatcagtttgctggtttctagagggtgggctgaccttgacttagtaaagtatagtactttttgtctccctagtagaagtattaactgacctttaaagtgaacttgatgcaccctcttcaggaaacaggaaactgttacatttgggtgtgatattaggagatgaggatactgtgtaggaggtgttggacctgcctaaagtgtttggccttgaaatgtcaaggttgctctcccaaacctagttttccttgacctggctgtttttctaacttcagagacggacttaaacaatagagtttattagattatatgtctgtgtaaacaaatgaagattaaaagacaaaaaataaagtagttaaaaatgaaatgtcttactttttcttgttttaggataaaaattgtattaataccttaaaatgtattcagcaggcaaaaacttcggtagtttcggtattacagtgacaccatttatttttaggcatagtcttgtctttttttttttttttttttggtaaatattataccattttcaacttaatgtgaaaagcttttccagttaatctttatcgtgtgtgtgtgtctgtgtgtgcgtgtgcgtgtgtgtgtgtgtgtgaaagaaaatgtgttttaggcagcatcagtagagcaaaataagatttaatgttgttacttcaaaactgtatccctaacaagacgatacaaaattcagagtgttttggccccttttctaggacagatttagaaacttatagacttgtagttataggataaatgtatgccaaagctttcttcaaagaaagctccatcataaggtggtttttcttcgtggtgcttatattttacaggaacatttagagggatgtggtgtttctatttttctttgcccttctaatcagcaattaaaaaaatattggatctacaggtttggggggtaaattctattgcagatttgttattaacactactctacatatctgttggcctgtagcatacttactgcagaacttgtagcttgatagcccaatgtgttcttgggttatgattctgaaatactgctgagctttaaaaactttagcagctttgaccagaacacctacgttaaaatttctttataactcttcagaatttttttctttttctttttttttttgagacagggttttgctctatcacctaggctggagagtgaagtggcataatcatggctcactggagcctctaccttccaggctcaagcaatgctcctacctcagcctccacagtagctggggccacagatgtgcaccactgcacttggctaatccttaaatttttttgtagagatggggtctcaccatgttgcccaggctgctgtcaaactcctgggcttaatcagtcctcccacctcagcctcccaaagtgctgacattacagacgcgagccactgtgcctggccagtcttcagatttgttaacaaatctcaggggtttgctttagtctcccaagctcgccttacgtaaatgtgtcatgtaatgaaagatgatattcccaacccaccatctcacatattcagttgattttcactaaccgtgaaggatttgcactgatttatgcatccaattctctcctgatttctttacttttcctcctcttttctctttcctcaccagtcttccgtttccatctaatgactagtgtcccacattggacaagataaaatggttgaccagttagagacataggaaaaagtggaatattgaatttgcattgaaagggctgaacttgtgaccttatgttatcttccatataattctaatttctacaatataaggttttaatttactcagttcagaaaatctaattgtttgacagtaaagtttggacctatttatataaagtttggaggaaatatgatcttatcaatatgcactatggaaaatgtcctttttagtctgtgaatttagagctatacctactgcttgaatgaagatggtctaaagatttaaaagacatttagggttaataagttttcatggcaaaacatttaacatttttaaactaaattcagatgagttactcattttttgtgtaccttaattccttccaaatactcttctgtcagaactacaaagttaaatctcaattatagtgcccttttttttatttagggaaataattatcatcattgattaatacattgtacaagggttaactgtcttttaaccatcagggtatagaaaaagtaagttggttaaaacaacttttaagtttattatggagataaacactattgtcatatgattctttagatttccttaaaaattgatctcctatgccaggcacagtagctcatgcctgtaccctagtactttaggaggctgaggtgggaggatcacttgagaccagcagttccagatcaatcttggcaatacagtgagatcgtgtctctactaaaaaaaagccaaaaagaaaaaaaaaaaacctagttgggcatggtgatgtatgcttctggtcccacttactcaggaggctgaggtgggaggatgatgtgagcccaggaggttgaggctgcagtaagctgtgatcattacactgtagtctagcctgggtgacagagtgagaccctgtctcacagtaaataaataaataaaaatttaagccttgcttctaaatccagtctcctttaattaagttttattgccacattctttctgcttttaattttttgttgttgttgttaaaactaaattttacagcttttgtttctcacgtagcagccagggtttgaaagagattaagggtcattcttctgaaataaaacatgtcctgaataattttaatttgagtctactattgaaagtcacataacattttgttgaatggtgattcttacctaatcacctgtaaatggatcacagacacaaatacctagtgatgtgctatacattatgccattgtgaattttataaaggctaaagagtgaggaagtagagttcttcttttctgatagtgcactacaaaattttgaggaccttgcagtgatcatctgtagtcataaaagctgtttagccaaaacatgattggattttattaatagtgttacggctatcttttcatgagttagttaccatgtgaattagtgcaattttggtgaatagaagaatgcttaggactattgtcttattttaaattaccgattatctttttataaggatatttgaggagttcatgtgtcagtgagaattgagcaactgagaagaagttagaggttagttcccttttccaagtatgatggattaaccacatgcaccccgtctttctcactgaatgcatctataaaacctaggcaaaatggatggaactcttctggactctgcagaataaataataccaggtgggatatgaatgaagactagcattcagaataccatctcactggctgtgagtttaccattttttttttcttccagcatccccagacaacttaacacaatctaaaacctaaaagtggggcaatctgaaacagaaagctctaaaagacgcctgctacttctggctcaaggaacaggaaagataactgctaagttcagaatgaaaattttgtcattttttttgtcttctccatctctcatgccctattcccaagcaaccgtgtggtaatggcagcagagactacagcaggagcccatggtcaaaactgagggatgagaactttcctctccagttgacaaatcccattgctttttctttttccttcttcatctctttgttcttccatttcttgtttccaagtcagatacagtatcagaagtgtgacccaagaagagtaccaaagatgcagcattctggatgaaggaattaaaagggatgcctcagagaattggaaagtactgagaccacgtgtaaagagaagcttggaaaagcaataccataaagttctttatgaattccctgaactatacatacttggaaataaaggctgtcacccaggctaaccattcgatgatacaaaagtgggacaaattcagatggcacagcataagcctttgaaagttgaactgatgctggaaccatggctatagaagccatgttagagctcatggcctaatcctaaccaaatgaatcacttgttaaaacaaatatattaccagtgtccacaggatttaaacaggaaccagagtttcatagcaatatgttaaaattcccaggttataatccaaaattagctaacatatgaagaacaaggaagatttcaactcacatgagaagaggtgatcaacatataccatcatgataataacgttggaattatctgacagagattttatggtagctattataaaatgtttcaacagacaattgtgaacactcttgaaatgtatgaaaaagtctcagcagagaaatagaagatacaaagaaatggaaatgttagaactgaaaaatacaataagttaggggaaaaagaccactggatgggtcaatagcagaatgtaatggcaggaaaaaaatcagtgaacttgaagataaatcaatagaaatttttaaatctgaacattagagaagaaagaattttaaaaaattgaacagagccttaggatattatgggaaaataacaaagtgttagacatttaaacaagaaccaaaatttcataacaatatttttagacatccaggttgtaatccaaaatctaacatatgaagaaccaggaagatttcaactcacaatggaagaggtagtcaacatatagaaagaatgtagttttgagaaaatatttgaagaattaaatggctaaagacctcacaaatttattgaaagacacaaacatacagattcagagaatcagaaatggaataaatccaaataaatttatgcccagatatgtcataattaatctgaaaactaaaaacaagaaaaaaactattgaaagcagccagaggaaaatgacattgctccttggggggagcaatgattctaatgacttcagattttacatcagaaaccatgggagtaagaataaagaagaaaaaacaatttgttcagtactgaaagaaaagaactgtttataactagcaaaagtattttttaggaatgaaggtgacataagggcattttccggtaaaggaaaaactaagaatatctgttgtcagcagacgtgatctaaaagaattgctaaaagatgttcttaagacaaaagggaaatttatatcagaagaaaacttgacattaggaatgaaagaagataaacagaaatggtaaatatttgggtaaatattgtagatggtttttctcctcatgaattctttaaaatacgttggataattgagaggaaaagttataacattatctgatgtgattttcagtggctgtggcatcaaatataacatctatgatccacttgaagagtaaaatattgattccaaatagaccctgaaaagttaaatatgtatgttataatccctagagccactacttacaaaataagtaggtaggttagaattacaatggataaattaaaaaatattcaaatatcatgctgttttggttactgtagccttgtacagtttgaagtcaggtaatgtgatacctgcagcttttttttttttttttttttttttttttgcttaggattgctttggctatttcggctctttttgggttcaatttgaattttagaatagtttttttctagttctgtgagaaatgacattggtagtttgataggaatagtgttgaatctgtaaattgctttgggtacttaggtagtgtggtcattttaatgatgttgattcttgtaatcagtgagcataggatgtttttccatttatttgtgtcatctccgattttctttcagcagtgttttgtaattctccttgtagtgatcttttacgtccttgattagctatattcctagatattttatttttgtggctattgtaaattggagtgtgttcttgttttggctcttaggttaaatgtcactgctgacttttgtacattgattttgtaccctgaaactttattgtagttgcctatcagctctaggagccttatggtatagtctttagggttttttaggtatagaatcatgtagtccatgaagagagagagctcatcttcttttcctatttggatggcttttatttcttgctgttgcctgattgctctggctaggacttccagtactacattgaatagaagtgctaagagaggcatccttgttccagttctcaaggggaatgcttccagcttttgcccattcagtatgatattagctgtgggtttatcatggattactcttattattttgagttatgttccttcaaggcctagtttgttgagggtttttatcatgaagaaatattggattttattgaaagctttttctgcatctattgagatgatcatttggtttttgtttttaattctgtttatgtggtgaatcacatttattgatttgtgtatgttgaaccagccttgcatcccaggaataaagcctacttgatcatggtgaaataccttttgatgtgttgggggattcagtttggtagtattttgttgaggatttttgtgtctgtattcatcagtgatactggcctgaagttttctctttttgttgtgtgtctgccagcttttggtatcagcatggtcttggcacaaaaaaagatgatgcaacagaatagagaacccaaaagtaaagccacacacctacaaccatctgattgttgacaaagtcagtaaaactaagcagtggggaaaagacttcctattcaataaatgttgcttttaataactggctatccatatgtagaagaatgaaactagacccctacctatcagtgtatacaaaaattaactgaagatggattagggactttaagacctcagactttacaaatcctgtacgaaaacctggaaatactcttctcaacattagccttggcaaggaatttgtggctaagtcctcaaaagcagttggcaactaaaagaaaaattgaccaatgagacctaattagagagcttctggacagcaagagaaactatcaagggagtaaacagacaacctacagaatgggagaaaatattcacaaactatgcatccaacaaggtctaatgtccaaaatcttaaggaacttaaatcaactagcagataaccccattataaagggacaaaggacatgaacagacacttctcaaaagaagacatacaagtagccaacaaacatattaaaaaatgctcataatcactaatcgtcagagaaattcctatcaaaaccacaatgagataccatttcataccagtcagaatggctttgttaaaaagtcacaaaataacagatgctggcaatgctatggaaaaaagggaacacataacactattggtgggagtgtgtaaattatttcagccattgtgggaagcagtttggagatttctcaaagacctgggagttgaactaccatttgacccagcaatctcactgctgggtatatactcaaaggaaaataaattgttctgccaaaaagacacatatacccgtatgtccattctaacactcttcacaagagcaaagacatggaatcaacacatgtgcctatcagtggtggattgggtagagaaaatgtggtacacatacgcaatggaatactatgcagccataaaaagaacaaaatcatgtcctttgcagcaacatggatgcagttgagaatcatcctgtgggaactgatgcagaaaaagaaaactgtacaccacttgttctcacttacaagtgagagctaaatattgggtacacatggtcataaatgagaacagtagacactggggaatacaagagggggaggaagggaaaggagtaagggttgaaaaataactacttattagatattgtgctcaccacctgcaggagggattcatttgtcctccagacctcagcaccatccagtatacctatgtaacaaacctgcacatatacccccagattctaaaataaaagttaaaaaatattcaaataacccaaaagacaggaaaggggaaacagggattaatgagaaaacaaataataaaatggtagatttaagttcttacacatcagtaattacgttgaatttttaaatgctgtaaacaaatcaattaaaagtttgtcaagagtccatagaaaaaacccactttatgctgtctattggaaacttactttaaatatggtataggtgggttaaaagtgaaaagatggaaaaagatatagcatgcaaacactattggaaagaaaaccctagtggctatattaataacaaagcaaacttcagagctaagctaatacccaaataaagaggaacattacatattgataaaagaattgatttgccaatcctaaatgtgtaagtagctaacaacagaatttaaaaatagatgaagcaaaatctgatagaacttaaaggagaaatagggaattcaataattataatagaaaatttccacattcttctcttacgaatagaactagtagacagaaattactaatggtatagaatgcttgaaggtggtctgggcgttgtagctcatgcctgtaatcccagcactttgggaggcctaggcaggtggatcacttgaggtcaggagttctagaccagcctggacaacatggtgaaaccccctctttactaaaaatacaaaaattagttgggtgtggtagcacgtggttgtagtcccagctactagggaagctgaggcacgagaattgcttgaacccaggaggtggagactgcagtgagccaagattgtgccactgcactccagccttggtgacaggggtgaaactctgtctcaaaaaaaaaaaaaaaaaaaatgcttgaaggagactatcaaccagataaatctaattgacatttgtagtatgctttacccaataatagcagaatatacattctttccaagtacagaaggaactcagcatttataattgaagacttcaaaattcttttcttaggaatagatagaactagtagacagaatcaccgggggtacagaatgtccgaacaacattatcaactagatagatctaattgacctttatggaatactttacccaacagcagcagaatatacattctttccaagggaacaatgctctaagacagactgtatctcggtcttaatacaaaccttaacaaatttaaaagaattgaacttacaaaaaatatattctcagatcataatggaaatatattagaaatcagtaacagaaagataacacagaaatctccaagtacttagaaattagacatggctgggcgcggtggctcatgcctgtaatcctagcactttgggaggccgagacgggcggatcatgaggtcaggagatcgagaccatcctggttaacgtggtgaaaccccatctctactaaatatacaaaaaattagctgggcgtggtggcgggcgcctgtagtcccagctaatcgggaggctgaggcaggagaatggcgtgaacccgggaagcggagcttgcagtgagctgagatcgcgccactgcactccagcctgggtgacagagtgagactccatctcaaaaaaaaaaaagggaggggggagcggggagaaactagtcaaagaacaaataaaccccagtaacaggagaatcaatgaattaaaagcagtaaaacagtagctaaaatcagtgacattaaaagttgagtttccttttttatagatcagtaaaattgatcatctttagcaatacagcagaaaaagggaagacataaaaaactagtatcagcaaccaaacgggatatcattacaaactccacaggaattttaaggataagtgatactaaaaaactctatgcacataaatttgacaacttaggtgaaatagactaattccttgggacagtaactaccaaaactcacctaagatgaaacagatgatcttgtatagtcttttaactattaagttgaatttggccgggtgcagtggttcatgcctgtaatcccagcactttgggagggcaacacgaggggatcacttgaggtcaggagttccagaccagcctggccaatgtggtgagaccccgtctttactaaaaatacaaaaattagctgggcgtggtggtgcatgcctgtagtcccagcgcctcaggaggctgaggctggagaatcccttaagtctgggaggcagtggttgcactgagacaagatggagccactgcactccagcctgggtgacagagtgagactctgtctcaatcaaaaagaagagtttaattcataattaataaaaaaagaaatattaaactcctgagctcaagtgatccacccacctcagcctcccaaagtgttgggattgcaggcatgagccactgtgcctggcctaaatttcatttcttaatcaaatgctaaactttctcatttttctcttgttcataactaggagtattcattcacttgtgcagtaatatttgaaagacagaacacatttcctatacttaaaatctgtgagcaactttctttttgaccttttgtaatctacttcatctcttgaaatctgttttgtttaaattttaaagacaggatctctctctatcaccagggatggagtgcagtggcaccatcatagttcgttacagcctccgtctcctgggctgaagcgatcctctcgccttggcttcccaaagtggtgggattacaggcatgagccactgcacctggccagaagtctgttttttttttttttaaacatataaaataagggatgatattacttttctaaataacacatgggtcaatgaagaaatctcaaaagaaagtgttttaaactaaatgaaaatgaaaagtttatcaaaatttgtgatgcaacaaaagcagtgcttggaaggaagtttgtagcattgaatgtagaaactagacaaaagattgaaaattaatcatctgagcttccaccttaggaagctaatgaagtacaaattaaatccagtataagcaaaagaaaacatgataaaaattaaagcagaaatcaatgaaattaaaaataagaaatcagtgaacataaaaactggttcttcaaaaacataaaggatgatgtttttccagtctaactttgtttttattatctgtgcctccttattaatgatttctagtactgcacaccaagcctgattatttttgccactgaggtatgatttgtgtcaaatttaccattaccagggcttggctcctatttcttcattttagtttttcactgctgaaattctttcttagtgctttattttgcagttgtcctgtttattatgactctacagccatttttttcctagaaataaattttgccttttctgtaattattctagtgcttttatttttaaatttttaaaaatttaaaaaaaatttttttttttttttttttgagacggagtcttgctctgtcatcacccaggctggagtgcagtggcgcgatctcggctcactgcaacctgtacctcccaggttcaagtgattctcctatctcagcctgctgagtagctgggattacaggcatgtgccaccatgcctggctaatttttgtattttcagtagatagggttttgccatgttggccaggctggtcttgaattcctgacctcaagtaatccgcccacctcagcctcctacagtgctgggatttctaatgcctgtttatatttcattgtccaggaattccacaaattgtattattttttgtaggtttcacagatttgaataccagcctccaatatttcagtaagtatttccaccaaaaaggacgttcttctacttacaccacattattttaacaaagaaaattaacagcaattcgctgacatgatttctatttacattccccagattgtccccaaaatgtctttcatagatttaaaaaatattcgttggatttgattgttgcatgttttagtttcttttcatttaaaatagttttccttatacctgatgtttcagaaagcagagcacctgtctagggatgtctcacattctggatttgtctgactttccttgaagggtcattcatgtgttccactctctcccatttttcctgaaacattaatttttttgtcagtaaaatttcttaattgatgctatatatcatcacatcaataggacatattttcgagtgactggttcctagttctgcctgcttccattgtttattctagaggttgtcttttttgtaagagttcaaggagaaagccacaggagaaggattgccactgtctttggaaagccataggagtaaaagagtgagtccagatatggaaggtgttacaacaacccttacataactgtccggattgaaggagagcatgaaactttctagaaagagagaaaccaataagccttgaatttgaatttgagattataggtattttgaagttgagaagcgtatctatgtccctagtttttctaaatatagttttcattgtccatgttcagaagtcaatgattggagcacaagtggtgacctatgcttagtagctctaaaagactaaaattaggagttgtctcaataggcaaagacatgatggtgattgtgttgtgtgtgcaagatgaagagatggggtgggagttgttgggggtatagttacctgttccacatgccccatgagaaaacaaacacttcttgcacatcttactgtccagaaaattgagaacacaaaggaataaccaaatacgctttacaaaaaataaaaagcctccgtgtttcctccctaggcgagtgcccttaaaatcatactcaatcacaatgtttacattatttactatataaagtctattaaaacaaatattatccacctaacacatatatcttcatattcataaacctgagattttctgtgtagtgacatctacctatgttgattgactataattaattgactccttctgtattttttgacacaatacagagtactgaactagcaaaagacagttatcggtcaagcatgtcatttctagattcccacatagatatatcccaattcaaaaagaaaactaagtgacttgagagaagtttctaaaagctttccttttgactgacgaactgtcaatcgaaacggagacttagttttcattctctgtctctataaggtttcacgtttaaacagataaataaagcagacagtctatggcgcttctcatgctgtactactgtagcagtttgcaggtaatgattgattcagatgaatcctttacatactcgcacctgcaaaaccaacagatgatatgaattctgtatctgagaaaagaggatcacttctaaaatcagtgaattgaatttactggtaagctgagagtttaccatttaaaactactgtacatctttcatagtatgccactactaggttaacagcaaacttagaaaaattcattcttctacaagaggaacatgataatttcctaagggcttttatatgagaaatctaaccaacatttattcatttctgaaaactttttctgcagatgcccacttttctatgggttgaggaaatctggaggtaatgtaacatagggtaatgggtaacttcagtggcttctcagtcaaggtagtatggtctataaagttgtcatggacaccgaattagtgaatactgaaccactgctcctaggggaaatacagggttaggtacctgtgagcatctggtcacagcatttttgttaactgatcaatacatgttttatgtgtgtttctgtttaaagacatatatattgttgattcattaacattgagctcacaatcaacaaaacaataactcattcctgaactaagtttatctaacacagctattttctccatgatgcacattgtaggtttcttgtgcttgagaacactaggcagcacttacaatgacttgggggccatgaaatagtgaaatcatcaacaaaaacacaacaatgcaaaaacgtggcacaaaataggctactgaaaggactcttgtttacattataagagctgaagcaagaaagcctattcgttgtctgctgggaatgtgcatgtttggtgactcagattttttgttatcccgtgtgtgtctgcaaatgactggaagacccagctactgtacaaataaattttattaaataggcaaagttgcatatattgaatccgtgaataatgaagatcaactgaatctaatggtccttgggtacctatgcagactgaagaaggaagctagtgttcttatttatttcctttgctttcaccttcttcctctctcctcagtatttggttggcttcataagcaaacttaaaatcaaatagaaccttttcttgagattccattttgtaaaggtttgttggctcgggcttcttacatggtagtgcatcagtctgccttcattttgagggatagatgggctgttgaccttaactgaagaaaattggtttttgtttttttttcctcagtgatgtaatttctataaagagtgactctcactttaagttatgataaacttttgcttttttcatataattaattttagctgtataattattctcttctctcctgagaatattgataattaaaaattgagctaaagaacctaaacgtaggtcttaacatttgttcatttctttctttctttttttttttttgagatggagttttgctcttgtagcccaggctggagttcaatggcaccatcttggctcactgcaacctccacagttcaagcgagttcaagtgattctcctgtctcagcttcccgagtagctggaaatgcaggtgtgcaccaccatgcctggctaatttttttattttttatttttttgaggcggagtctagctctgtcgcccaggctggagtgcagtggcgcgatctcaactcactgcaagctccgcctcccaggttcacgccattctcctgcctcagcctcctgagtagctgggacaacaggtgtgttccaccacgcccggctaatttttttgtatttttagtagagacggggtttcattgtgttagccaggatggtctctgtctcctgaccttgtgatccacctgcctcagcttcctaaagtgctgggattacaggtgtgagccaccgcgaccgaccctatgccaagctcatttttgtatttttagtagagatggggtttcaccatgttcatccgtctggtctcgaactcctgacctcaagtgatctgcctgcctcggcccccaaagtgctgggattataggcatgagccaccgcacccggcccattcatttcttaaattgtgagtttacattcagttctctatgttttcaagaaaatttagaaattcattctgatctttagagtattagctatactatatgctgttttagaggactgttttttcttccattcattgaaagcattttatgttcaaaactttgtgcctgagggagagataccagccaaatattatgatataaatatctctctactactatttttaaggatagtctttcctttgaagacatatgatcagggtgtcattattagaaaaacattagttgatacttcctagtatttctgggtgttcttaggtattctttaaataaacaaaaatagataaagcaacaaaacccatggtggaatatttggagaacccttgattaaacaaagttaaattgatttccttagcatacctctttaatactcatgtacatttttttaatctcccagaagaattctagtattgcatatactatataaacactgcacgtgtttcctagatttatatgattgtggtattttttgtgagaggtagcttaagggatcagtggtctgtggaataaacttgaggaaatgctgacttagccttccttcaactgtctcccatagatctcatttctgctgttgtagcaaaacagaatgaacctgtatcctcctctatataacagtttttgagtattttaataattttttaaaaatgtattttaatttttgtttttgtttttatttgtagacagggccttggtctgtcacccaggctggagtgcagtggtgcagtcatggctcactttaagccttggcttcctgggctcaagcagtcctcttacttcagcctcctgagtagctaggattacaggtgcatgccaccatgcctggctaatttttagatttttttgtagagacagggtctcactatgctgcccaggctggtctcgaactcctgacctcaacccattctcctgccttagcctcccaaagtgctgagattacaggtgtgagctaccaccctcagtctgagtattttacggaagctaaatagtcaccctaagctttttattttccaggtgaaaagtccgctgcccttcagtggattcttattatactcttatttggtagaccttttttccaaacttactgtattttattggatatattgctattacttttattagactgtaaggtcatttatgacaagggatgtctaatttttctgtggtttgcaatgtctgtcatagtaccattcatgtactatgtgcttaataataaattgaactgaacactcttttatgatttttatttcagtatattatcaccacaaaaattaaaaggaaccagtgatgtaatagatatttaaaattccatgttgagattagataaggtttttattctcacggactatacttatttttaccagaaattatgactttgccagtactggatttaagattgctattaattttttttttgagatggagtttcgctcttgtcacccaggctggagtccagtggtgctatcttggttcactgtaacctctgcctcctgggttcaattgattctcctccctcagcctcccgagtagctgggattacaggcgcctgccaccacacccagctaatttttgtatttttaatagagatggggtttcaccatgttggccagggcatggaggctcacgcctgtaatcccagcactttgggaggtcgaggcaggtagattacttgaggtcaggagttcgagatagctattcatttaaaattactttccttttgaaaatgattggctgggtgtggtggctcgtgcctgtaatcccagcactttgggaagctgaggagggtggattgcttgagcttaggagtttaagaccagcctggccaacacagcgaaaccccatctctaccaaaaatacaaaaatgagcgagtgtggtggcatgcgtctgtggtcccagctacttgggaggctgaggtgggaggattgcttgagttaggaggcagagggttgcagtgagccgagatcgcaccactgcacttcagcatgggtgacagagtgagacctcatctcaaacaataacagcagcaacaacaacaaaatgagatatggcaattaacaagctagataaagcatatttggcaccatgttaactagatttttttaggtaagtactttgaggaattactgcttcgtaattgtgtcatttgtaaggttaatgaaatgttttaaagatcttagcttctttcagagtctatacattgtattctacaaagtataggtattcacatcgtatgtgaaacatttcctcagtttctttttaaagaaaattaagtatcctgatatatagctaaatattcttctgcaagaaacagtaaaccatgtagatgaaaataaggttatttccttatctaccaatattaaaatgttttcagaaaggcaagcatggggtcagtattttctgtctttccccacaactatttgtagaaagacattcctagcaaactactttgagtagataaaaacaaaaaaggtatgatgtgttctgtttgacgtgtattctgtttgaggaggacaatcagtaaaaaagataaaatgaagaatttgtttaagagaattttttggagtatggtaaatgttcttcacgttgttataagagaaagaattatgtattgagatccctcaccctgccataaactgttaatattggacaagtcactttacctttttggtcctaagtttcttcctttgtaaaatgaagaggtagtattagattatccctaaggtcttttccagctttccagtgatttttttgtataatgaaaactgactaatatgataagtctgagatgccgacagattgagaaataccttctgaaaactcaaggaaaatgatgtaacaaatatttttccttctttctttctttctttctttctttctttctttctctctttctttctttctttctttctttctttttctttctttctttctttctctctttccctcccttccttccttccttccttccttccttccttccttccttccttccttccttccttccttcctctttctttgtttctttgtttctttcttttttctttctttctctctgtctctctctctctctcgctctctctctctctttctctcactggagtgcagtggcatgatcatgatcatagctcactgcaatcttgaactcctgggctcaagccatcctcatgcttttgcctcttgagtagctgggactacaggcacatgccaccaggcctggctgatttctttttttttttttccctgtagagatgaggtctcactttgttgcccagactggttgtgtactcctggcatcaaacatcaaacattcctccctccatttcctcccaaagtgccgagattacaggtgtgagccactgtgcctggctgtgtgtttttttggatatattttattgtcttaattttttaaaaaattgttatttgtgttatatatggtaactccactcacattagccatgtaaaaataccctttttttttctttttttcgagacagggttttgctctgttacccatgttggagtatagtggtgcagttatagctgggttgaagtgatcctcttgcttcagctcccaagtaactaggactacaggcatgcaccaccatgcctggctacattaactatttttactcaataggtttttcttgaagccatcatgattaatgaatgcttatttttaaattttcttaaatcctttagacattagtttattgaagtccttattgtccaagtattcataatcccaggtttttacaggtagagattacagagggaaacaaaagttttcatctctacagtcatttccattcaaacatcccacagctgtagtgtctagccatgtccattgcgtcaaaatctttattggttgctctctagtgacagtatactttaaattgaacataaagcaaaattgtagataatgcaaaattgcaatatttcatgatgtccatgaaagggcctttggtatctaaagtggtttagataccaaagaattaagaggtaactttgtggaaaatttacctttgtttggataagcaaagtcaacttgtgttgattctcctcagaattagcacatggttataataatgacctaaatttgtaaaataaaatgctataagctcttctaaaaataattttcattttgaagttaaagtcccagtcaaaccttcttttcaatacttaactatgaaaatttggtcctgcttttttgttgttgttttgagagagggtccttctctgtcactcacgctgtagtgcaagggtatgatcctggcttactgcaccctctgcctccagggctcaagcagtcctcccacctcagcctcccaagtagctgggaggactacaggcgcacttcatcaagcctggctaattttgtatttttagtggagatggggttttgccatgttgcccaggctggtctcacactcctgggctcaagcagtctgtcctcctcagcctcccaaagtgctgggattacaggtatgaaccactgtgtgtggcctaatggtcctgtttttatatggatgaactaggtggcttttaaaaaaatccagtgccagttatctgtgaatcctaagtattctgtagatttatagccaaagatgagaatggcgaaatttcctgatacacagtactatttttgctgtcaccattagaaagcatttattgaatattcttctttactgtttgtatgtggtgtgttaaattgatgctcttacctttacagcaagggagttggagaaaacagaagaaacactgaaaaaatatcaggattatagacaagcaaagattaagttcacgtaggacatttcttaatttctcaactcaaatttattgtgctacatgaagttctaggttccacaggtgatgtcctttttgtccctggatggctcatatacttaacccaagtcgaagttaaacatttttcatagaattttccacatacaatttgaaaataacataaagctctgtgtgactctatgtaaaactaactgttttatggatgaaataaggtatttggatttatatatttgagggtaaatataagtaacctgttggggaaagcacagggactctgtaagtgtggaagtcaggtttacaggtagtgcgttctttatccattgtgagtttggacatttaacataggtttatgagcaagttctgactctttactctgcataactgattttatttccttttgcacgcagtacatgttttacttagttgtgtccaatcccaaagtcccctcccttttttttaaaaaaactccttaactataagagaaggccagggaatgttcaaaatctaaaatttggactcaagtcaagaacattgataaaacattcattatatttgctggtgggcaagcagaagtcagcctgtaattccaacactttgggaggccacggcaagaggattgcttgaggccaggagttcaagagcagcccccatctctaccagaaaaagtccagaaaacaaaaataaacaagacatgcagcctatctttaagttaaaaaaaattatttataaaagtaagattttaaaataagcctgccatagtaccgatatgacaaagagtagaaaaaagggaaaaggaaagacacattagaagcagttcactttctttcactggaagaggattttttgactcttaggtggtcagagctgatctcttttgtaggaggtacttttttatgaagggaagcttttttcctgctccttaaagcaaaaataaggaaaattgttactgcctaatttgctgagtatttaaaaacagctccagggtgagtgagaaacgtgtttactgaagttcatggatagtttctgatatgactgatgtggccagtctagttctagaaaatgtttggagactcttgatttaggaggatgattaaaaaccattctttcaggagggtaagtcctcagatgttcttggtgttgtataacttaaaatataatttctggtagttcatgtggccccatttttatgtagtcgtattgctgtgagtcagagttggacaggtagaactgaacttttaaaaatttttacgagttggaaaattcccaggtcctttttaaggtaagtgaggtgggactttgagtttgtgctggctttctactggacttaacttgacaccatcaatctagactctgtataaaatggttcataagaattttgttcactgtagcaatcattttttaaaaaaattaaatgctgaagaaacaaaagatactaatgtggtttgggtgtttgtgccctccaaacctctatttgaaatgtgattcccagtgttggaggtggggtcctgctaggagtaattgaatcatgggggcagatccttcagaatggtttagaaccatctgcttggtgataagtaaggtctcattcagttagttcatgtgagatctggttgtttataagtcagggatccaccccctcttgttcctgctctccccatgtgagacacctgccccccgcttttccttctatcatgattgtaagcctcctgaggccctcatcagaagcacattctaggtctttgcttctacagcctgcagaaccgtgagccaattaaacctctgttctttgtaaattcctcagcctcaggtatttctttatagcagtgtgagaacggcttaataaaaaaactgtgttttacaaaagcatctccaccctccacaattagccagaggcttccttcattaacaaagacccttgttcttacccctcaagaagaaacccaccataaccagcccactgtcacccctaatttgcagacaccaaaacagtcctggaatgctaattacaggaccccccagtcttcctaccctctccaccctcaagaaacccccagtgccttgtatgcaaaaactgattttcagttcaggtgattacagagagtctgtgggcagactttccatcaatttttaaagtattttatgatttcaagggcttgtaagagaagtgattacattttgagaaacagctatgaaaatggatttggatgtgttttcctacatttcttcatgtaattaattcatattctaaccttgctgcttgtaatggtgtgtataggaaatgatacttttactgataggatctctgaatcatttataagtgtttgtattctgctattaaatttcaggacagcattttcttcttaagcagggatcttaataggagagtatctttctggtttttaatttgcttacagaaaatggaatacttacatggggaatttctattctgattagaaattaaaatataaaaaccacataaaacagaccatgaataatctaacatttaatatactacattaatatatatattcaattactgttattagaaagaaagaagtgttgtcctagcctggaaaataatggtaatagatatatacactgagatatttaatatgttcataacttggtatgtatttttttaaaggaaaatattttggttcagttagaactgttagagaagtagtggtagctttttcattcttccgtattgtttcttcacctattaagatatataagtagaaactattattctaactcttgtacgccgcattgatctacaagtgtggctctcaggaattattaacagattggaatccatgggatgcctgagatagagtttagtgtgcaggatattcattgagtaccctttggatcaacatctgtgaaacagaggggaaggaagcaggattggacagagggaaaagttgagttgtgattcggttccagtgacatcctcgactaagtcctcagctggacttcaatttctaggcccttatatagctttgcattggttgtgggctgccctgggaaaggagcataatcttgggcaatctgctcaggcagcctgagtcctccattaaggggaacttggtggtttgtcagaatactctctacaggaatattccattgaatctggtttggtttctttgcttatttttctttctagtttcccttatgcttcagggatcagttatattatttttctttatttttctgtgatcgagagtaagaggctctgatttaactgctttaaagatttactaagtctctaagagttagtacttttagaaattgttttgggatcattatatgtaagataccgcagattttttttttttatgtgtgtgaaactgtatgatagtatggtatttccatatacatagtctcttctctaggtttcttgagataatctgcctcagatggcgtggcagtgtgttaggaaggcaaagagaataaaaattaatatttggcatcagactttcatttatccagtaaatatttatcgagtgcctactatattccaggcaatgttatatagactttggggaaaatagaattttgcagtaagaaaatgagcttgacaagcaggtattgccacaattgaagcattttttccttttatactgagtcttgctctgtcacccaggctggagtgcaatggcacgatcccggctaactgcaacctccacttcccaggtttaagcaatccttccgtctcagcctcccaagtggctgagattataagtgtgcgccaccatgcaaaaattagcccagctgatttttgtattttcagtagagatggggtttcaccatgttggccaggctaatcttgaactcctgatctcaagtgatctgcctgcgtcagtctgccaaagtgttgggattataggtgtgagccactgcctctggcccagttgaagtgtttcaaaagtcctgtagctcatgaagatccgagcctgaaacagtgaagtaagaggatttcttccataatgtagaggagataactatagtgtagagaagttcattagacttctttttacctgaagaaactacttgtgcgtttttaagttaacacctaaatttctaaattacaagttgaataattgcataagatataatttggatgtttggtattgacatttaaaaataaagtggttgcattgctcttttaaatgtatccagtgaaatctaaataccctagcaattggatacttgctttcatctcttttttaaaaaaaaatgctaaggtgcaagatgttggtgttacaaagtactcttaagtttctgatggagaggacactactgtatttcagacttgtggctcctgccaaaaattgacattgttgtgttgcgatgatctaggtcacgttgcatgggttcctgtctgctgctggcatcttgactacattggacctttgactccttgggtctattgatactaccttactgctgttgataccttttcatatcatagtgttgatgtaccagtctgataagccaacttctccacacttgtgaactttgaaactaatttgtgttatgtgttcactcagcttgtgggaccatttgcaccctgatgatggtatgccttctatcccaaaagccactctacagtgggctgttagtcaggatatttagtgggccttcctcattccctaccatcagtggaaatccaatattgttgagtgttggagtggtcacaaaattgactcaaaaaaaaaaaaatttctgaccttctctcatttcctcctggtccttagtaagcagtttggtcccttgaatgtggcctatccccagagagggaacatgtcctatttgctgcttcctggttaatgatcaggatgaaagaccttgggagttacatagatgtattttgaaaattcctgggcatgatgtctttttctttttctttctctcagaggttgccacaggccagcctgctaggtacaccctccaggtggcagcctacctaaaggggtcttaggggattaagaattatttctggctcaacaactcagattcttctgcagggttgacagtcaggtcagaagtatgataaccatttggtgaatatacagataactaagtttccctacagtggtccttatgggtcaagatatgggggtggggaggtataatggttctctggacctttattattattattattattattattattattgttattattattattattattaatgttctcgtttcttttgcagtgactcttccagatgaagggtctgagtctgaggaggagattattatcaacagttacaagtgccttaaatagtccaggcgtggtggctcacacctgtaattccagcactttgggatgtgaggcaggcagattgcttgggctcaggagttcaagactagcctggccaacatggcgaaaccctgtctctacaaaaaataaaaaattagccgggtatggtggtacatacttgtaattctggctactcaggaggctgaggtgggaggatcacctgagccctggaggcagaggttgcagtgagccaagattgtgccactgcactccagcctgggcgatagagccagaccttgtcttaagtgaaaaaccaaaaccaaaattcagatgctttaaatttaacatagtgctaagtctcccacccgtttccagatggctcagcccatgttttggttttcattccccataaccaatgatggccccagcactctaaccttccatgcaaaatagctgtcaatatcttcagatgtcttgcccacccccatttttgtagccattgctcagttattccataaagtggctgaatgccaccttgctgttgtgtggacaaacaggagaggtttggctggctgaggtttggctgagtttagaagtagggcaaaatctcaggcccttcatggttgacactgagattatgggtgctgtctctggagtgtccatttgtgggctacatagccccatgtcatgtttcttagacagtttctccaaaaaaacaaggacttagagactcagttatttgaactaaaataagaatgctaagccacactattctgatggaagaccttgtttgaagtactgtgggcttgtgccctgactgatttatatcttacttgtggagttccaaccattgtaaacaacacttctttccagggcgatctcatgacttcttggtcccttagttcttatatagaagccagacattaatttgcccccttaccagaaacataatgacttgtattgtaagagtgattttaagagacctttaggtatttaaggaaacatcatatagttctcatatgattgctgagatttctccaaaatcaggctaacctagattacttgggggaatttcctggaggggctgactcattcattatttacgtgtaccctgcaggtagtttatctctaggatggagtcatccggttaggataggtattatgaaatcagtccctgacttcagctgaaatgattagtgttaggattttatctctaaaaggtattcaggtcagcatcaagtcactagccagaattgttatgtatgatagaattgcctgggacttcttcatgggccagacagattacaaggtagattctgtgtaattgccaatgcatcttcctatacctggattaatgctttagtttaagtggaaaggtcaacacagaaacatgaggaggaagccagttgaatttctaaggtagactttgatggtttatgggatttgtttagctgattttgtccaagaccctagaggacctagtggaagtcagtactgtagattgacctcaccttgctgctcagagttcctgtttgtagtagccttaattacataattcataaggcaaattaaatacatttggtcctccctttgttggtcagattaatcagcttggttgatagaatggcatacttatagaaaaattgactgggagcctaagacaatgtagaagcaaagggtacatattgttagaaggtgattttccttgggcctcttgcatttccatgttttacaagcagaagcactgactgcctttgttttggactgtcctttcaaggatgcttgtatactaaacagccatggaaagtagacatagtttctccctctggaacaaagggcaggtatgtttactgtgtatatggagagagaatttatctctccagagcaaaagtcagccatacttactgtgcattatagatctgggcttcctaaactcaggcttcctttcctgtaaacgcactgggcatgcagacatccatttgggctcatccgtgttgctgtcatgacagtggggataagggaactgatgcaaatatgctgatatattcttgctgggatgtgactaataaagtcatttgtctctgatctgagtctcctgtcttctaccttcatccttgaaagggtggcaggctaccttgttagtttacaagtagggcaaaatctcaggcccttgacacagttgacactgagattatgggtgctctctctagagtgtccatttgagggcctcgtagccccatgtaataaaagatccatttgagaagtaaataaaaatttcaaaggcatatacccttcagcctagcaatgccatttaaatgtatatgccctctagctgacttaaggagagtcacaagttatcgcccttgagacaaatctggctcactgcttatttcttgtaaatgaagatttgttgtaacatagccgcaccaatatttattggtattgcctatcattgcttttgcactacaaggcacaattgggtagttgcaacagaaccatatgggcaaagccaaaaataattcttaactgttcctttaagaaaaagtttgcagggccctgctttagcatgctagcccaacattgtttactttaaatatatgtgcaaaagtaggtatacaaagtaggtatatcaaaataggcatacaaagatgttcagtgcagaattattggtaatattttttaaaacccaccagttaaactgtaagcaacctcaggagatgtgagaaggtctaattttctttctttttttttttttttttgcctgaacattgcctcattctttagattttaaaaagtcataccttgcaatgaattcctggtgactctggtatgtggccttacatacttgttctttaaatatacatgtatatttcttcttcttcacccagttttagaaaagaagggattgtcacataatataatctgggaaagaaggcaagggacaccagattattttggtaaacctccatgtatcacaaactccagggagtgtaagaatcacccagtgagggttgaggtgttactgttgaattttacattttagtagaaggatcttggaaagccagtcaaaaagtaatttaggacactaaagtgtcgacctaaaaggaagaagctgaggcaaaattaatgtaagtagagagcgtattggggccaagcttgaggattgcaacctgggagcatagattcaagttgctctgaatatacacattgattagcagcagttacaggtgaatttttagaggcaaaacaggtggactgatacaaagttgttaggaatttttgttagtttacagaaataacattgattagtgattggctatacattgttaagctatgtgtgtggcattaggttaatttatagctacttgttgcaatagcaagcagtttcaacagatgactgcatagctcaagaggcaggaagtaggatgtaattgctgtctcattttaatgcctctctgggccggatttatttatttatttttatttttatttttttgagatggggcctagctctatcgcccaggctggagtgcagtggcaagatctcggctcaccgcaacatgtgcttctcggggtcaagccagcctctcacctcagtctcctgagtagctgggactacatgcacgtgccagcatgcccatcttgtattttttgccatgttgcccaggctggtcttgaactcctgagctcaagcactccacctgccttggcctcccaaagggctaggattacaggcatgagccactgtgccctagccggggcctgataatttgaaagggctcatattcctcagataaaagttcttttctcaaagtaaaacaaaaacaaaagagagagattgaaacaataataacaaaagttattgctttggatgttgatgagccacgctaactactggttctttttagagtaaggaagaccctctgattctgtgctgagatgtgttgataaaaatctagaatggggtgaaaggcctggactgactaaggcttacgagacaattaaattgactttaaattgaataaatctggtaagaaagtcaagccaaactgtttttggaatttggtagctgttaagaatgagaggagttgataccttggtagaaaagagtttttaggaatcaacctaacaagaaagtaggcaaagttctaatactttggtagccagcactggctaaagtgcaacttgttagcagacaatattgaaggtatttcagaagtattttactcgttgccttttactatcaatgtagtgaccatgtgttttgaacagattagtattatttaattcctttggttagacataggaattaaacttcttttattctcaaagtctcacatacttgtaatctcctgatgggctcttcttacccactgcacagataaacccaattcactgagacagtgttattgcagtaaagaaagagtttaatgcagggctggccaaacagaaggacaagagtttattattactcaaatcagcctccctgggaactcagagggaggctaaggtttttaatgggtaatatggtggccaggaggatagggaattatcctgttgctgattggttgaggatgaaattataggggtacggaaaaacggtcttcatgtgctgagtccacccacctctgggtggaggccacaggaccggtttgagtcatgagtcacgggtcccagtggagtcagtctgttgtcagaatgaaaaattttgaaaaacatctcaaaagaccagccttaggttctcaatagtgatgttatctataggagcaattggggatgtcacaaatcttgtgacctctggccacatgactccctagaagcaaaagactatagaaactatgcctacattttattagaattcatgcccctcctgtaattctaaccttgtgacctttcattaattttcattccctgagcaaggagggggattagttttagggggggactgttatcatccttgcttccaagttaaactataaactgcatttctcccatggttaacttggcctatatccaggaatgagttagaacagccatcctgtgaggctagaagcaaggtggggtcagccatactagacttctctctcactgtcataatctttgcaaaggcgatttcacatttataaaaacccagtcatgtttaattgtacatatgacaacctcatgaaaaggaagagtatgtaagataggaattacaccagaaaatctaggacatgtgtgccttatttacgtagcatagtcttaacagatgtggttaggggatgagtggtgaacctgctaataattgggataggaacagaagcaaatgtactgagctcatcttgaggtcttcttgcagagcgttcagtacagtgtaatccctgtgtttctatttcttaaagtatagaagtggagaaacagtattttgcatggcaatgttttgcatgtgttagtaggttaacccttttaaaagggtactttattttcatttggaaaaagtgtggaagtagtgagagggacacctattgttatttaacctgttgcctaatttctgtgtattatattttgcttcaaacattaaattttccaagtgttcaagccatcgaaggtagacaagcaatgtagagaaccattatgtcttactcaaagctaatataaccatctactaaatagatggataaggtcgcttgggaaatgtgttcaacgaaataaacatatattgtttaattggtttatttttttatatgggcagttaggtaagcatgttatttcaggtggcatatgtggaagcattttgggactatgtgtaggtgtaacaatgctaagctttcttttagttaatcagggaagacttcatggaagagcatgagtaggtgtgcataagaaactgagggggtatggattatttttgtgaagagcttcaaaaccaaggggaactatatcatatttgaaattaagagtaacaaggtttaattttttattatatgagatagatgaagagggtgagacatatcacctttttttagactttatgtatgttatactaatttcatgtttacttctttccctatatattcttcaattacattaagagcatcttgagagtggaaattatctcttctgtttctttggtgtcccatatagaacaaaattatgaacacgcttacagaaatctcagttaaaaagaagtttaacttttcagatatggaaggtgtgagcatttcttgttagtcattgggcagagtatgggtcaagagaggacatgggaccaagaactggggcagaacgttgatcgtgtttctagcttcgagggccaacctgaggccattgtgtcatgctgaaatgggaaggcatgggtaagctctggagctagcaggttaaactagtgatgggacagaaaacattggcatcgggcgcggtggctcacgcctgtaatcccagcactttgggaggcccaggagggcggatcacaaggtcagaaaacattggcatcaacagtggcttagcatacagatgtgggtcaggattcttgccaatcataaggaaacagtttgagaatgctattcagaatgagctacatgcctcagaatctgtcttaggaaaacaggcttatatagggcagcaccaaggataaaatgttctttacacagaagtgacttgtttggtctttctacgattttaccacagtgactgaaacctaacagataggagttcttatatttaggacagttgactgttgaacaacatgggtttgaactgtatgggtccatttatacttagattttttttttttcaaccaagcgtgaatcgaaaatacagtgttaatgggatgtgaagtctgaatatatatggagggccgacttttcctataggcgggttccacagggacatgagtatgtgctgattttggtatgtgcaggggtctttaatcagtccccggcttgtactgagggatgactgtatactgtatttattttgtgggtttgacctataatggtaggaagtgtgatttcaaatagtttaacttatttttttcttttaatcataaaccctggtgatcaatatttgtcaggcagatcttttcttttttttatgtatgtatgtatgtatgtatgtattatactttaaagttctagggtacatgtgcacaacgtgcaggtttgatacacaggtatacatgtgccatgttggtttgctgcacccctcaactcatcatttatattaagtatttctcttaatgctgtccctcccccagctccccaccccccgataggtcccggtgtgtgatgttccccatcctgtgtccaagtgttctcattgttcatttcccacctatgagtgagaacatgtggtgtttggttttctgtccttgtgatagtttgctgacaatgatggtttccaccttcatccatgtccctgcaaaggacatgaactcatcctttttatggctgcgtagtattccatggtgtatatgtgccacattttcttaatctagtctatcattgatggacatttgggttgattccaagtctttgctattgtgaatagtgctgcagtaaacatacatgtgcatgtgtctttatagcagcatgatttataatcctttgggtatatacccagtaatgggatcactgggtcaaatggtatttctagttctagatccttgtggaatcgccaccactgtcttccacaatggttgagctaatttacactcccaccaacagtgtaaaagtgttcctatttctccacatcctctccagcatctgttgtttcctgactttttaatgattaccattctaattggcgtgagatggtatctcattgtggttttgattttcatttctctgatgaccagtgatgatgagcattttttcacgtggtcagacagatcttttcttgttgggccatgtgactagtagaaggaaatagtcataccctaatttaatgagatttctgaattgaaaggagaacaggttactatttctagcttacacaggtgggagttgaataatgtacacagctccaggtggttttccttctcttttaagtgcattgaggctcttcctgtttctgttgtataagagacattaaatgtcataatttgctgttcaggaattttaaatttttgttttggttgacatactaaaagtttagctggggttataagaaataatcctagacaacatctccagtttttacctcaagcagattatttgaacaacattcacttgtttcatagagattattttttaagtatggagtttgattttattcagtgcttgtttagagtatttattgagcacttgatatgtgccaaatacttgtaggtactttatgtcttttatttaatcctcatgggaacttcaaaagaaaggaagtggtattttcagttttaaaaggtgaggacattgaaactctctttaccaaacagagtaaccacccctccccattctgcttgaaaaatacaccaattgatgatcacaacttactgatcattgtatctggtcagttatattctagtttactttcatacttctgcaccaaccatatgagttgtacccttaccaagagccaattatattggttcccaaacctcttaataattatttatttaaaattaagcagattggattcataaagaagttttttttatgaaaaccgagggaatgtttggaaagactcaaacacagggaggtacaaaacttgctattgaattaggtgtaaataagaaaacaataaattggagaaaaaacaaatctgtgtgattctgaatttatttctttgcaaatacattagtttttgttatagtttaaaggtgccaacctttttggcaccaggaactggttttgtggaagacacttttctgtggatggtgagggttgtaggggatagttttgggacataagtattccacctcagatcatcaggcattagattctcataaggatcgtgcaacctaaatcccttgcatagttcacaacagggttcatgtgcctatgaaaatctaatgtgaccactgatctgacaggaggtggagctcaggccttaatgctctctacccactgcttacctcctactgtggagcctggttcctaataggccacatattggtagtaatctgttgcccaggggttgtggacccctgctttaaagaagcaagacaaataactgtgaacaatgtgttaggagtatggctcaggcaagaaaggcaaagtgcaaaactaatctgaggacccatactcaaaaaagtgtcttttttttttttttttttttttttgagacggagtctcgctctgtctcctaggttagagtgaggtagtgcgatctcggctcactgcagcttctgctaggattcaagctattctcctgccttctgagtagttgagattacaggcgcccgccaccaaacccaactaatttctgtattttcagtagagatgtggtttcaccatgttggctaggctggtcttgaactcctgactgcaagtcatctgcctgcctcagcctcccaaagtgctgggatttcaggcatgagccactgcacccaacccaaaaaaggttcttgatcctgagtttggaaccaaatgaaaaataagatacaagagagtaacatagtaagactggaatgtcagctttattaatgataagatgatcagaattcatggctttagagctgctgccaaaggagcttgccggtactgcaaagaaaatacccagaatttctgacttagaccattccatagtaagaagaatagtgccaatcagtaattggaagaatagtgccaatcagtaatattggcagctttttattacattagctccacatataaaagaaccatgcacattcgtcaacaagctcacttccctttgggataaggtaggtaagggagaggaacgaattcttcaagctagaaggctgaggttaggaaaaggtaaatcctacattaaaatgttgggttatgttttatgtttaaaggtagtcaaggtaatatctggcttattcattgtatttttaatctgcttttgaaattatgaaaatgtgttgcatagctatgatggaacagcacctaaattcaaatctagtcctatgtgatttataagtttgtgtccccgctacctttttttttttgagaccaaggctcagctcgctctgtcgcccaggctggagtgcagtggcacgatcgcagctcattgcagcctctgcctcctgggttaaagctgttcttttgcctcagcctccctagtaactgggactacaggcgcctgctaccatgtgcggctaatttttgtattttcagtagagaggaggtttcaccatgttggccacgctggtctcgaattcctgacctcaagtgatcgcctgcctcagccttgcaaaagtgctgggattacaggcatgagccaccgcccccagcctgtgcccttttcactaaaatcacatttattgaggtttctttggggcactcctgcttgcgttttcacatttcttatctatgcacctgaattttccctttggaattttgaccacagaacctgttttgtttcagttagaataatcctcagtctggaaatcatgtattaaatgacacaatgggatggaattgtagcctataataagtgaagagaaagagaagattaccacctaagagctttaaatacttgaaatgcgcctggtctccagatgcagagaagttgtgttgaaagaatttgtatgatagctcctcatacagtgtttttatttataaaagtaattcatgtacatcagtttacaaaataaaagttcttacgtaagaaatgttagtcaccagtgtgatgaaacgtagaatgaaaccttaaactgtgttaatagaaatgtggtgtcagaatcatagatggtagtggttcctttgtaatcttcgctgagatgatgaattcattttcatactttaagagggtcactcgtcaactgtagtgacttagaaaggcatgtttaggatttgagctactgaaaatgttcttgtaggaacagttaaaaaactgggaatgggaagactgagaatgtacaggaataatactctccagagttttaaatgctgtcatgtagaagataatatagatttctctggtgttcctctagaacagagataggaaaattctttttggaaaggaccaggtaaacattgtgggctttgtgtcaccacttaactctgcagttgtaacatgaaagcaagcagccatagacaatatatggtaaacaaatgggaatggctgtattccaacaaaaccttatttgtaaaaacagatagtgggctggatttcaccagccaatagtgtgccaaactcttctctgaaagagcatcatttccatgtcaggttaaaagtttagcttaagaatttaagagaactttcaagagaatatgggtttcagcagtgaaaaagactgtcttgagaggcctagtgtcctgttactgatttattataagcagcagtccagcatgctgttggtaggactcttgtagaagagaggaccagaggaatcctgacttctgccaacttttctccacaaattgtctgtgcttctcggataaaaattttctgatttagtcgttaatatttacagtttaagggaaaaacattcaactcagtaaataagtctgtattaaactttgctttgtatgactctgcttattttttagtttcattgtattttatccagtacagtatttcattttatatattttaatttacgtatacattttacataatatgtattttattgtgtatatgtaaatattgtatatataacatacatacagtcatttcttgatgtccgtgggggattggttccaggacccctgcaggtaacaaaatttgtggatgctgaaggcctttatataaaatggcgtagtatttgcatataacctgtgcacatcctcctatacaatttaaatcatttctagattacatataatacctaataccatgtagatgctatgtaaatagttgttatactgtatttttaaatttgtattattttttattttatttgtattggtttttattttgttgtatttttttttcccaaatgttttcgaactgaggttgaatgaatctgcagatacagaaactgaagatacctagggctgactgtatatacaataaaacatacacattttaatgtatgataagattagttttgagatctgttttgatagatgtatatactctaatcaagatagggaccatgtccatcactccagaaagtaccccctttcagttagttttcttcaacacctatgtcttggaacgggtcatcagatttctgtcactgtaaattacctttggcctgttgtagaaataactacataataatgaaattgtacaggataaactcttgtatctggcttctttgactcagaatgttttcaagatttatccaagttgttgcatgcatcagaaattagttatcttagtgaataatagttttccacgtgccagtgctgatttggccattcgttcgttgatgtatatttggaccttttagagtttttaagctattatgaataaatctgttgtgaaattctctataaggttttttatggtcatttttttttcttggatacatactgagtagaggaattgccaggtcacattgttaactgtatggttaatactctgagagagtggaaaagtgcttttttaaagtgatcgtaccactttacagtcccacattgatatggtttggccgtgtccccacccaaatctcatcttgaactgtagctcccataatccccatgtgtctcaggattccccacgtgaatcatgggagtgaattttcccttactgttctcatgatagtaaatgtctcatgagatctgatggttttataaagggcagttcccctgcacacgctctcttgcctgccgccatgcaagactttgcctttgtctcttcttcaccttctgccatgattgtgacacctccctaggcatgtggaactgtgagtccattaaacctatgtttcttttttttttcttttgagatggagtctcactctgttgcccaggctggagtgtggtggtgtggtcttggctcactgcaacctctgtctcctgggttcaagttattcttctgcctcagcctcctgagtagctgggaacacaggcacgcatcaccacacccagctagtttttgtatttttagtaagtagagacggggtttcgccatgttgggcaggctggtcttgaactcctgacctcaggtgatctgcccgctttggcctctcaaagattataggtgtgagccaccgcgcccgactgaaacctctttttctttataaattacccagtctcgggtatttcttcatagccttatgaaaatgtactaataaacacatgtaacacattattgttgcagttgctcaacattctctatcacacttggtattgtcagtcattttaagttttgttattcatgtggtagtatctcattatggttttagtttgcatttccctgatgtttgacgatgttggacattttttcatgtgcttattgttcatgtatgtatcttcttttgcccgtttttaaatcaagttgccagctttttgttaaatttaaagggcacctcataattttggatataaaatcttttgtcagttatacgtaatatgaatattttctcctagccttttcattgtctgaatagtcttttgaggggcattaggattttattttgataggatcatttaccaaagctttcattgtcttgtctaaaaaacatctttgcttactgcaaaattgtgaagaatttttcttgttttcttcagaagttttgtggttttagattttatatgtagtccttttttttttctttttggaggcagtctcactgtgtcgcccaggctgaggtgcagtaatgcgatcttggctcactgcaccttctccctcccggttcaagcgattctcctgcatcagcttcctgagtagctggaattacaggtgtgcgccaccatgcccagctaattttttatatttttagtagagacggggttttaccatgttggccaggctggtcttgaactcctggcctcaagtgctctcgaacgacctggcctcccatagtgctaggatacaggcatgaaccaccccacctgtctttacatgtatcataagcatttcaaattaattttcgtttacattgtgaaagagtggttcttccagtgtgaaagagtggttcttccactacataattggttgttccagcaccacttgtttgagactatcatgtcttcattgaatttttttttttggtgccttagttgaaaatcatttgaccacatgtatttgattctatttctgtactctctattcttgtattaatcattatgtctattgtaatttatgcctacctgactttgtttttctttttaaaaattatgttgcctattctgagccttcgtacttccatatgcactttagaatcagcttgcagtttcattttagaaaggcttgctagaattttgattggaattacatcgattatttgttttattttttactattcctccaccttattacttggagaaaagtatactttgtactacgctatatgggttgttcagttgtgttgtttttaagttttatatttaaaaattaacatggagtaaaatggacttttttggtgtataagtcaataaactttgacatgtgtagctctgtgtaacgcataccacggtcaagatatatatagttctgttaccctataaaccatgttcaagctgttactttccccttttctcacctcttaatccctggcagccattgatctgttctctgttactgtagttttatcttgttggagactgcgtataaatgtaataatacaatgcagtatgtaatgttttgacactggcttctttcactaagcataattacatgtgagattcaactatgttgtaggtatcagtagtttcttttcttttattgctgagtggtgttacgttatatggatgtaccatagtttgttttttcatgttaaaggacatttgtgttttttatagtttttggagataagagtagagtcgctatgaacatttttgtgcatgtttttgtatgaacataagttttcatttctagttttcatttcaaatctcacctgggaataagattactgggtcatgtgataatttgtagagtttgctttattgattaattaattgattaatcagttgattaattgagtcgtggtcttgctctgtcactgaggcaggagtttgctttattgattgattaattgattaatcaattgattaattgaatcatggtcttgcgctgtcactgaggcaggagtgcagtggcatgatgatagctcactgcagcctgaaactcctgagctcaactgattctcccaccccagcctcctgagtagctgggaccacaggtgcaagccagcacacctggctaacctggctaactttatttatttttttgtagaaaatgggatcttgctgtgttgcccaggctgttctcaaattcctgcctcagcctctcaaaatgctgggattataggaaagagccactgtacctggccttttttatttttaataaatatttgtttcttattttgaaagtaatcacgttcattagaaagattttggatatgtggacataattgaaaaataggaaaactatcgcccattgtctttctgctgaaactcaaacactatagaaatttcagtttgtttccgtttcttcctcttctcttctttttctgttttcaatcattttgaaaatataatttaatttccatctttatcttaattgcatattcatatataagattcagttcttagtaacttgctgattagtatgtgacacattatcttccatgtgtataaccacaattcacatttgtagaagtgagttactgtagtgggattttagacagtgtaactggctcatatgagatagttttgactgaccaagctttatttattcatcaaatccaaccaattgcctatctcaaggattatatagttgatgccaaccacttgacttgccattcagactgaataaagcctacatacttgtcattttttattgtgtgaattattatttctgtagtaacttgtcttctaaattaagaataatgtttgtattctcaaaaggaatagggtgcaaatatttccacatagttttagaaatcagatgctgctctctctatatttttctgcctcttacctttatttttaagtgttgtgggctactcctgttttcagaatgttggctcctgtcaagtgattgctaagggctagatgtggccttgtggaacttggataaacattttcttctctgcatttggttgaagtgtttatcagtgatctccctgtcttctttgtggccaggagcttggctaaaaggattgtttagcttgaggtttggggggtcagatcaatcttctgaggctttctgacctggcttatcgctgtggttggatattagacagtatcattaagctaataatcagaccctataactcagaatttagacatgaagaaattcagcttcttttacttatttaaaagaggataatattctccggttctgggtaatatggagtgaacacacagcactctttctttagaattgaatttaattataaaatctggacagaatacatggtcaccagctgcaggcagatagagaaagaacatcagatttcaaaataccagcaaacctccatgatccatttcagtacagccagaaacctagaagtgaacactgcagaaaaacagccagatccagaagctctctaactctggcttgagctgtgagaaaggatgaaaagcttagagagagttgaggtcatcccttgttattttttctttttccttttcccctattttcttacaacttagtcccaggcaatcacatggtaatgacatcagctgacagccgttgcatgcaggaaccaaaactctgagggggagggtaccttcagctctgtttgatggaactgtagttccaagaggcagagccaaagcccattgcattttttactctatcctctcaatgtttttcaccaaaccaaggcagttgtaaaagtgacctctttcgggcaggaggacagaaaaagatatcctcaggaaattggaaaagagaggaaagagcttgggaaagagacctcgtgaagtcgtatacagacaccttgggctcatgaatctgatcttaattagcatattttaaaaagactttaaaaacaggtatgagatagaactccaccaggttgtagacttaccattggatggcacacccacaggaataatccaaatagtgctgcaaaggctttgaaaactgaactgacattggaactgcaatctacagagggcatattggaacttgcagactgaccttaaacaggttgattgtctgctaaaacaaaaatataaatataccttataggatttaagaatattctgagttttttgtgtcgtttcggctttttgaggcagggtcttaactctttcatacaggctggagtgcgctggcacaatcagggctcgcagcagcctggacctcccatgctcaagtgatcctcctgcctcagcctccagagtagctgggactacaggcatatgggactacaggcatatgccaccatgcctggctaattttaaaattttttgtagagaggaggtctcactatgttgcccaggctggtcttgaaatcctgggctcaagtgattctcccacctaggcctccaagagtgccgtgattacaggcatgagccactgcctctggctgatccttagttttatagcacattattcagaatgtcaaggatataatccaaagttacttgatatacaaaaggccataagtaattcacactggtaaaggcaataacagacaccagtgacaagataatattaatgttggaattatttgacaaagacattaaaccctccattatgaaaatgcttgcataagcaactgtgaacatttctgcaacaaatgttacactaaagtatcaacaaagaagtaaaaggtaaagaggaaacaaaattttagaactaaaagagcaataactataacttaaaaagctgcggatggactcaataacagaatggagatgaaagaggaaagagtgaataaagataggtcaatagaaatttttcaatctgaacaataaagagaaaaatgaaaaaaactttagagcttcagagaactgtggactggtaacattaggactaaaacttatgtcattgaatttccagaaggaaaaatagtgtgatgcaaaaaatatatatatatttgaagaaataattgctgaaaactatgattgtgttaaaagtcatagatgtatacattaaagtgaaaaaagtcaattttaccacatgagaatttaaaaaataattttaaagaggagctgctattatattcagacagtaacatggaatttttattttacagtagttaaatcctgatcttgtgactttgggaattattgatttcacagttagtaatggcaaatgttttccccacattattgtctgaactgaatcgaaacttggtgtgagtagtggtggcaagatactgactttttttttagagcaattcttggtatgtacaacagtttggcttattatggctcttattttctaagctgtagaaatgttctacttgtgaggtactgcagggacatgaacagccctgagaaagaaagtaggttcttacttatttttctacgtatagaattttatgatatattagtaaaaattattagctttcttgcttatttaattctaaagatgtaccattaactaaaacccttcaatttcacagctccgtagacatttggtagggattatacaggtccaaaaggaaagtaaacaccagagtagctattacaagggaacacaaataagaatggtttagaaatggatatgatgaattgacatgtaagggtccatgtaaatgctgtttgctctctaaaagaatgtttacctaaagctattcatcctgcagacttgtttaatggtatcctggtgatgaaattgagacataagtaatatacagttcagtttagttttgttagtgagctactttaaatctttgatcaccacattggtttttatagtacctgtttggatttggatacagtttaacacttcattaagcaaatggcttctctttccttaggtgtgcttggataacctaattgatgtatataggactgatcacattttcagattttacttgagtcactgagattatttttgttgttgtttttgggttaaataaactattatattgtgaatggaagaatctttaggttcttgcttttcttgttgatgacttttttttcttccttttgccctatgttttttcactacgcttgaccacttctgggtgggcaagaagagcttgccctttatttagtcgagtttgtagctgtactcaataaaatttgccacctgtgaaagggattgcagtgttggagaaacaaaggaaattaataatgtttgattttaagatcatttatggtttcatatgttcagccttgtgtcttatggttgtgaacaggttcataaattatgacaatgaatttaacatttaatagaatatattttttaatgatacacacatatatgtagatgtataaagatatgtatgtagttttaaaagtactctcatatctgtatacttttcatttcatactcatgatacagtgaatttaatagtggtattgtctctattttacatatgaaggaccagtacctaattataatgacttcccaaaaccgtatagttaataagcagtataatagtgatttaaacccagaactaggacactgtctccctggtcagtgttatttccatttcacaatactgcctttagcaaaacagtgagaaataatctgtaagctttactatttgaacaggcagtgttgtcatttaaaattctgtttgctgtgattctccaatttttttaggaacatataatttcccattttctgggtgccataggaaataatatcaacataaaatattttcctcaacatgtaagtttccagatcactgcgcatatattagaaactaatgttaataatattaacattttcttaatacttttatgtgtatttaacatgaattcttttattcttacaaccccccaatgagattggtacagttaccttaattaccagatgaagaaacagtcttgggaatcagtaatttgtacaaagttacacacagtgaatgacttcggggtttaaacttccaaagtgattaaatgatattgtttcctgaaagagtaatgttatcttattttattttagagatagtgtcttgctctgtcacccattctggagtgcagtggcacgatcatagctcactgcagccttgaactcctgggctcaagcaattcttttgcatcagcctctcaagaagctagaactacaggtatgcaccaccatgcctggctaattttttaaaatttttttgtagagacgggatctcactatgttgtgtaggctgattgccaactccaggcctcaagtgatcctcccacctcggcctcccaaagtattgggattgtaggtgtgagccactagtgcccagcctctgaaacaataattttattcaaataagagcatgaaaagtgtttgtagtcttgtcacaaggtgcttttaatggactttgaagggtggtttaggcaagttaaaattttttctttgtttatatttttggggaaaaaaacaccaaaagcctggcctgtcaggattagaagactcttaactgaggtcttatggaattagaaaagtggatcaggatcagattgtgagaagccttgactcaggggtccccaaacccctgggcacagactgggaaaccccgttgcaccgcaggaggtgagtggcaagcaaacaaacattatctcctgagctccacctcccagatcagcagcggcattagattctcataggaaccaaaccctattgtgaactgtacgtgtggggggatctagattgctcactccttatgaaaatctaactaatgcctgatgatccgaagtggaacagttttatcccaaaaccatcccaccccccacccccagctcctggtgccagaagggttggagactgctgccttgactgacacattgaatagttttgggctttgagaggttcttgaaagattttgaacggtggctgttcaaagcattttggttttccctaaatgtggtgtggaattagttgaacagcacaccagtgaagacggtaatgaaggcatcttgatatagataaaggttttttgtttttttttcactgaagaagtcataggaatggaataaaagagttggagaagagatattttaaaggggaggttgactgcgtttgtaatctggcatttctctttggtaggtacctagaagtaaaattgccaggtcatgtaataactctaagattttgagaaactgccagactgttttccagagtagctgcaccattttacattcccagcagtagcatatgagggttctaattttccaaatccttggcagcacttgtttttatctctttaattatagcctgcctagtagttgtgaaatggtatctcattgtggttttgatttgcatttccttagtggctgctaatggtgttgaacgtctattttatgtgcttattggctgtttgcttattttctttggagaactattttgtttatttgcccattttttaattgaaaatttaaaaaaattactgagttatatttctttataaaatattctaaatacaaattccttatgtaattctgtagattcttttaggtttcttttcattttcatgatgtcctgttttccctttttaaaaaaattattgcttgtgtttttggtatcatctctcagaaggacttttaagggaagcagagaaaagagagaagcaaatcctatattgttttcctctgtgtagaagtttttgaacatttccttatagtaagtcaaaggattgggacagctgcacataactagcatgttgggatgatgtggttatttcaattaagtgaagaagtcagttgtttttaactggacaagcaggtaagtgatttaaagtgtaatcattttcttatgttgattgttgtgaggtgataaaatctggtaagaaaattaaggtggtttgaaaaatgacatcctgtgcagatttaaaaagtagtataaggggctcgagcacggtggctcatacctgtaatcccagcactttgggaggccaaggcgagcggatcacctgaggtcaggagttcgagattagcctggacaacatggtgaaaccccatctttactaaaaattagctgggtgtggttcctcacgcctgtaatcccagcaacttgggaggctgaggcaggagaatcgcttgaacccaggaggcagaggttacagtgagccgagatcgtgccattgccttccagcctgggtgacaagagctcaaaaaaacaaacaaacaaacaaacaaacaaggtagtataagctacctaactgtaggatgaagtaagtgcacagtagaagatcaagagctctagtgagaatagaggataaggagataaagaagccattctgggttgtcctcttgtattgtcttgggtcttggtagcaattttgactgctttggaaaattgttcggtttcttatgagcatatgttccgtttctttgattctctgatgctgtaacaagtacccttgctttttaatggacaaattaactgaagggtagtatcaattttagtactgatttccgtttcctttttcattcttatgaatatgtagttgatctttctcacacacatgtacttacacatgtggtttaattagatgtggcaaaaaaccagtgttcctttttcaggaaggactttatttctattgctagtgctaaaacacatacgtttattgaaccaaatcataggatattatcacgttcagcactgtaaagtgaaataagctatcttaaaaacagcttgatggatttctaggggtaaggagttttaattacaaaatgaaataggttttaaactaatattcataagagttcaaggaaaaacaaaattaagtggaaaaattcctgttctaattttattagaaaggaattaatagctatttattcacaacatctgattaggaagctgggatagggcaagctctcaataatagaaaagtgtggggcaggcgtggcggctcatgcctagcacattgggaggctgaggtaggaggattacttgaggccaggagtttgagaccaacctgggcaacatagtgagatcccatctctgttaaaaaaaaaattgctggacatgagggtgcctgcctgtggtccaagctactcagggggctgagacagggggattgcttgagcccaggagttggaggttgcagtgagccatgaccataccacttgcactccagctgggtgacagagagcccatctcaaaaagaaagaaggtgggggtggtggagagaaggaagagagggagggagggagggagggaaagaaaagaaaaaaatatctgggtactatttcgtgatatcacagattgagtctttggcttcagagttctagaggtgattcaccagcctgaaaatacgcttttcataccttcgcattcttgccaaagcatgtccttcatttaattaggagaggataataaaatgtaacttgtaaggtgaaaaaaaaagaagcgacaagccatagagtttatctaaaaattttttgtcctaagcatttttgttatatttagtaggaaactgctactttgggaacaggagaagggaatattggggagatctgcatttttctttagctagtccttgttccaagtatattgtagacatagaggtaaacattagcgttgtattgaagtgcagtggttctttgggtatatgcaaatatatgtacattatttgtactgtagttagctgaggggacacgggatagatagatgactaggcctttgatgtttttttccttgtgtgaatgaggaaaaatgaaaaggtactccaaatgctgtgatttttgtggtatgtgcctagctcttaattgtcaaatgatactttccccttaactgtataggccagactgcttggtgtatctccattccgtaccattaattcacaaaaacttagaaagtattcttccacttgttacctttttgatttgattaatttgtttaaaggtacattgaaggctgtcttctgttgtataagggttgagtgaacacatccatgttcacttttctgtgtaattgatgccgtaattgagaggtcattacctgatgtctaaataaatagacatgggttgttttttcttacatatctgttcatattgaaactcatctcctgctttaccctatttctgaggctccgtgaaatatttcaacctcagtcttcgcattttgttagccagttacttcattgtcatttgtatacccaggtatttaacttggtttcccattcaggctatttatattttctgaccatttgtggaattcaattcatacctctccatctacttcagcaaatgttttctggtcactggttttgtttctctgtcagacccttccttacccatgaccaaaaaaaatccttaattttatcatagcttcagcttttgtttttattgttgctttgagtagtccatgtggtagaattttttaccctcagcccccaaaataaactttgtttcctgtctctctgtgggttatgcttacttattaagtccgtagaccttcttgttgcagactggcttttcaggaatcatgagacccatttatttgtacagttttgggtttcttctggacctcctaaaggacaagaagagttactagtaatattcctgccctctgacacagtaactaccacttaggtgccacagctctttgagattgtcagaagtcatgattgcctgtcatccagacctagtaatttctttatattaatataactgtattactctttgatctaatattctaacttctgcttcaaaaattatttcaggcctctcttgattagcttttccagacttcatgagtctctcttttatctcactttctttcctgaataagaacttttattattggctttttgagtaacttgtaaataatattcaaactcctcttcaggatttttatttctttcttttgaaaaagtatcttctgtctgtgaaaacatgattatatggattcttttttatctccccattgtagagtacattcttaatgcaacaaaagagcaaagattctgaaccattaatttatcgttcaatctagattcctgattttgtttataacgtgggctgtatatttgtggagcctatcttgacatcatgatggctttttatcctttaattatatttggtaaaaagtaaattgatcttattccatttgtcttcaccagtggattcagtatcggaagaaagctctttggcaagtgcataacctgactgaaatgtcagggaacagatggaaaggagttccgtaagaattggctgaatagtaggagtttgactttctgaaaagtttactgcctttcctttcctccagaagtgatgggaggaagagctcaaccttcaaacgaagagacagctgtttttaggctggtattcagtaggagaagataaaagcagtttcaaataggtctttaccctatggtttatttatttttgaagagacatgagctctcagaatatcgagaatatctcatgatcagatgtaaacacaaaaaacagtttcgagccaatataaatagttcttttgaattttcctaattatactactgccttgattagggtgaaaaattgcatttagggtaattaacttactcataatatggatgtgaaggcaactgactttatttgtgattatatagttgggtgttgtgaatgttattatagtcaaaatttctgcttaagtgcatataggctatttttgtacattttaacatttcctcatagtgttctgaagaccacactgaaaaaaatcccttttaaattactgattttcattacctgattaacttatgtgaatctatgatgaggctctcaggtattaactttaacaaattaagctatcatgtttataatcacatgaagaatttgaggcaggatgtcctacctgacatcaggtacttcttctacatttgataaaacgaaaaatgcattggaagacagatgcagtactttggaagacagacagaaaagtacaataaagattaaaagaaagatgggcaatttggcagtcaaacaaatttagctctgagtgctggggtctcttttctaattactcagcttttagtacgttaaaattggatgttaatctcatgatgaatcttttctttatactattgaaccaaatagttctttctcttatttattttttatgttgtcttcaggtggataaattaggtgttatgtctatgtttttccctttgtattcacataagtataatttgcaaaaaagcctttgccacagtgggaattcattgtggtgatgaaagctaaagtgttctttcatgctaattttataatgtgtatatactgcagaagttagacaaagaaactaagttaaacaaagatctagagccactgccaaacctgaaaacaacaatggcacaaagaagagaacagaatgcagggtccaaagccaacaaaatccaaatgtaaatttgctagtttgcaggcatctcatgtaaatgggcttattttggcaactcttggagttaaaaatacaaaagacatcacttatacaaaagcaaaaataattgagatttaaaaaaaaataggaaaatggtctttggaaatttatagtagccacttagtttgtatgaagaatgctgcctttcacttttgttaaaatccatttgtttacttgatcgcattactagtgtactgtggctcttcatatttatgaaagtcattttggatgacagaagaagacatgatcattacatcaaaagtttactgaacacgttttttccctaagccttggattgggacctgtaattacaatcctttcttggtatgttggcaacatattttatattaatataattgccattttctagccattgcctgcatgcccatttactcaatttaactacaaaagtaccttttaccttattttatttttcaatttttattgttttttttgagatggagttttgccttgttgcccaggctggagtgcagtggcacgatctcagctcactgcaacctctgcctcatatgggagggcataaagtgaatccttagcaagtgtgggtctggctcatttgtggttcatcagatggacgtggacgaagggaaacaaaagtagtaatgtttctttgaagataaaggatcgaaaacagagtgttcttatggaaataaaaagataatggctaaagaaatgggcatcactttttggtatatgcaaaaaaacgtgattttcctgctctaatatatatagacaaagtcttaactctgttgcccaggctgaaatgtgtgccacagtcattgctcactgtgacctcaaattccggggctgaattgatcatcctgcctctgcctcccgaggagccagtactacaggcacgcaccaccattcctggctaatttttaatttttttgtggagacgggatcgcactgtgttgcccaagctggtctcgaagtcttggcttcaagtgaccctcctgcctctgtctcccaaagtgctgggattacaaatgtgagccactgtgcccagccttacatataaatattttttcttatgaatttttaggtctacttttttgttttttattgtggttaaaaaaatgagatctgtcttcttaacaaattcttaagtatttagtatggtattgttaactatgtgcacattgttttacagcagatctttagtactttttcatcttgcatgactgaaactctgtccctattgaataacagttccccactctacagtaatcaccattctaccttctgcttctgagtttcgctactttagatacttcatataagtggaattatgcagtatttgtccttttgtgactggcttactttattaacatgtcatcctgcaggttcattcatgttatcacaagtgatagaattttttctttcttttaaggctaaataatattttattgcacgtgtgtaccacattttctttatttttttcatctaaagacccactaaaactacatggattaactacattaatccatcggtagacatttaggttatttctacattttggctattcatatttcaataaacatgggaatacagatacctttttgagatcctgattttaactcttttggataagtatccagaagtgggattgctggatcattatggtagttctatttttaattttttaaggacctgccatactattttccatggcaaccgtatcattttatattccctctaacagtgcttccagtctctccacgtcctcactatcacttatgttcttatgttgtgtgtgtgtgttttttaataatagtcatcctaatgggtgtgaggatatgtatcagtctcactgtggttttgatttgcatttccctgatgatcagatatgttgagcacatttttatgtacctataaaaatatacaaagaagacacctgtatgtcttcttcggagaaattgggtattcttaattgatttaaaacaatatttaagtcagtagaattttagcaaagtaaaagatactgaatttctggaagtctttgtgattgtgtttgaattctatgaagtgttaggctagtagttttgtatttgtccattgattgtttttggtttaagttatttcttcaagaaaactcatttttaacttataaacttcagaaattttggaagatagtgaaaggaagaaaaaattcaactttgcaaatgaaattattattagttttctagttcccttcagttttccccgtcatgcattgtttttaaagttaccatattaaacttttttttttatcttgcttttttaccgaaaactatgatggaaagaaagttttaattaaaaaaagcttaacagataaaagagaaaaagtagtacagtttttacattcagattggacactttcaaattggaaacaagaagaaacagtttttgaattaaatgggaaagtgaaataaacaaggataaataggagctaatactgtattactgaatttatatactcttagaaacatggacagagtcagaacacatagtaaatttatatgataatgagccacatgactctaatataagctctgctatttgagttttaaatgtttcactgtttaagaatttaccagccgggcacagtgggtcacacctgtaatcccagcactttgggaggccgagacaggcggatcacttgaggtcaggagtttgagataagactggccaacatgatgaaaccccgtctcttaaaaaaaaaatttacctgtggattctttaagtgaagttacttatattgtcatttaattactagtttttaaaatgaactttttgtttgttagagaaatttacagggcatatattctacctgttgaatgaatcatcatgctcagagagagttccagatttgtgactgatttgccttaccattttttttcttttctaactattgtaatttttttttcagccttgcttttacccgtttttctggtcaaaattttatggatcttttctttgaagtagagcttttcatgctgactttagtcatgtgatttttcaggtaattttttttttataagactgtgtttaggatgacatattctgcttagtaagaattcattattttcaaatgttcacggatttgttatgttttccatacaaatacatgttttgaggttagtggacataaagtggaatgggacattttgggagaaaacctctgttttattgagtttaacttgcttgatcgtttgtggtactgatgaacctaccatacaaaaagcagtgaagataaacttgggggtgtaaatgacaaagcatccagaatcatagtagattttcactaaatgcttattgagtagaaattattcagtagtggaaagcagatataattgatcattgtagaaaacagtaacattttctgtcacgtgttaatcttttaaaacaactcagtgaaacagtgcagggagaccgttttgtgatggtgattatagacacttagaaatgactccatgtgagatgtgttccagacacattacatgctgtcccatttaagtaggcagaacctatgtttccttttcacaaaaggaactggggcaaaaaagtgtgtggcattcaagacaaacgatttgaactgtgtctggattaatacgtcaaattctttttttccccataagatgaatactgtttcttttttattgtctaggtttttattctcatgaaagtaggaaaagagttgatttgtgataaacatgagtatctttgtgcagcctgactgactttaaagagcagtgggatcaggattgtgtcagtattacactctgtggtaatatcttctgtatcacttgctataataagtcattcatgttgaggatttttttttatttgtttgcgttattgttttagtttttgtgttttgagataggatctccctctgtaacccaggctgcagtacaatggcataatcatggctcactgcagcttctacctcctgggctcaagcgatcctcccacctcaacctcccaagtatgtaggactacaggcacataccatcatgcctggataatttttgtattttttgtagagatggggtttcactgtgtttcccaggctgttctcaaactgctggacccaagcgatgtgccctccttgccctcccaaagtgctgggattacagacctgagccactgtgcctagccatgtggagaagttttagtacagaggctattagctccggcaggctgtcagtactccagtcagagagaaactgatactttaagaggcaataccacaaatgggaaatccaacttagacccagcaacttcataagcagcagatgactgccttccacgattttcttcactgaaaaattgccaaatgagttctctaacaataggaatgaaaaacctttccttacagtttcagatcgtttacatttgttgagaatttaactgtgtgacagagactgtacttaaacgccttaccaacatcatctcatttaattctcagcctcactcttgagttatgtactattatcaacccacatttaacagaggaagaagcagacttagatagggtcatcacatagctagcaaatatcaaaacttggcatcatacctggatctagctaattctaaagcatgttttcttgagtttgtcaccttacatagttactacagagttcactatattctactttctttgttgacttgaagagaaactcagacactagtttgagaaattgggtatggaaggacatcagttagattcatttttttctgacattgtttttgtttgtttgtttgtttgtttttgagatggagtctcactctgttgcccaggctggagtgcagtggtatgatctccgctcactgcaacctctgcctcccaggttcaagctgttctcctgcctcagcttcctgagtagctgggactacaggccagtgccatcacacccacttaatttttgtatgttttttgatttttttttagcagagatgggtttcaccatgttggccaggctgttctcgaactcctgacctcaagtgatccacctgccttggcctccccaagtgctgggattacaggcgtgagccaccatacctggctgatattctaaaactattggaatacatatattaaatgttcttaatctctcaagtttccttcacactatcgataaatatcttcctctgactaaaggcacaccaagggagaaacagtatttccccttcttccctcctgaggcagctctgaacaatacataaactcatattttacccatcttttccccaatcttgttgatgatgtaattgaggaaattaagaagccctgtctggttccttgctcataggcagagatgaatctaaactacgcctttcgtctttacaagttctttagtttgaaagttttaaagggaggaacatggctaattcagctaaaggacacagagcaaactcagaataaattcatacttaaggaaatactgtcacctataagtattttgccagcgttttgctgttgacattgctttttctaacgggttttacatacttgataggtattctatataatacttagaatatttaaaatggtgcttagtagtacaaacaagttactttatcatagatgtttgtagaataaatggagagattttagcccttcacttgtaattcaaggttagcaaagggaagtgtgttctataaatagttctgttaagttactgtcttctattgctatcttgattaccagcttactttgagaaagattgaacaagataagtgatttttgtatacctaaaactattcaacaataataatttgagtggtttaataaggattcttaatataagaaattgtaatgggggtagatgagcaaaaattggttgacttatggagatctctgccttgagcagcaattgattatcttgcaatattacaaaaatgccagaaaataattcttgatttttcacccttcttctctatttggattgtgagagaaaatatttttgaaaattttataaagaaaatattagcctcaactgaaaaaaccttttttcctcttgaatatcagtataaatatacaatatctcaaaacatacccccattgttgtgtgtcacttaataacggccatatgttttgagaaatgccttgttaggcgatttcattctattgctaacatcataaagagtacagtgcctacacaaacttagatggtatagcttactacacacctaaggttgtatggcatagccttttgttcttagactacaaaccagtaccctatgactgtactgaatacagtgggcagttgtaacacagtgatgagtatttgtgtatctaaacatagaaaaggtacaataaaaatacagtattataatcttctgggaccactgtcatatatgccttccatagttgttatgtggtgcatgactttatttacatatgaattttctacctttcatctgcattaaatttctaaaaataacattgcatttaccttctcaatctataaatttaattaatttcctggatgtaattggatgggcttaccaatcataagccagcactcatattcctcccctgaagtttttttgtttgtttgtttgttttgttttgttttgttttgtttttgagacagagtctcgctgtgtcgcccaggctgtagtgcagtggcgcgatctcggctcactgtaagctccgcctcccaggttcacgccattctcctgcctcagcctcacaagtagctgggactacaggcacccgccaccacgcccggctaattttttgtatttttagtaggggcggggtttcaccatgtttcccaggatggtctccatctcctgacctcatgatctgccctcctcggcctcccaaagtgctgggattacaggtgtgagccgctgcacccagcctcctccactgaagttttaattgtggtggaggactaagtcttactttgtatcttgcaaaagacatggcactctctatcatttaggtagattttttttcaacctatcattttggtttgtatcgagttacaattttaatgaacataatttgctgctgtttgtttgatttctgtatgtacccattatcctctggaaacccacaagaatgtgagtaaaacatgaatattgggaaaaatttatatatggtgaaataagtgtatcttaaatgtataactcagtaagcttgataaatgcatacacccatcatcaatatcaagatgtttatatcatcaagatataaaacgtttcccttataacatgtagaagatacaatggagggcttccagcattgaacacttacttctccagctgctggaagtgttggtgaatgactcaccaaagttgcttttcaagagttaccctctgctaaagagagccatgttgaccgtggtcacgtccactttctgggggctgcctatatccactttctgggggccgtgggatggagggagaggtataaaggtcttggcccacttgcagcaatttgggacagttctcaaatgtcatcccagctccagaacttcccatgtgatcagttgaggcatttgttgctatgtagttcaattcatcttctccctctacccctttgtgcttccttcaactcataggttgagcatgagagagcatttttcagtggatttattttatagatacttccgtctgcttcccaggaactacccagcagcactccagaaagatgtctcatgtctgcttccagtcaacccttacctactccaaacaaccattgttttgatttctgtcaccatagattagtttcgttacttctggaatttgcacattgatggaatgaaatagtatgtcctcttttgtgtctggctgcttttgctcacaagatttatccacgttgttgtgtgtattagcagtttgttctttctgttgctgaatagtagtatttcattgtatcaataaaccatcatacatttatccccttgggtatctatagacattagggctgtttcaagtttttggctattacaaataaagctgctataaacagttttgtgtaattctgtttgtagatacatattttcatttaccgtgaactggaatttctaggtcagagttgagaagtattttaatattctgaaaaattgcttgtttcccagactgattttactgcgacagttgtagttgctctgcattctctctaattcttgttctaattgatatatttagttttgtaacattactatttgttttcttttgcgccattaattattttgtgcctttgttttgccctttctgacttattaatcaaatattttttgtattcagttttaattcctcaacgtggctttttagctggacctccttcagttatttttaggggttcctctaggaattacagtatacagtcttatcacagtttactcggagcttatagtttactatgtcaatgtaaaattaaggatcttgaaaagtattattctgtatacctcttcctattctttgtcatacaaatgttgcaaggttttcaaaacaactgtagtttctgctttgaacaatcacgtgcattttaaagaaaatagaggataaatcatctttattcgtactcacatatttgccatctgtatgctttctttttttttatagttgtgaattttatctggtattattttccttcagcctaaaaactctatttagtatttcttgtagtttgggtttctagtcagtgattctgaggtgacatgagcatccttcatgcttaaaggatgtcattcctttattgtttctgataagtcttcgtatcattttgctcttatgtaatttatcttttttctctctggtgaattgaagatttctttctttgcgtttgcactttaacatttttactattggtgcattgatgaggtttgctttgtagttctctcctacttagagactgccgagttcattggatctacagttttttcactgatttggggaaatttttgccagtttttttctcttaaatacttttggtactctcattacatgcatttagaccatttaatgctatctaacaggtagctgaaactattaattttttcattattttttgtgctttaatattgaataattttatattgatgtgtgttcagttttacttaccatttcttctgctgctccagtccattgttaagcttatccagtgaaattttcatttcagatattgtgcttgtcagtgctagaattttctttttttaaatggttttctgtcttaagagcctccatttgttcattcattttgactgtctttttcttaaagtgtttgaatatttataatagctgctttaaaatccttttcttattccaccatctttgtcatcctcggatatgttgactaatggtcacatttttatttcaccacacatgtagtaatttttaatttcatattggaaaatgtaggtgatatgttgtagaagttttggcttttgttaatttttgcagagttttgtttttgctctggtaggtagttaaattattggttgattatcttgaggcatggttttatgctttgttaaggcaggtctgtagaaagcccaaattatttaccaagcctttctagttagtctctgctgtggtgcccagcatctgaaatctgtgatcagttattttagcgttccacctgttgcttttagttgggattcttgtattcttcctcacgtttatgttgagaggtcataaagattggaggggaaattaaatgtaaatttttgaaccttcctcagctgtggctttctgctcccttgtgtttcccatccgtaatttccagtcacattggcattctcaaattctgttttctggatgctgccttttctgcctcctctccttcttttttttttaagtagagatgagttcttgctatgttgcccaggctgtctcgaattcctagacttgaagtgatcctcctgcctctgcttcccaaagtgctgggattacaggcatgaggcaccacgcccagcctattttctgacttcttaagcagagaagacactggctttctgcttgtccagccaccacattgccatgttgactggggagtgccttcatttaaccatatagatttggatcttacccagagagtctggttttgttctttgctttctagtttcaggtcttatgtttaagtctttaatccattttcagttgaatttttcatatgatgtgagatcagcatccaatttcattcttttgcatgtggacgtccagttttcccattgccatttttagagactatcctttccctattatgtattccttgtcaaagagcagttgaccatacacacatggatttctgggttctctattctgttccattggtctatgtgtctgtttttaatggcatgactttatgtctggaccatactgttttaattactagagctttgtaataatattttgaaatcagaaaggtttagacgttaattatgagagttcagaatttagaaatctacatgacattaatttttgcttacatatgtacactcatacatataacaaatttgtatgaattttttagtccatttcatgagaacagtgtgctaatatcaggggtttcagttgagtacattcttggtgtgattgcctttgttctgtgccttggtcatcagttgtatcttttatgaaggttgccttgcaatgtcatgccctttaccagggagattgggagagtgaacataagtggataagtaaaaaactatagctaggccgggcgtggtggcagtctcagcactttgggaggcagaggcaggtggataacctgaggtcaggagttaaagacagcctggctaacatggtgaaaccccttctctactaaaaatataaaaattacccgggcctggtagtgggtgcctgtaatcccagctactcgggaggctgaggcaagagattcacttgaacctgggaggcagaggttgcagtgagccgagattgcaccattgcactccagcctgggtgacagagcgagactccatctcaaaaaaaaaaaaaaaaccaaaataaaacaaaactatatctgctactagaaaacttgtccttatgttaagtaacagtgtcatgttatttataaatacttctttagtgagcttcttctgtgtattcagcattgaaggtgatacagagtaagagctgaatgtggcctttgctgttaatttgagacatgttagatagtgctcatgtaaacagtataacttcatccattgatgaacatttaggttgtttccacatttttactattgtgaataatgctgcagttgacatgggaatacagatatctcttttagatcctgattgtaattgttttggataactatctagtagtgggattgctgggtcattatgatagttctgtttttaatttttaaagcaacctccataccatcttcttaatagcagctataccattttacattctcaccaacaatgtacgggggctctagtttctctacatcctcatcaacacttgttttcttgtgtatgtgtgtttttaataattgccattctaacaggtatgagattatatcttactgtgattttgattcatattttcctgatatgtatgatgccgagcagcttttcatatacctgttagccatttgtatgccttctttggagaaatgtctattcaaatttgttgtctgtttttaaattggcttatttgggtttttctgctgttgaattgtaggggtttcttatgtatgttggacgttaaccccttatcaaagttatggtttgcaaatattttctcccattctgtagattgccttttcactctgttgttgactttgttttgagtagctttttagattaatgtagtcccacttgtctgtttttgcttttttgtctgtttttattttgtcacatccaagacattgacaagaccagtgtcatgaaggtgaggtgcttaacaggatcaggcaccgcagaacagaggtaaatataacctgtagcccatcaccttttttttttttttgtagataaattttatttgaacacagcaactcccagttgtttgcataacgcctgtagctgctttgttgctagagtagtagagttgagtagttggtatggaagtgatcagcccccagttgcctgaagtatctatcatttggccctttattgcaaaagtttgctgacctgtgctatagagatcaaagaaatgaagaataagagtaagagttatattttatgacgaggacggctttgatgacctgaaagagtttagttttatcctgtaaacaaatgtttgctgagagcctgctgggtgtgtggcatttggttttgctggtgtgatccagaagatgatagatagcaggagattaattaatgagtgagtaaatggtaagaagtgaaggtgatgaatataaatttttcttttgtgagtatggaaagaattgagtggcagttttgtactatgagggagatttttaaatataaggaaaatatgaaaggaaaatttttagagttcctctgagagaggcagagtgtgttgtcattataggaattaatggtctaagacttgaaccagggagtacatgggcctcattacaggaaatgaatagaattgtttgtggaattaagttaataatagtaattgctcacacagctgtttttaaatagcaaattgtgttaggtaatcagcaaaaattcattaaaatgtacttgatagttatgcagaaactgctttattggtactgacttatgatcctaatgggtaccataaaaacaaaaaacctttgcactttcacattggtatagtgttgtatgttttttgtttaatgtgtaagtccatttgtaatgttttcatcttccttttctaaccaccaaacccaaatataattgtcttgttcaagaagggcagcaacatgaactttatgagctcacagagcaatggggtgtgttcgcactgaaaagaggagtatctgtttgattgcttccctgtcttctttcccagacagaagtggaatattttattgtatggttggatttaggtctactaatttgtttgttttctgtgtattccaacagtattttgttttactgtatctccattcttttggggtgggattttcttaggactccttttattagctggcttttttgcaatgcctctgctttttttttttttttttttttttttttttggtagcgtctctagggatgttaacatacatcattaacttctcaaaggctatttagagttaatattgtgccacttcacataaaaggcagaactcttgaccttattataggtctatttactgccttcctttatgctatagttatcatgtgtattacatctgaatgcattgtaactcttaggagagaaaattattttttctttcctaagctctatgtgttttgaagacattaaaggaaaaattagtctttttatttattatatatgatactattccctaggatgcaggtcttcctctgataacattatccttcaacctgggccaggtgcgttggatcacacctgtaatcccagcactttgggaggccgaagcaggcgaatcaagccggggtcaggagttcgagaccagcctggccaacatagtgaaaccctatctctactgaaaacacaaaaattagccgagtgtggtggcgcacgccggtaatcccagctacttgggaggctgaggcaggagaatcgcttgaacctggaggcggcggttgcagtgagctcagatcgcgccactgcactctggcctgggtgacgagcaaaaactctgtctcaaaaaataataataataatgattatccttcagcctgaagaacttcttttaatatttcttataccaaagttatactggtaatgagttcttaattttctgttatttgtaaaggtctttatttcaactccattcttgaaggatatttttgctgagtatagaattggttgataattattctcccacatcccccaaccccaagcactttaaagattttttttttcacatctgctggcattcatagtttctgaagacaagttcttagttatttgaaatgttgttactttcaatgtagtatgtcactttctggccattttcaagcttttctgtatttttgggttgtcagcagcttgactatgttgtgtctatgtatggttttcttcttatttatactctctgggtttcactgagtacagtctttaatcagtaagtttgtgtctgtcactgcatttgtgaattttttggccttatttcttcaaacacttttttctaccatattttctttgttctctcattatacctatgttagtcttttaaatatcttcccttaggtctctgaggccctgtttgttttcttttaatcctttttctctttttatcaattggataatttctgatgatctctcatcacgttcacttactgttacccctgttatctccatttactcttaagaccatccaggaaatttctttctaaatttcagatacttagttttaggggtgtgtgtgtgtgtgtgtgtgtgtgtgtgtgtgtgtgttttgagacagagtttctctcttgttgcccaggctggagtgcaatggtacaatctcagctcactgtaacctctgcctcctgggttcaagcgattttcctgcctcagcctcctgagtagctgggattacaggcgcccaccaccattcccagctacttttctgtattttcagtcgagatggggtgtcagcatgttggtcaatctggtctcgaactcctgacctcaggtgatccacctgcctcagcctcccgtagtgctgggattacaggcttgagccactgcacccagccaattttagttatttttaattaatttatttatttatgagagagaatctcgttctgtcaccaaagctggagtgcagtgatgcaatctcagttcactgcacccactgcttcccgggctccaatcaatcctccaatgttaacctcccacgtagctgggactacaggagcacactgccgtgcctggctaattttaatttttttgtagacatagagttttgccatgttgctcaggctggtctcaaactcctggactcaagcaatccacctgccttggcctcccaaagtgctgggattacgggaaagagacaccacacctggcttaattttagttttttttaatgttttctttttcttcgtgagattttcacttttttttttttttcattaaaagcatgtatctttcactttattgagcatagttacagcatctgctttaatgtccttgtctgaaaattttactttgggtcatcttgctgttggcctctggtgattatcttttcccttgagattgggttacatattactgtcaaagaattttggatattatgagtgttatttgtggaaattgtggcttattttcatgttcttccaaagagttttgatttatttgttttagtgagccatttgcttttggttagactcatagcaaaaattatctcttgcctgaagttggtagctgctcagatctcaattcggttcttttagtctctgctacaaactgccttgtgcctgccctgtgaatggtgttccaggactcagccaaagatgtgggcagagataaaccaaaaatttgggacctctcttttctggccttctcccttttgggattctatcctcactttctagtgactgtggttgtcctgtctctgtcctcttttccttcaggccaaaaagacaatggggtttctgttggaattttagttactagaggttattgctgcttgcctgcaggagaaagctttcagaatgggaaactcacctgtgctggtccctgaaagctgattaaaagagaaactcacccattctggtctcttctttcaagtttatattttcatcccaatcagcctgtttttgtttactccccagagcctttatgtagttgatagcaagctagctagatattttctttccgccagccctaggatttatagtaactattagaagagaaagaacagtaggagatgagttcagagaggtgggaggcagaacctgtaaaacattgtagaccattgggtttattagtaattctgaatgagttgggaagccattggtaggttttgagcacaggatggacatgatttggcttgtttttaaaaggttgctctagtaggaggggcaagaagaagggaaaacatttaggagactattacagtaatgcaggtcagagatgatttgattgtgttaaaaatagcatcaacgttttgttttttgtttttcctttcttaaaactacgtttgtagtgcttctatggaagaaaacactggcattggtcttcagatacagggctttggtatattagattgggagaatacttggttctcaggtacgttgggagggcccttccttctttctagaaacttgacagctaatttaggggagttttaaaggtagctcaagagcctttgtcagtcttggaatgtctgttcagacagtcagaacaagtcctcaaaatacagtgaccaccatatcactatatagttcccattaaacaattcccaagtcgacccctgggaacgtattactttcaattcctggccatcaggcagtttctgtttttcttaaagagatagacttggcatttccttttggccctgtactcttacttctttgattaaatcagtcattgggttttccttttgtatctttacagggcatttgtatcagggtgatatagctagtaacaataatatagcaaaatctatgtatgaaagtcattttcaaaattagtcatttttttgaatgaaatttgccatgtgttcattaccttattgtactgtactgtggcactaaaaactttaatggaacatctgtacttgtaaatctttggtttcaacagtgccaaacaaaaattctgattggattattaaagatgaccggaaagggtgattccttctaatctttccaccggacttactttcttacatatgtgttttttagactgttttatttgacaattcactgcacagaacctaaattttttataagtaaaaaagtctataactaatgttatatactttagatgaggtagcatgttttaacttctattaaattcccttgcaattttaatattttcctagcttttcccttttttactaatgtgtagcataacaaagcacttgttattatattctaactgatcctatttcacaatgaatgtctgggaaaatacattcatagatttatttcatgagtgtctaaaatgtgaaaaatacaataaaaaatcttggtgttggttttttaggtgtatattagtttacaattgattgcagcctttgagtcttatctaaaggaatatccttactctacaaatagaattgaataaagacactattaaaaatagacacattcatagctttgattatctgatatagctatctctagtcagaattctttcatcaaatcatttattggatccccctacagcagatggcaatcctgcaaaatatgttatgtttcccttatttatgacagtgctgagatttgatatttttggagtacattttactttctagaataaaaatttgatttcagtgctactaaaggcagagtgcacatgtgcaccagcgggtggggggagaaaaagagagaaatgtgtatgtgattttccctgtgcccttgctcccaactgtatgtgtgtctctttcccacagggatgggctctcatttatgataccctagcagtatggccagattgaattgcttttcttactgcttttgctgcagggacatcctaaccatttctctcattcttgtatgctgtctccctgtttcatcctttcattctttcttgggtcatcagactcaccactactaactgaaaatattttcccatttcctgtcttatttctcactttaccctagtcttggttcagggtggcggagtctttagtgataggtctggtagtggcaaatgggcagagaaggaactggtgttcatgtcagcaggtttgttcctaattcttcccttttactttcaggcaggtcttgcctaagtctcaccaattctttaatgatggtttacttactcaaactctgcagtgttaacaataatttgtttacagggctcatatgtggtggggggctggggggagggtggagggaaacacaataggtgcttagggcatagaaaagcatctcctcccaccaaaaaaaaaaaaaaaaaaaattccagtttccagtttttgctagtggatcaaaacctagagatgcccataggactctggtggcttgatgaaagggaagaagtaggagagaggctgtgggatagtttttgattgacactagaaagaaaatactgttattcaaatactaagatgggagtagagcataagaaggtagtctaaatctgtgttcttcctagaaaagggagtaatggcagatgttggacttgggcaagaagtttacctgttcctctaagagtcttatactctgaaaccttaaaaacttgaattttacctttctattccttctttaaggtatcagccttttagggaactgcctgtatatatagtaatttatgattgctcttagttacttttcttgttaaatgttttcacaaaagaaagaggcggattgcttttgttaagttcacaaactgttgtttttagatacgaggtctagaatttaatgttccttactggaaaatactaagttaaaacagcatgcttttaaaaatggagctcatagaatcagaatatattacatttgacttaattgattccattcagaaaaccaggtactaagagattatctatataaaaggttaacaaggaaaaaaataatttacgtctttctgttattgatcaccccttttaatcctgttgaatagaaatggaaaaaatttattagaaagtcaaataaggctcaaaagtgtttctatcattaattattgctgaactttctcttacatctgccattttggtttatgagtcaaggaactaacttctctgaaattgttgaattcgcatgcatatactagaaatgggaatgatgaaaataatatgggaatgataattcagaaataacaggaaaaatgttacttctcatcactgtattgcaactgtggtgtattttcttgtcaataggtatttttttcagattttggtcaatttgtataatatctgtgttaagttttatcttctgtgtgtaatttcctttttctgcttaccttggtcttacggctgaagctttggaaagtttattattcctgtcatatttctgtgtttgtacagccattgtctttagcagaaaggagtcattgattctaaaagatgactcttgcctttgtcagtgccagccacgaccttttactcagagtctggatatgttaacaataaaactacagagcttgagtttaaaacctagccagattcttgttattctatagcattctttgagccccttgtcatttccagtatcagtggtatgtactactctttagctggtgatgccatcacccaattaattaccattttatttcattagtctttgctttttctttattttatagaagtagagtcacttgatgaaaattgaatatgtagtttcacataattttgtgtgtctcttgaattttgcttgagatgttctctgtaactggcacccatctttcctctctctctgtttttacaaatgtatttaaaatacatgcaaagctgggcatagtggttcacacctgtgatcccagcactttaggaggccatggagggagaatcgctggaggccaggagttcaagaccaacctaggcaacatagtgtaagactctgtctctacaaaataaaaaaaaaaattaatgattagctgagcattgtggcatgttcctatagtcctagcactgaggaagctgaggcaggaggatcacttgagcccaggattttgtggttgcagtgagctatcatcatgccactgtactgcagcctggatgacagaacatgaacgctgcctctaaatgagataaaaattaaaatacacataagcctcatatttattagtcatttgatataagaaaatatgaagtcataaaaagactaagttatggtttgattattttcatcaggacaagattcatcgaaatcacttaccattatatgttcaataaaagtgattttttaaaatacaacttttcataaaattatatgcagttccatatattagtggattttgtaggttaatggtcatctttttcttggattgagtctcagaggaatacttgctgctattctacagtgttggttgcagagaaaatgcttggaagatagctcactggtgtctaatgatactggagagatggtaacagtgttttttttttgtttttttgagatggagtcttgctctgtcacccaggctggagtgcagtggcacaatctcggctcactgcaacctccaccttctaggttcaagctattctcctgcctcagcctcctgagtagctgggactacaggcgcccgccaccacacctggctaattttttgtatttttagtagagacggggtttctccgtattagccaggatggtctcgatctcctgaccttgtgatctgcccgcctcggcctcccaaagtgctaggattacaggcgtgagccacggtgcccggccggtaacagtgttttttacatgacattccccaaactcatagaatatctcttaaatttggaactttaatactagctccacaggaatgaacaaaacactgttcacgtaatctctgtgttttcaaagcctctggttcacttgaaattgtgcctggaatgttgtctatactagatactcatcttttgtatcaactttttaaaaaaagttattaaaatatactttagtcacttgatacaggaagtacagattcataaaaataatagagtcctaataactaagttagtaattagtacattctactttggaaactgacccctcccccttccctgctttttgttacccatcctttcaatttggcaattgtgtcactataaaagagccttagtaatcattgcaaattaatggagaatttgtggcatttaatttattacataccacattctcacctaaattacagggaaattacagagggacttccaggaatatcttgaaagaaagataatttctaaacttagcagaatgttatcattgtagtatctaggctgttctcatgaaagaatgaaagaaagaagtcaactatttctgtgttgatgaatttcatcatagaatgaaactcagaaggggttagagaagtgtaccctccttgcagtcaaggatgaaaaagactggagtcttcaaaacagaagaggtagaaatggctggattaagagatctccaagtcttccagctttttctggggactgattcggaggtgaaaataatggagcccaagtgtcagaagatgcattaaggatgcacaataaattgttttgttggttatggcacctaattctttctcactgtgaattttcttttgccaccttcataagagtggaactgcttatttgaaatcaaattgtgtataattttagaagagatggaagtgtcacccacaaaattactaagggtgagttttcatgtcattttgattttatataactaatgttgatttgatatggttgatatagttagatttagtttgatgtcatcagttaagaatatctgatcactgatcagaaagaaaccaactttattaaattgaatgattgtttgtcttgcttcattttctagggcttaactatgaaaaatgaattattcatgttttcatgtaggcagtactaaaccagacaaagtttgggggttcatctactcctagaagtagcagtgcagggcgtggtgctggatggagagactatgccccattctaaagtctgcaaagaaatattttgattctgaattactataatttacatagggtattgcatgaggattgatggagcaatgatgaagatactttgcagtaacttatattttacaggtttctgaagcaaggattgatacttagctcttccacgaaagcgcaaataccacttgctaaattgtactctgctgtcccgtaccaaaaaaatccacaaaagtatgtttttagatatatcttttattttcttctctttttaggtattgatgaaagaggaggtacaacatcttggggaacaagtggtcaaccaagtccttcctatgattcatctagagtaagtttgctgatcaacccttgattaaagctgtaatttggcagactacgtaatttctttcatatatgctgtttcttatgagaaatgaaaattaatttcttttcatggaaatgcagtagaatacctagtacctttttgttacatttagttctttttataagctgtcaaactttggaaatttaatttcctacagttaaatattcttggtgttacttgtacacatgaactgcctacagtactctactaaagagcttagaatgcataagtgctctccatatgtatttagccatttttctttatgtgttgtttatttgctttgagagatggcattggctttcaacatactaacttctagcctctctccctcatccttgcttcaacagtcatcagccctttgcatcaggaactcaacagccctgcctcttggaagcatatcaaaacagacataacagatgacatttcttagttaacagttaagagaaaataggaccaagtcaactttctacacactgaggtcacaaggttagagccctttccagcaaaaaacaaaaacaaaaacaaaaaacccccaaagctttataaaatgagaccaggaggtggaaaattagatcaaagaattggaataaaagtaagcactctgctcccagactttctctagtaaactgacgaggttaagagatacttttccaggctgggcatggtggctcatgcctgtaatcccagcactttgggaggttgaggcaggtggatcactacaagtcagaagttcgagtccagcctagccaacatagtgaaaccccatctctactaaaaatacaaaaattagccaaggcgtgggggtgggcatctgtagtcccagctactcgggaggctgaggcaggagaatcgcttgaacctgggaggcagaggttgcagtgagccaagatcatgccactggactcaagcctgggccacagagtgagactccatctcaaaaaaaaaaaaaaaaaagagagagagagaaagacttttccaaaaggccatactttaagtgaataaatttctcatttctctcagaattaaccaagagaagaaagagacaagcataagatttatgggtagttaatcctagaagcaaattgccttaatgggaggaaaactgagtaagtgactgaaatgcatagtctcagtatggtttacacaagtttgcattgaaaaatgctgagttaaaataccttttaaaatacggggttttactgttatatctggctgtagcccatgtttaatttattttaaatcctttggaaagaactgggatagtcgtatggaatccaaaaagatatataaagaggctgttaaaggtgggtttttgtgtttcacttttgagaatcagaggctgagaaagctacattgtagtgtaaagaaccctatgctgagtatgtcaggacttggattttactatcaactgtattgtgaaccagccatttaatcttggacacactatttttgtcttagctatttaatcttggacgcattgtttttgtcttgaggctacttaaactggttgatacccaaatttccttccactcttaaacgtttctgattctttgagtaatattgtgaatatgtgagataggatctagtttagattttgaaggtaggagttttatgtagtgggaaactcacagtactacttattaatattggattatttttttcagaggcttgagttactttgtaataacttgttatctcttagaatgcattaaatggtgcctgggtgccttatatttctctctctttcaggctttcttcaccgccccgcccccccaccaccccccttgagtgctgcataggattttaggagaagaaaagtactaatgtatccaaacacttatgtaatttatgatcttgaaattaagtttaccttcagacatgaaatccaaagcaaatcttgcttttctttttgctatttataggtcaaatgtgaaatgctgtattttacttagtttatttatttttagtatgtattatgtacagtgaaaagttaaattgattatatagtaagctagttttcatagaaccatagaaccacatatgtatttctacctgtctattgagagatcagatagagtgaagatttaatgctacccttctttatttttgttcccattgaaatccactctttcactaatttttctccttctatcctagtcatcgtctaaacctaaaaggtttggtgagatagttaagaagtttttcgtatcattttcaaacaaaaatctggatccagtttctccttggcaactcttcttgccaaggagaactttatggttgtctttgaagcctccctcagtactactttatagggaaattatcagcttttggggtttcatcttttaacagtattcaccatcttgaccatttctttcataatcataagcataaatgggtataattgtgttgataagaatctcaactaaagtacttcattctcctattttagtatattgaatttcttaaattcttatttaagtacattgaggttcttaaattcaaaaataaatattaatgttggctaaagactagttttgacttgttagttaaaaatttgtcaacttaaacaatgtagttgcagatacttcagtagaaatcaagtaaatgaaatttatttagactttatcatattatataaatattacatttctatcagcagattccattatttaaaaataatttgattttcagtaacatcactaaatagaaattttttattatactttttataacatttgaaaatgcttagtaggccaaaaaaagggtattagaaactgcaaaatgagtaatttgttggagatacaatatacctgctttaaacttaacatgaattgaactatctgagctgcctgccattctatccctctcccattcccatgccaaactataagggagaaacaatactttctttacaataatatgaaaccatatttggcagatgaaccctattaatattgtatgttatatgttactgtatgggaatagttacacaaagtcatattgattgaacttattctttatttaatagcttttcaagggaaatttttgctatgtacactatttgccttacagggtcctgactttaattgtaagataccattctactatagtagccttgatgcataaatgagctccacctgagttatgtattaagcggtcacaaacttcttatctctgtgttaggcttatccccattctttcagaattaggaaaagtcactctagcatggttccagtctgtgtgtctgcccttgcttttaccaaatccaccagaaaagtagcctcgcagtttagaggtgattaagtttctggttatcagaagtacctacagcaatccattcagtgaagaggtttcgctaggttgacataaaaatagacattgtacctaagagtggttataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgtgaacccgggaggcggaactcgcagtgagccagatcccgccactgcactccagcctgggcgacagagcgagactccgtctcaaaaaaaaaaaaaaaaaaaaaaaaagagtggttatagaagaaatggtaggcatggtcagcattcttaggcaatgtggatttcacatttcctaagcatgtctcagcatgtttgagacacccagagggaaggaacaaacatttgttccttcctctctacttttgttagagtcctggtttctgcactcttcatctgctgtctacctgtgcagagagcatagacacacacatgaacatatagatagaatcatgttgtgaatagcacttccagttttagaaatttgtgaatgtggtgataaaggtaaagcacctgagactgaaaggagtgattaaaatctcaggtagtttagacatgggcaagagatctagttaatgagtttgttccctctctcccttgctttttattctttattgcatagaaatgttggtgtaccaggcataaaggccagagaatattgtggttgttcttgttcactaaggtgttaatgacttactctagtttcagattttttttttctcttcagaaggctgtgcttaagagggcagactgtgaaatcatactgcttgggtataaatcgtaactctgccacttactacctgtgtgattctggacaagttatttaaatctagtgtacttcggtttagtcatctgtgaaatggggataatgatatctgtttcatgaagttgttgaggattaaatgaggcaatatatggaaattgcatagatcaatgtctgatatgtggtgagtgctatataagtgttggctttaaacctgtgtatctcaaaattcacccattagatctatatttaacaattacacaaatttaaacacatggatacatttgcaaatatgctgtattctaagtgtaataaatgagaattatttgccgactcagtcatgcttaatttaactacttttatttattttaaatgtatgaaggacataaataaaatcaatttcccctcttcaactgtttatttctttcttgggaaagcaacagtctcttcctgccaaacttggatataaaagttatcagtctctctagtataacaccttatacatgatgagtgctctatacatgtttgctgaatataatcaaattcgggaacaatcatcagatttactagattaactaggctgggaggttgaggaaggaaagaatcaaagttgatttaaggtgaagcttgaagtaggtggtggtggtattaatggtaataataagtgatttggaaacttgtactgtgtgaccatgggaaagttacttctatgtgtcttagttttctggtctctaaaattatgataattttacatgtattttgtagggttttggtgaagatgaaatgtgataataggtatgaagtatttcatttattgatataataagtgagaactgctattatattgttatttataataatttgaagtacattttcatggttatatttcttgatgtacaaattctgtttctagaatgtcgagttatatgagtttgtggaaatgtcaagaggccaggtcatcttggtttctctgcctttttaactgtgttagccaacctacgccaagctctggagtagagtattaaagtaccattgaggtttgcatcctggggtgggagtaggagagaggagtatattgatactcttttctaagatacagagttggtcattccttagtttaaaagatagaattgagttcactgataggaaaccactgataggaattacatttataggcatcatcagtgatcaagagttggcattttaatcatgaacatttttcagtttatatgtaatctattatggtagttatttttttaaaaaagaagcaatattaagttgagtagagtttgagtgctttttaaaaaaatgaattgctaaatgtccaccatggttttctcttctgtctgtattatggcttgcagaatgaaacagtcatttatctttttgctctttcttccctctgtgttttacagtatcatagaattttcaaaactgaaagatgcattggttatatatgttctgtctctttatttcctacatgaggaaactgaaacgacatgtttgagatttgaccaggtgtagatttgtgctgtatgtagagatttggctaggctatgtgactagttaatgacagcctctggcatgacagaactcagatattctgaatcttatgctagtgctttttaaccccttgactttagtacttcccaactcaaagaactttacgttttctgccatatactgaaggaatgggaaaagagagaggagaaaggtgaaaatagaagagggtctgcagctgataaaagaggacatgggacatgatatgatagaacagtttagcaagtatagtgtattgggtagaatagcatagaatttaagagcttgagcattaaaatcaagctgtcttgggttctatttctggcacttctgcctcattgctctgtgactctgagcaagttatgtgtttttactttaatctttttttcttttttcattgattaaaagggggtgggtactaataataacttcctcactaaagtttggggcttatacctgtcagtggaaaggggaaaaccagttgtgtggtgatgatttagctttaaaatacttgatttagctgctgtatatgattcagcacaagatgatatccgggattttttttttattaagggatagtaataggtatgttctgaggctttttgtttcaatacatgctatgatttctgatacctatagcaataaagggatatgaggattcagttcatttaaaaagcatcagcagtggtttttttcacagaccagttgttaaaaacaaaaacggaccatagacccaactaggttgaaaatgaaaatatgtgggtacaaggatttaagtatttctccagtcttctaaagttcatagacaaagccatagattggggccttgggataagggaaacaaaaataaataaaaactcagtgaaagtaaacataagctttcagattctatgggaaagtaaaatcagcctataagattatctggatgagattaatgtcatttttcttgcaaatcctggaccattcctgccagatatggctaaagggaactttaattttgtttagcgctctctccattcttaacaggagttcagtattttttcgttaatgtggaagagtttggctaagaacctctctatagtttgtaggtagtgagttagaaataggataatagaaccttggtttttctaatgtgctatctatacaaaaaacacaggtcattctgacctcagcagggtcatactggctggaggtgtagaaggaactggtgggtagttcatttacatttgacagcagatgccttaagagtgtatctatgggcagaggcaacctgtagtttccttcctccaacagagtccagtggcataagaacagtatagttggcctgcttttagggaggttggacttaccctgatcccccaattttaagatgttgagatttgtaaatgcattcagtttcttaaatgttaaaggtgaataaatgtgtatcttatagttcaggaaatatgcttagacatgtaagtcatatttgcctaaagagttactttttaggctgggcgtgatggctcacacctgtaaacccagtacgttgggaggctaaaatgggaggattgcttgagcccaagagtttgagaccagcctgggcaacaaaatgagaccccctctctacaaaaaatagaaaaaaaaaaaaatccaggtctggtggtgcgcacctgtggtccgagctactcaggaggctgaagtgggaggattacatgaacccaggggttgaggttgtagtgaagaaaaaaaaaaagttgctggttcacacctgtaatcccagcactttgggaagctgaggcaagtggatcgcttgagtccaggagttcaacaccagcctctgcaacatggcaaaaccccatctcttaaaaatttagccgggtgtggtggtgttggctgtagtcccagttactcgggaggctcaggcaggagaatctctagagcccgggaggcggaggttagaatgagccttactacactctagcctggatggcagagtgaaacccgatctcaaaacaaaaaacaaaaaacaaacacagcccaaaaaacttcttaactcttttaagacagcagtggagatgctgtaattaggcaacaaatagttaattacgaaaataattttcttggctactgtgagattccagaggagggagattactttggatggtcaagaaagacttaatagaggaggaagtgtttgagtagactgttacaggacagatagcatttgaatagggctggaagaaagtctggaaatatggaatgatggaaacagtacagtggtctcattacaaaattcggtagataataaatcagcttactttgtgggaaaatagtacgagataaggcaggttaacatttctgtagaaaaaaatgttatctattctttgggagccaattaaaaatagattttatacacaaaatgttttataaatattaacttactgtggtatgaagaatggatccaaggtgaaagagtgacaaaaaataggatgatctgaaaagatggtacatggacccacggataatgaaataagacttggattgggaggatagtaatcagattgcaaagttatataagaaatttcacaaaggggaaaacacaaaactggtacaactaagtgactgggaaagatataaaatcatgtagactcacttcacccacaaaatggtaactcctgaattaaacttcatgtgttttatttaggctttgtcaagttagctatggttgtattaaaacagattgtttgattttgataaatagttttccttaatacatgggaaaatcgagttgtgtgaataaagaaatataaaatagcttttactcagttgtcccatttgtcagcattgatgggtaataaagattagtgttactttttcttctctagtgtagatattttctcaaaattgtgtgtttgctattgtttttatttttgaaggggaaaaaggtatacattttatagctactaggagttcaaatacagtaattagaaaggacacacgaattttgaaatagtattttatgcctcttgatctcaggtacaatacacgagatgaagcagttaaatagcaaagcaagacagaagggtcagagaattaaagtaagtgttttctatatattgcatctgtgttcccattaatctctgttttgttatgtaactgctccttctgaatgttctgaatgtgaagaaaactatgagtaagaaaaagggtgtgttttaaagttaggtttaaataaagccagaagagtaaaatgtttttactcttagttctgtttgaaacagcacctgcctataaattataacctaaatgtttttggataagaaaaaattgggttgtgatgatgtaagcacctttaaatctcttgctagcagatatttaaagtgaaagaaagcacatactgatcagattgcccatgtttccattttaagacaattaaagcttctgtttttttcagactagcctttcttcctggggacaacacttactgagaggctttgctgtggatctttttggaaataaccttcatgtcaatttctcaccttactgtgattaactttctaggcccatgaaataacatcttgatcaggactgatctaatctttatagttttcttttttaatcttctaactgttcagattttaaagttaacaagtaaaaatcaaagcatattaatctttgaatctttatgtccctttttgtaattgttgaggtctttcttgacagcctgtttaatattttttccctaagtttagagattgcttatttgtgggaataaaaagtagggtgacacttttttgtacccacttgggtttttaaattaataacaatgaaatcataaccagcacttgtcacaatttagtttacacactttcatgttacctgctttgatcttcacacgagctcaccaagaagccatttttaaaatcttctccattttagaggtgacagaattgaagctcagaaaaggtagataacttatcagatattaaatgcttaggactttatccaggctgtctctaaattactttccctttttactgtgttgcatttgccaaattataaaagagacccccagaacagttatttctacttgtgcaggacttgaaggacagagtcactagaagtttttttgtttgtttgtttgttttttgagacggagtctcgctgtgtcgcccaggctggagtacggtggcgcaatcttggctcactgcaagctctgcctcctgggttcatgccattctcctgcctcagcctcccgagtagctgggactacaggcgcccaccaccactcctggctaattttttttgtatttttagtagagacagggtttcaccgtgttagccaggatggtctcgatctcctgacctcatgatccgcctgtctcgtcctcccaaagtgctgggattacaggcatgagccaccacgcccggccttagaagtttcaggataacggtactgccatcttacttcttataaaagcagtaattcgtattttatgtattaaaataaatgagccataggatgaatcagacaggtttgcttctagttttcaccactctatttgaccttggacaagagagttaattcccgagcctcagatttctcatctccaaagagctttttctcataggaagtgtgcaagaattaatagaggaagttttatacagtatttagctcatatagaaatctatacattgttcttctttttacattcccatgagaaatttcatgcccattttgattaaaaaaaaaaaaaaaaaaaagatgttaggaatttttcaaatcttggatggtcactggagaggtagctgttttgaattcttggagtatatcctgaaaagatgatggactattagggtttttaaatgcccaacaagaagtttgtttgtttgtttctttgtttgtttgaaacagggtcttgctctgtcgcccaggctggaaatgcagtggcacagtcatggcttactgcagccttgacctcccaggctcaagtgcctctcccaccttagcctcctgattagttgggattacagaggtctaccaccacagttgaacttttggaaagttcactgtattgcaggtcttgggatttggagattattgggaaaaagaagtagggcaacccacattcttatgaatgtaaatttatacaaatctatattcttataacagattgcagattaatacattctaggaaaggaagagatttcagttcctcaaatctgtttaaaaggatatgcatctcacaaggcatttaagagacctaaattagcttatataggccaaaggattggtgtcatcaataatggttagatttttgtgtcatgtatttttgttgtcatatacttaaacacttttattctgagaacaagcttgaaacgtttcccttcaacatattgaactgatgctttaaccttcttataaaatgaaataattatttaaatgtcattttacatcataatcagtttgttgctttgtgcacggagcagagcatattctggtggttaggactggaaattattttgtgattaaataattaagtgccagctgtcctgaaccaaatatcttctcgatgttggtaatactgttgcatcttattgagttgacttttctgagtttttgctgtgtgtgtattactgtttattttccactaattttgccttacttccttagatcgtttttcctcagtatctttcttccctacttcgagttttgtagtctcttggaattctgtatgcacatctttatgttgttaacatggaaatgttttttttcccagctcctttcattcatgaagcttttactgagattccactatttccttgtcactgaaattagttgtggaaaacaaaaatcatcagtttatatttcataaagggagtcctcattcttatgggaaaaacagagattattgtactgtagaatgataaaagctatgataaggatggcctaggggagagtaaaagtccagaaatagaaggaatatttgtttatgaaacctccaggacatattgtatagcaagtgaaaatgataatctgttttgtaatacaaggaacagggaatttaagcctgagttctctcattagacaaatgaacttggtcaaatgggtcattttttctggacatgacatgaggtttcttttctttctttctttctttctttctttctttctttctttctttctttctctctctctctctctctctctctctctcttttctttctttctttctttctttctttccattctttttttttatttgagacagggtcttgctctgttgcccaggctagagtacagtgacacgatcgtggcctattgcagcattgaacccctgggttcaggtgatcctctgcccctgtctcccaagtagctgggactacaggcctgtgctaccatatctggctaattttttgtagagacagggtctcacttaggttgcccaggctgttaccaaattcctgagctcaagtgatcctcctgccttggcctcccaaagtcctgagattataggcatgagccactgcgttcggatgggcatcagatttctaatgtgtaaaacaaaaattttgaataagatcatagtttctcaaactggccttcataggatattaacaagcagtgtacgaatacagagctttgtgatccaaaacatttatgtattagttaaaattaaatagacttttttattattagatttcttagtttttaataggttgtagtaaatgataaatctttaagaaaggaatagaataggccgggcacggtggctcacacctgtaatcccagcactttgggagactgaggcgggatcacaaggtcaggagatcaagaccatcctggctaacatgatgaatccccgtctctactaaaaatacaaaaatttgctgggcgtggtggcaggcgcctgtagtcccagctactggggaggctgaggcaggagaatagcgtgaacccaggaggcgaagcttgcagtgagccgagatcgcgccactgcactccagcctggctctgtctcaaaaaaaaaaaaaagaaaagaaaggaatagaataaactttttcccacatttttttccatcatagaattccctcgatattacttaagaaatgtagtttgactgctagtagcagtctcaagaaatagtaagttaggcagtgtaaacatttagctcttaacttaaatctgtgatccattgtgagtttgtttctgtataagatgtcaagtcaggtcaacgttaatttttttttcataaggctgtccagtttgccaccaccatttgttgaaaagatttttcttccctcccattgagttaacttgttatctctgttaaaaatctgttggccatatatgcgaggatcaatatctgggctctgtattgtgttttattgattttatcttcacaccaataccataactgtcttgatttctatacctttaaagtaaatcttggtatcaggtagtgtaagtcttccaccttgttattctgtttcagaattgtttgaactattctacgttctttgcatatatatattgaaaactttaaaaccagtatgtcagtttctacgaagctgtgtaggattttgattaggattgcattgagtctgtagatcagttggagggggaacttaacagtgtggaggcttttgattcatgcatatgatatatctctatatttaagtatttactttccatatatatgtatatatatgtgtgtgtgtgtgtgtgtgtgtgtgtgtgtgtgtgtgtgtgtgtgtatatatatttttttttttttggcaaggctttgctctggcgcccaggctggagtgcagtgacatgatctctgttagtatttttagatagtttttagtgaacaagtcttgcacattttctgtttaatttattaactaaatgtttcataatttttgatgatgttataagtatttttaattgcattttttggattacaggctgccgccactgcacctgcctaatttgtatattttttttttagtagagacagggtttcaccttgttggccaggctggtctcgaactcctgacctgaagtgatctgcctgcctcggcttcccaaagtgctaggttcacagacgtgagctaccacacctggcggatctgtagttttttaaaaaaaaaaaaacgtttgcatgtactttcttaagaatttgttatgctaatcctggcttgaaagaattagttgagaagtattacttcttcaaatttattgacaagattgtgaataatattttcttctttttaattttttattagttacctattgttaactaggtaccagaaacttaaataacacatttattgtctcgtctatgagatgggggaaatatagtattattcgatatataggttaatataggttaaattaactgacacaatgcatggatattcttaacacagtgctggtacgtagtatgtactcaataaaacttagttgtgatgatcaaaatgacaccagaggtgcttattgacactttattttccagttatcaatatgtttcattttgctttagggtattctttagcaaatcttaatgcgacttctgcctgcctaacagtatttgttctgcttttggtgctcccatttgaagctgtgctggtgtattagcatcttctaaactattcatacaaaacccagcaagtttaacttgtaatttggcggactggtttgtacctcatttaaatttttactgtttattatcatcctgtcccctagactactagggagtccaatggtactaatcaaaccttggaagctataatgtggtacatgcatctcaggcccagacctcatgaaaaggttattcagtttattaatatattttcagataatgtctctctcttcttgtgacttcttgtgactgtaagctccttgaaggcaaaggcttttatttattcttgcatcctatcatctggcacaatgcctaatgtattataggcagtactacacatatatacatatgcattatcacacttccatatgcatattttaatttctttaatttcattaataactagattgacatgaaaagataggtaaaaaaataagatgagtgttgaaggagaaaatgggggctaaaaatcgagagcaggtaagacgagaagatgaagtatcaaaaagcacacctggcatttaggatatagattgatagtatgcattacaaatattagaactcaaagcagacaagaaatccatttcggttattgctgctgatgaaaaccatcgtatttgatcacatagataactcagtttatatcacaattagctttagtttccttaggaagggtataagaaaagaaaggtaatgctgtgaccttttgttatcaaagtaatgctggtcttctatatttgtaagtatctgaaaattttatattatgtgcaaatgtaattaactcattatattttcgtaagtatgtgaaaagtttgtattgggtgcaaatacagtaaagcagtatcagtttggactaaatgtctgaattgaagtgtaattttattttttaggaaataactgctttttacttttaattacatgtattagctgaaactattccaataaagtaatgccacttaaacgtgcttcacagtttacatacacacatcagaatagagtttttctctggtaatggatcagatagttatttctttgattgtgtactaggtgaagatgctgacttgtgttttcataccatgttatatgaagaatactatttctcacactagaatcatggccatggaaggagatgcttccactgagaagcattaaaaaatccatgagaattgctggcacttccacatctcatgctcactccaggatacaaaccatgctttttggtagagtagggatggagtggaacagtactttttctgctttcattttttataaattcacatagtttgattagatcaattgacgtaagatacgagtcagtatatctggacacacaaataaccacaaaatccctccgctgtgtgattttattcaattctagtagatgtttctcaaactggtgaatgagtagcccctggcggttgttcctcagccttgttctctaacgtggttagagaaggaaatgcctttacttactgattttttcagtgaaaggagactgacaaccatgcagaaataagtaaaatggtctttagttacaaaagtgctatggaaatgagagggtagtgtatttagaatttaattcctttgttctttgtagcaataaggactaacctgaagagatattttctttaaataaatctataaagtattaacatattaataggaagactcacagattctaaatctgtgattttggtatatttaaggagacttaaagatcattctaaaaacgctttctcaaattaaaacagcagctttcttgaaaaataatttagatgctctttcaaattgaaaaattacagaagttcaaaatgaggaagtattccacttccaagaaaaacctgattagttacttcagtaagctgctcattgaaaataaatgtctctactgacaggattatattttagttttaagaagctaatttatcatttaaaggttatctctaaaagttaggttttgtatatctaatgtactcacagttacacctacctctcataacttgatagtgaaacctttctgtttttcaaagggagttccagcatttcagctgctgagcactctgcaagagaaactgtatactgtacatcagaaagcaggggtactgtctgcctttgatgttaagtagaaatgaagacttccttcattgccggttctttgttggattattcacatggcacctgtgtcctttagccagataatcactgttgatttcagagatctaggaattgaggaaggggataataggtctgtctcttaacaagccgttttgcattcagttgctatttctgggaagcttcagtactgcagaacgaatcacagagtccctgaggaagattagtgccccctatcatgctgtttctcttgttgagcattcaattgatgttggatttagggccctgacccaaaagattttgatatctctgtgaataatttccttttttgcaattgtcagtgcattacagctaggccattcggatgccttttattagaatggagttacatagcctttcccaattaattataatgaatattaattcttaactataattgccaaatcattatcataaactttaacataagggtactcaactactggctctgacgctgtagaaatttgcctctaggttttttgaggcctctgtatgcattttccatgggaattatgttagcatcccagaagactactgtacctattcccaccttgggcaagagaaaagttctgcggtagataaaaatgtctgcagtagatgttcacttagcagcggaggtttttccatttcccattttgtttgtggcttcatgagagtcccccagtccaaacagtttactaaagctcttatgactgtctccactgttgtgagcaccatttgccaaactgggtagttaaattttgttttgttttgttttgttgttgcattttcctactttcattcctttattcttatgaattactgtttgaacagatttattcttcattttgtatggcttcagcctgtcattgagccattcagttcacaatagttctatcggggagcagttattactagaaaggcagcatttcatggtgggctctggacagacagcctggattcaaatccccatcctactatttactgttagactttgggtgatctgtgtaaattttctgtgcctcttgcctcatctgtggaatgggaataatagtaactagttcatagtgttgtaaagattaaatgaataaagcctttagcccaagttctggcaaatggtatcgccaaatgtatgctcatgctattattatttttattatagtagtagttattactttttagttggagcctcactctgtcacccatgttggagtgcagtggcgtgatctcagatcactacagcctctgcctcctgggttcaagcgattctcctacctcagcctcccaagtagctgggactacaggcgcatgccactacacccggctaatgttttttgtttgtttgtttgttgtttttgttttttgtatttttagtagagacagggtttcaccatgttggccaggctggtctcgaactcctgacctcaagtgatccaccagcctcagcctcctaaagtgctgagattataggcaaaagccactgcacccggcccatgctattatggttagtactgttacacaaaacctcaaattagggaggatgagtgaagattcggtaatatattcctggaaggaaccactgatctatcagctgtggcttatctactttcaccttcaaggaaatgaatctaggccagggatttagcacatatgtgagccagttattaaataaacattgtttcactattatacttttaattggaacttacccttaaagatgattggctttagtcatggggcaggaagagggagtgtaaataagtggctcatggtcaactgccctgactagtaacagaattcaaaagtactgtcttagtggttcctaccaagatatgcagtactattttaatcatgaactgtgtattattacggccatgggtcagattctaaaagtcagcagcagccagtcttgttgccatgactcttaacagtccacacaacactggctatcaagataggataccagtgacaaactaaaaatatatggtatatcttgcagattttaatctattggtgcctggagtaatgtatgcaactttatagaaacttaagatgaaccgaagaggctagcaaagattaactcatttaacaaatgtgtcttgaacattttttatggcaaaggactgcctttggacccaggccaaactatttcagataagaatatagctacactaacggttaagtgaactgataaggaaatgtaatcatgattgctttgctttttatcatttgggaagtgtgtcacaaattacatacaacttacaaggggattttggaagccacctttcataagtttggagctttcatgatgcagcaagagatatgagactttccccctaaatgataacatatttctattctagagaacagtttggcaatatctagtaaatttgaacacaagcataccttgcaaaccagtaatttcacatttagataattgaccccaagagaaaatttcatataaattcgtacaaggagacatattcctaaaatgtttataacaaccttatttgtaatagggagaaattggaggcaagctgaatgtcaatagggaattggataaattgtggtatgtttataaatagagtattctataggagtgacatgtatataccagtgctacacgttgtcagcatacatcagtcttatatattgaatgttaactgaataaagaaaaagagatactatttagaaacataaaaagtgatgctatatatcatttagataataatatgtaatgaaagtattaagtaatgtgtgaaaatgataaaaaacaaatttaggatagtgtttgcttctaatgggaattataattacataggggtttaaactatactggtaatgttctatttgttgagttgtgggcacatgactttttattatgtacattttaatatgtctggactagtttagaaacatttaaaaattgaaagaaaatgtgtcttgttgatgtttgcatttcagtggagataaaaagagatttttttcctgcttacttgatgcgatttttgtacattctctcgtttctacaatgggtatatgttattttaatcatgttaaaggaaaatctgagaaataatatatcttttagaaaaataaacgactgttttaggaatttttggaaaatataggcaaatgaaaaaaatactaacactttttataattaattttctagtcttctttctataaactttatttatttgtttttaatttttaaaaattttttgagatgagctctggctctgcttcccatgctggaatgcagtggcgtgatactggctcactgcagcccccaactcctgggctcaagggattcttctatcacagccttccaagtagctgggactataggtgtattccaccatatctggctgattttcttgtattttgtagcaccagagtctcgctatgttgccctggtcttgaacacctgggctgaagtgatcctcccacctcggcttcccaaagtattgggattacaggtgtgagcgactgcacccagctctataaattttatagaagttaagcattattgtatattcttttttcctcctatttttccggcctgttgttataaaataaacatttaatatatgggactggtattttaaagttactttaaaatatgttatcctctgaatgtaagaacatggttttgctcattggctgatgttctcttttcttgcaattagttgttgcttcttaagcatgggttttaataaaattatattgtaccttatgtttgatttattttaactgattttacaaatatcaggaaataaaaatatatacgagcagttatatgctcagtgataatactgttgatttatagtagtagaagataaaagctttaaattatgtaaaatgtgagattttcttgggagggggacagtaacattttaactgttaattttactggttgtatatagtatgtgataggcagatttatgaacacgacagtggaattatggttttacaatgtgagctctttaggatttgatgtagtgctagtgagtgctagtggtactacaaaaagaaataatagggctaatactgttttacaatgtaccgggtcctgtgacttacaggataatataaaccagttcttgccaaacttcattttgtttataaatctcctttaaatcttgttaagatgcagattctggattcactaggcctaaaactctgccggagcttctgcatttcaacaaactcccagaatttgccaataagtcagttttaaggaccacatttttagtactgaggatgtagattagtgcttctcaaactatctgcaaaagactagcttttaaaagatactatctagtatttcacaaaagaatacttcttggaaataaactaaagaatatatagaaggcaaagggagaaaattgtatattaattgtatattataaatgtatattaaatgtatattaaatgtatattatgaaattgtacattaatgtgaatgtaatctttcaataaaccttttacaggtataaagttagtacattaatttagaataaactgtttcctaaaaaatgtttagatatgtcacactatatagtacagtttttaaggacaggtaattttataaaaatacttgcccttgtgctaagcagcatctcatgtatccagcatattttttgaatattctatttctaaaagtttttgattctcctcttcctcctaggccagttcaagactcgctcttccttcttggattagagtaattctataaaactacttagcattcatgaataaaatgttacctgaagagattattcatcctctcaacaaaaacttaagcacttcattacacacaaaattctatgctagtctctttttggattatgaagaggaataaaaagttcttgccctgtagaaatgtatggacctggatgacagaatctatctccctgttaagaaattttattatatgttagtattgacctgttaaaggatatcagaatcttaaaatactattaagtagctgtttccgatgtagacctgattcattaactggggtagtgtttatttttcagtcattcattacattaacagattagtcacctactacatgcccgttagtgtgcttgtcccttgtgagagattagtgagtggtaactagagatataattcccgctctcacataacagactgttgtgatcaagtcaacccacttgactttttcatagttgtgtttaactgagagagacagtgacattcaaggatttgttttagaaagtatagcgttatttatctagacattaattttggcaatttatgatggggtaagtgaagaaatacagtaagaacacttttctctctttgaaactgcatttattcttacttttttaactttccattttattaatatttcactttgaagcataaacacttatttatatccaggcctcatccagaactttctgatggcttatgggttttggccgattcttctggcttttgcccacttagagggtgtaagatttcggtaattggtgggaaatcttgtagctctttgaataccagaaacccgtggatacttgttcaatccggttagataagctagtttcttaccacctttctttctgatagttaccctgaggtctatggagaaactgattggacatttataatatctaaaactcagcagcattttaaagatttagcagctaaaacctcctcccctccctttgtcatttgttcagcacctgctatgtatgtggcaggcatcattctgaggatgtcattgttgggggaaaaagaaaaaaaatagggtccctgtgctctcagaatttgtaagacataatctctaacttggatgatgatgataataataataataataataataataatataatgactagtgtttattatgtgcttactatgtgccaggaacttttccaagtgctacatatatttacttatttaatccttttgtaacaacctgtgaagtgaacgcattcttattaccatcatctacattttacagataaggaaactgagataagaaagtttaatatgccccatgccacatagcttgtatgtaccaaagatggaattacctgccagtctggctccaaaaatttcatgtttatccactacactatgctgtgcaattataacacaaatttaaattataaatttaatttaaatggataattaaataggcagttttaataagtaggagccgtgcaatgatggagtgctcactgctgtgggagcacagaataatctcacgcaatttggtcttgttagggtccagggaaagctttcctgagaaagtaatctttattcaaagagcctctttccctccctttaaaaaaaaaaaaaaaaaaaaggccattgaaaagaattgaaaaattttttaatagaattttaaaaacagtggtttcttttttttaaactgattttcatacaaagaaataacaacataggtttgtaaaactgtaagtgtattctgaactgggaaagatcctctggtgatgatactctataaattggatgagataaattttttaaatgagccgttttaaaaattagccaaaagaaaaaattcttgtatttttgaggtgagaaaccagataagagtactattatataaataatactaggtgtgttctctccctctgtctccctctgtctcttcccctctctctccctctgtctccctctgtctccctctctctccctctgtctccctctgtctccctctctctccctctccctctccctacccccctgctcaccttggatacaacaaaatatttgattgcccacattttgggaggccaaaatgggaggttcacttgagcccaggaattcaagactagcctggacaacataggagaccccatctcgacaaaaaataaaaatattggctggtcgtggtggtgtgtgcctgtagtcccagttactcaggaggctgaagtgggaggattgcttgagcccagcagattgaggctgcgttgagctgtgatcatgccactgcactccagcctgagcaacagagcaagaccctgtctcaaaaaaaaaaaaaaaatttatatatatatatatttgattatgtgctgtttagtttaaatatggaagctgctttgatcacttcaggtctgttgtcatactgtagcaggggttaacatttctaagttcctgcatcaggaaatgaacatagagaaaagtatgaaatctactttatagaccacattttataatatcaaagcttttatgaagtattatgcattcatagatggaattatttaagatttaccaaccaaattttagacagattttaagtatagaaattaatggtttttgtaatcttgccatgcatcaactgattttatcaattattaatatcttgagtgctttccatttttataagatgggaacagtgattgtttaggttgtatttggaaatattttggtgttcaatagcatattgtggctaaaaggctggtgtaatagataattctgatagtattgctctgtccttcataatgtatgtcatctcatgtattaaaaaatctcgtttatcttagttgctattaacagaattcaagatcttaattaggagtcctgggagccatgtttgaccccttttattagcatagtaactttctatcaatttgaaatatgcagcatgatcattgtatatttaatgatgtcactgatttacttcctttatattttaaaattgaaatagcattcatttactggtcccattggttgatccactcgggctccaacttaaccattgtttgcttggtttttgttcttttcttgtcactgcaaccactcccttaggccatttaccttcaacctatgttctccagcctgttggaagttactacattattttgctttgttctctgctattctgtcagccccgtgagtgctctggtttatgacattttccccttttgctctatgagcagccatgcttgttgcctaactctatgtggtatttcagaagaagtttaaactcctagtcaactaacctatttctttcattggggctatatttgacagctaagctaccttctacttttaaaactacatggatgattacatacatacataaaaatattttgctattctaattgctttagtttttttttttttttctttaaactgtggggtttctccctaatttattcttatctggaaatttctggtgttttaatatggtttcagtggggggtgcctggctgtcacctttctagacctttttactctgtgtttatgaaaaagatctttattccaagttgtgtaagttcttgctactagtagtgtagttgataagccagcagcatcagcatcacctatttgttagaaattcagaatcttaagttctacccccaagaccttatgcatcttaatctgcattttagcaagatctctactcgtttgataagaacattgaagtctacaaagcattgctgtaggtatcggtcaactagatgatacattgacgtgctaatagttgtacatttctacaactgattttaaacatatgacttgtgataatcgtatttaaatatttgtgaattatttcataactattcatcttgtttcaccaaaagttatactatgggtgggtattactactactgtgtgaaaggaatgacaggaataatcccaaacagtagctacccccagtccttgaagtgaagttttggtgtacagttgtatgcgatgtaaaactgtgacaaacattttgcaactctatttgtcccttctcccagcatcagtttgcacctgtagatgaagaactattattcctttcttgtctcttggacagtggcttttaaacaaagttccatttgctaaattgaacctctaaggtgttggggaaaatatctaattttcatccttaaatcagagaaattgtgccttactgatacttgatatgtggattaatagtatatgcatataatctcagtaaataggtattgaggattcatatccaactcttgcttgtatttgaggaaaaaagtctataggctcctattttctggtgcactgtgaaaatcccagtcattagcagtgggaacagcaaaaaagttaggttagcagggtaaaagacactacatgtaatctaatctataaagttaataaattgtgtgtagtcatttagcaacaccataaatacatttcaaacttagatatatttgtatagtggtgctttaggaaatagttttttttttttttttttaactgtagtgtttttactttttgttgttcaagaatgaagagaactgggaggatacaaaattgctctttcatttgcctttagcattcaaatgtgtagcgtgaacaatgtagctgttccgcaagcacattttaattggcatttttctacagtagtattgctgtaggatgacaaacaatatttaagtgagtatttttataggttttgatgccttcctttgactgtgtgcctaagaatggcagtgggaagggtggcagagagaacacccagatgtacgtgagatagtgatttgtcccttagtattcattttaagtagtaaaagcaaattctatgggccaggcatggtggctcaggcctgtaattccagcgctttgggaggccaaggctggagggtctcttgagcccacgagtttgagaccaacctgggcaacatagtgagaccccatctcttcaaaaaattttaaaaattgattgggtgtggtggtgcactactgtagttccagctactcctgggagcctgaggtgggaggatcacttgagcctgggaggttgaggctagtcagcagtgatcacgccactgcactccagcctgggcaacagagcgagggccctgtctccaaaacaaaaacaaaaacaaaaacaaaaaaatggtaagctctgtggagtgacgttagctaagagccatactattgtgtatatagggtctactaaatgtggctgtatcagacaggacttatggttatagttaccagagaacacttgtggtcataagttgtgaatggcacccagattcttcttgaatatctatcacatgtctatcagtaattctgaagtatgtaaaaatgaaacaaagatttatttgggagttagcactccagaagattagtgttaaaacagaacagcagaaggagttgtgacatgcatctataaacaattgtaatgatttgacagttatttagccctctattcctagccctttcattgaactgacagcatgcctgcaaagatagtgaggcctgtttcagccacattaatgtcctcttaaatggtagcctgcagtctggggaatgataaatgttcagtgattgatgatttttttagtccccggggattctgggtggtttcaggtttctgtgagccagggtagttttttctcttacttgggcttcgtatacgtttttccggtctttaccatgttggttttagattggcagagatatatatgacctgcagttttaattaatagagttcaaagccttgtttagaaacaatatgattttggaggtaatgctgtacttaaagagtgcgtaaaagtctgagaaccaggacaggtttcatcacgtagtaattttgtaacacttgtttttgtttgtaaactttatcttttttcccctttgctttaaaaaaatatgttttaaactataaggagaaatgtaataacagctactgtgaaaagtaacattagctttattgtttttaatggtgtttgtaatttcattcttaagaatttaaatcagctatgtttaataattgttttactttttacatggctcagtttctgtaggagtatatattgttctactacagtagtattaaaatgagtataaacagaccttttttgttgaatatttgccatttaggaaaggattcatttctagcatattgattgtgaattagttttagtattttaagtcacttgtaattgcctaacgctttatttttagggtctgggggcagggagtgaataggaggataaagataagcatttccctaatttattacaactgagaaatatattttcttaatttattttaaaaaatccattgtactttccctttggatgtaaagtaatcttagaggtaattttagtaatagtttacagaattcttatagctccccatcccatcagaagagctgatgatactttgaaaacattcgtgctcatggttagtgtttatttatagaaacccacttttctttacgatcaataaagaaaatgttttttgacttaaaatcttaaaaggaataaaagaagcacttctgctgttagcttttcaaataatgaacaagaaacttggtcagaaatgaccatgtgtaagtctgtatattaattaggtgagtgtcattatgctcaattagcgggactgccaaataatctctttaatactctgatctttttctccccctagggttttacagacagccctcattacagtgatcacttgaatgacagtcgattaggagcccatgaaggcttgtccccaacacctttcatgaactcaaatctgatgggtaagttggtaattctctgcaagtagtcttctcaaagcttctttggtcagagacattttttatccctttgtccaggagggacaggtaagtatctagaagaaagttcttgagtttctaggggcatctagggcttttcttgttcagcacagcttgaggatcaaatgtccagaaaatttggggtctactcttaaagcattattgttttggtgtcaaaaaaagaagtggcagtgttttgattgtcagttttggcaatgtctttgtgacctcaagcattacatgttttctggggcagagaagtattgttttaggggcatttgtgatgttactatttctcttaacagttgtattatgttgtaattaaaaatgtgacatagcagtgattttaggcagactttacttgcattggacaatatttctcctggcacaatttgattaaaacatagtatatttagatattgcagcattgttttaagcacttggcttcatactaggacttttttgaagttttggtttgaagaagtgaagttgcactttcaagaagggtatgcactaccatctaaacttgatttttatgtttaggcaaaacctttgtggttaatcatgctctgcaaaacacccctcctttcctttctccttctctgtctcaaatgaaagtttaaagttgttcagtctaaaattataaacccaagcttgtttttttcagtttgaataccatttttttttgtgtaaatattttacccttttgcaaaacctgattgaaaataatctgtatgttttatgattttttttcttgcttatgctggggctgaaaatattacaaaaacttttatctgttttaccagttataactgtttttaccagttatggcatcatataaatatggaaagtttgtgtaattgacattgatttcattacttactttatttcttaaggacatgacctatattgtgatcttagaatcgtccttttaagacacagccatactaatctgagtagattacccaaatcccaaatcctggtggtctgcaatttatttaaaatgatttgctttgcacagtctttgtttcccttattctctatagtgtcgaggagacagaatctgatagtctagtgtggattttgccgaaggcggttgacagtttgaagccagaagaaccattagagtatgacagaagagtgaaaaaactgacacaagcaataaaacttgtgtttaaaatcacaatttgtttcagcgtaaataaatgcacatagaaaatcatggtattatatgtattatcattccagataaaaaaatcagagttaggtttacaataaattatttggctagggaaaactttctaatttattttttaaattttcaattgagcttgccatcaaagtaaaatcgatataacactccaaattatttcctttcggagtacaacttttccccaagtaggatttaatttatattaagtgtagtagggcaagtaaaagtccgtgtttttgtaattttggattaaactaagctttcttaattgagaatataactctgaactgtgaaaaatcagaaattgctctttttgtatttatgttcttacctttattcttcactcatagagatgacttttaggcccaatggaatttcatcattagtacagctttgtaccaaggtgacgattaaaattttgtacgggacaagtgtggaaattaaatgaatcctaagaggtatgcatgtcagtcagttgctctgagcagatgttgactaacaatatatctgtaattcactttgaggtaacattttctcagttggagcaattacgagcatgtgcttgttggtttctttagttttcagataattattagaatacgttcaatagtcatccataccctatgtataaaatcaacatctaaaaaaagtcttgaagtaaataaatatttgtaagtagattgatctcttaattcaaatgaaaaaaatctgcattcatgtgaactacgttgtttaggtactactttgtatcagatgcagatatacaaaccatacattttcttttcttatttttgagacagggtctcactttgtcacccaagctagagtgcggtcgcatgatgatgactcactacagccttgaactcctgagctcaagctgtcctccttccttagcacaacaccagctaattttttaatttttagttttgtagagatgaggtctcactatgttgaccagactggttttgagctcctggcctcaagtgatccttctgccccagcctcccaaaatgttgcaattataggcatgagccaccatgtctggcccagaccatacgttttatttgtgagttttaactacctaatgtaaaaatgtttacttatacataaaagaaggagacagaaccctgaaatgattaagtagataggttcaaaagaaattcactggtcattggcaatatctgatatacttcacttccttacctttatttttagtaaaaatgatcaaatgaggtaccttagtgtaaacaatctgcacgacaatagcttgcttttggaaatgaatgcctcttaaatcacaatgcagttctatacagcaacaggcaattcaacttgatatgagctgaagtaattgaactgacacccaaacgtgggtttatagcaatatatagttacagtggatagactgacttttctggccgtttgttaatttaagggagtttctggctgaaaaacctaaattattaaagctctgctgagatgtgtatggtagtatttgaagcatttggaactgttgataaccaatcatcgcaacaggtaacagttgagagtggtgctgtgcatgatgaatgttcagaaacagctaaaactaataggaaagcagtaacatttcctgttgctgtcaacatataaaaacaccattaagtgggggagggattgtacatctagggaatgttgttattttgagtattatgttcagccataagcacatttgcctgaagaaacagtggattataaagcaccactgtcttctgtgatagagctttcaaatactttaatgattttgtacattgcaaaaatgagaaattttgtctaacaagggttgataatgattcagtaatgaacaatttgcaacagaaagtgtgtttatatattcatgtatatattttgaagtgttttatgctgaatcagttaatgtttcttttatgaattgcagaaatctcctgtggatatgtcaatatgggaaagagggcttttcttatgtttcgagtgaaataagtacatctttttggcacatcactaggtaattagcatcaagcagttctgtactctgaaatattaaaactgtatgaaaagctttgaccgtagcagtgaatcccatggtcattcaaggctactatcaatcaccaagtagccttgtctgtctcaagcttcttccagctctggtccatttctccacccttgatcctctcattaatttcagtaatacttgttttcctttaccttttgataattagtcatatttttgatgatgggaggatcagtttactggttgaacttagaaacaaattattctcacagaattgcctggcttccatccccaagtgattgtgtaataaactactattatctttttaatccctccatgtttataagctttacttattttaggatgtatgtatgtgtatatgtgataaatgggagacttaaggtgtaaaattatcttcggttttgcttgttttttgagacccttaattgtgttcctttctgagacactattttgcctctagagatggtttgttaacaatttttcttttaaagagtgaatgtaatatgtggtggtacagggggaaattgcagggctgagagttaggaggtgtggattttaatccagattctgaaaatacctttacctttctgatagggtaatgctgggaattctcagaggtcttgtacagctctagaattttacaattccataatctcataaatttaataacttttattcaaccctgaaaaaggccacaactagaattataactgctattttgcaaatgattaaaactaaggcagaggacaattaagtgtttctttctgaggtcacaaagccagtaaatgttaaaactaaatgtagaactcatatctcctgactcttagttgaatgctgtttccattaggccacactgtttaggtgtttaagatacctgttgtttcttcatagctcagattttttactagctcagcattttcttaaaccatgattatggagacactgatcttgatggatgaccgtggaaaaacggttccacagtgaaataactttggacaccattgcgtatcagttgttccctcttagaaattcagattgtactttggaatgttaaagactctgaaaaaagaaaaagctgatttaacttttttagcctacgacaccccaaaatcacattaggcacagaaggctttttgtaaagagcgtcattagcttctgagaaactagttttctgtaggacactgggaaatgtttctggttatttaaaggaaaaaaaaaagatcatgaaagttctctgaaaagtaaaatagcatcatgttaatagaattgctatacagtcatcccttagtatctgtgagggattgggtcccctgatgctcaagtcccttatatatatatataaaatggtatagtttttgcatataacccacacatatcctcctgtatactttaaatcatctataacttacatataatacctaacacaatgtaattgctgtgtaaatagttcttatgttggattgtttagggcataatgacaaggaaaaaaatgtctgtatacattcggcacagatgcaaccatccatttttttcccctaaatattttcaaattgtggttgattgatttcacagatgtggaacccacagatagagggcagactgtatatattgttgtaacttattttaggcatgttaactcatttaacaggttgggtctaattgctcaagtatattactgtcaaacctctgcttataagcatttgacttataagcagaccaagtgtcttcccattgctgctggaatctctttgcttaactccactttctgtatctcagaacttaaagggcacctctggtaaagcttctgtgttttatttccatttcattgtagattgcataggtttcagtggatttgtctgggaatttaagcccaagtacactttttttctgtatatttggtacctcaaataaccaaatttcaaagaaaattcttctgtaaacttgatattgcttgcaatataacctatgaaaaattctgaaatctcctagagttacaaaatatgtagaatcaccattttcagactatcaaagggtaatacaaccctgccctcaaaagttaactcttttggcttagtggggtggctcacattcccagcactttgggaggtaggaggattgcttgagcccaggagtttaagaccagcctgagcaatatggtgaaaccctgtctctacaaaaaataaaaaaaattagccaggcatggtggcacatgcctatggtcccacctacctgggaggctgagagggaggattccttgagctggggaggtggagattgcagtgagccagatcacttcactgtattccagcctgggcaacagatccaaccctgtcttaaaaaaaataataaaaaataaaaaaagatatgtagtttgatatacttgaaatttcttcactagatgagatactgaaaatgattataaagtgtcgaagggaaatagtatctgatttgacagtgtttcataaggatgaggccttttactttttccagtgttttaataaccctaaatttcatgaaagaatatgattgtatattcattgatctacattctctgacctttggctgtgctgacaaacacaaaatgttggcaccaagagaaacttgagagaaaggagcctagatacagttgaaggcactaaagccaagaaaaatgaaattacttgttagtttgaaacatggccctggccaggcacaatggctcacccctgtaatcccagcactttgagaggctgaggcaggtggatcacctgagttcaggagttcgagaccagcctgaccaacatggtgaaaccccatctctactaaaaatacaaaaatacaaaaaaaaaaaaaaaaaaaaaaaaaaccagtcaggcatgatggcacatgcttgtaatcccagctgtgtgggaggctgaggcaggagaattgcttgaacgcaggagacagaggttgcagtgagcccagattgcgccactgcactccagcctggatgacagagcaagactccatctcaaaaaaacaaaacaaacaaacaaaaaaacagaaaaagaaacatggcattgaccctcttgattctgactagctcacagtccctttccactacgttgcttttttcctctttttaacttcttgtgttcaaccatttgtttcatctgctgcctttttctacattatagctctgctgtcttgttctttctttcactattgctcaactctcattaaccagtctgagttgttgagtaccttcctccatcttttttatgtattcattcctccatttttttctgccctttaccatgccctttttctgccttttacagaggaaagtactgtatggtagaatattaaagtgaataatattcagtctatctttatagactattattttagtgtgatagagggataagaatttcaacaattaatatacgtggcagaatgtcagtgatacgaataaattcttacagacattcagaagagattacattcaggcacaaccagaggtgatcaggaaaagttttattgtgggtcacatttattccagtcagcactctttttgttataagtgacagaacctaacttaaaccgggtgaaacaaaaagtggtgtttattaacccatttatctaagaaggctaggaatagattgatttggagcatgggggacctaggggtttaaacaatatcatcagccctccctctttcaccttgcaaatgtttcgttgaaagaataagaactggagaggcaaattgggccaaggagagtggatgtgagaagtgggaaaatttaggagtacagtgttctggtctctccttctctagctccctcactccagtatttccagattgctctaaattgttcttcatggttgctatattgtaaggtaccttattccttagtggtatggaatgtttttaatcagtggacatgtgcatttaatttataacatcctgttcctggcagtatcgtctttttccatgcccctgccctgcctctacagcctaaaaagcagttctctttctatggttagaatgaattttgatagccattctctgaagctgtttctgtgagccagagatgacctgaaggcttcttttctacccagtctgagagagaccgaagtaatactaacgccttagtttgaaagaggttccacactttccagagtactcctgtatggactcagatccctcttatctatgggtaatccgtcctagaatgaattacttgaaagagtaaccaggatttcagaaaatatagggaaaaaatatatttcatttgaattttaaaaaaatatttcaaaaattaaaattaaaataagaatataatattaaaaagtgaactatatattattcactaggtcttagagtaaacaaagaattagttgttgatttttttagcgtattcttctcagaaaatttatatggtaatactatatatcctgtatttcacatttgaatcttgttgatttagcctactatttctaactcaggtcgtaatccattagtgactttatatttgattaaatggctctttaacacctttttcaggacctcatgaagtcttcagtcttttgcatggtattcaacttatagtagatttgttttgtttatatattatgggatattcaacagaagattgatcaaagcaatcaactgtggcttgagacaaccgtactatctgtagaggatatttcagagtttttttttttttaagttatctggtctaatggattttttggtgagctcacaacattggcttaactatgcatccttgcaaactctagggacttaaatcaagtggaccacctttacttttacttgtttatccagtgcatttcctcattgtcacttgggtgtgcattgtctatgatcagtagttatctttatggatccttattgttttatagtgggccagttgcatagatctgataaatggttcttctttgaatcttcccattgtttgtgtctagttctaaccaagtgaacatgaactcctaaccagagatgttctgagttctgcctgtagggaggtggatgacaggggccgtggctacttggttgctagagaacaagagaaagattgcttttaaggagcttttgtagctttacagttctgctatatgcgtagaatttcagaagcacaccatagcacgcagttgagaatttgggacactgttttgatttaagaaaagtcctagagcagcattaacagatcttgcctcctatgtggtaacatttcggattcacttcctctttttttttttttttttttagtagagatgaggtcttgctgtgttggccagattggtcttgaactcctaggtttaagtgatcttcctgtcttggtcttccaaagtgctgggattatagacatgagccactttatctagcccagactaacttcttatagtaaagatgctgccttcatcatttaataaaggctttcagaatgttttatttaaaataaatggtttcatattaaaattctcatagatgtttgaactggataaataatatgttataaagaatagaagtagggggaggtattcctggtacttactccccataccctgaaaactctagggcctctttcaaagtgaagaattagcagtagcttgattagtggtcatggtatttatgtaagttttaattagccatcaaaataattttttaaaaaaatttgaaagcatatactgaattgctttggtttaaattgtacaagtattactattgtctgaaggtttccattacattctggtctttagttatataggtttttttactacattgctgtagttgaataagcctcacattttatgtgaggccccataaaacaattgattattttgagtgtcaattcaccatttttgtaatctccttatttccacatctcagcttctttttcttcttggaaaattcagcctttgcctttcataattcatggtttttgtgacttccagtttggtatttgttgtttttatttgtgattttagattttagggaggctttttttggtggtggtggtttttgttttttgttttgttttgttttttgagacagaatcttgctctgttgcccagactggagtgcagtaacacatctatggcttactgcagccccaacttcccaggctccagtgatcctcccactcagcctcccaagtagctaggactacaggtgtgtgccaccacacccaactaatttttaaaaaattattctttgtagagacacagtcttgttgcgctgcccaggctggtccgaactcttaggttcaagcgatcctccaggcttggcctctcaaagtgctacgattacaagcgtgagccaccatgcctggcccctgattttaggtttctgtgaacactagaacttgccattctgcctgtatttcaggactttctgatacgtacgcatgtgcacgcgtgcgtgcacacacacacgtgcatatgcacccacacacatatatatatggttctgagtttttaaatctttatcttgaaaaatgtttctttgggtatttccatatacatgatatgttttggtggttccacagtcattcttgtgttacgtatttgttttttagtttgagtatacctctggaggattatcacactttcaaagttccatgaaatttctagggagtgacaattaaatgggagtacattactagtccacttcacagcaaattaaatcgattagttaatgtatagttaattgtaaattttattagtttctcttacatacttttccacacttgtccctggtattagggattagcaaactacacacaaagagccagatagtaaatagtctaaggtctgtggtccagcataccaatatcaatgataatcgtataggtacttatatagctacttaaacatgtaggtagttatatgtttatgaagtaggccataaacatataattcatggcttatcaactaagccataaacatataactacttacatggttaaatagctatataagtacttatatatcattgatttggggctataaaaataacagttggtggcctggatttgttccataggctacatttgccagtcttgctctagataatttaacaaaaatacttgaaatagcagtaactctgccaatttgttgaagaattaataagttacatatggccgggcgtggtggctcacacctgtaatcccagcactttgggaggctgtggcaggtggattacctgaggtcaggagttcaagaccagtttggccaacatggcaaagccccgtctctactaaaaataccaaaattagctgggcgtcgtgacgcacacctgtaattccagctactagggaggctgagacagaagaatcacttgaacccaggaggcagaggttgcagtgagccaagatcgcatgactgcactccagcttgggtaacagagcacgactctgtctttaaaaaaaaaaaaaaaagttatgtatgtgaaattttatggaaagtaccaggttttttcttttttatttaaaaaacaaattcagacgtgatggttggtggttgtagtggtgaattatttctaaagtttctggagctatactgcctctatacagaatggtaagttattagttaggtgagttgtttttctgttgttttgttttcaaatatgggcaaatttctaggcaaatgtcagattttctctctctgaaatcctgtgtttcccttagttttctataatcagaaatctttcagaaaaaacctgcttctcaagatagcaatataagattgttagctttagtgtatcgaactgctatattgggagaggaaaaggtgaaaattaggctgcttaatagaggtgtggcagttgggcagtcgcgtctctattgagcagcctaatgcagagagaagccttcaaagaacagctgcaaagagtctgtcgagggaatctataatgagaggatagtgtgagaattgcacagtaataaaaaaagtatactgttgctctagtgaaaatcggtactgcccaacatatgagaatctccccaaagggtatgtacaataaaaatacagcattttctaggctgtgtataaataatttttgtaagataaatgtaaattgtggattttgatgcagtttataaagtatgtaattttaaaattccatgtacagtgattaatggttagtatttgaagaattttctgagtattatatgctattcattttcaacttaaggctgtcttctgtcttaaggatttaattgggaccctgcctctacaaaacattttttgaaacattagccagatgcagtggcacctgctgtagtcccagctactttccacatgtacatttggaaaagttaaacgcaaattgtataaagaaaacagtcccaaacgcacttatgaagatgaattttcatacccaataaaagaagacattgtatgttagctctaccacaatggaatttaacccaaggaagtaattgaaaatacacgtaaagatgtgtatgcaagaatgtttgccccacacagtattttataaagaaaaattaacatcacccaatatgggactaattaagttataatatggtcatatgatggataacattgcactcattaaaacttacctttcagactgggagaggtggatcacttgaggtcaggagttcgagaccagcctggctaacatggtaaaacctggtctctactaaaaatacaaaaaaaattagctgggcgtggtggtagaagcctgtaatcccagctactcaggaggctgaggtgggagaattgcttgaacccgggaggtggaggttgcagtgaaccaaaatcacgccactgcattccagcctgggttacagagcaagactctgtctcaaaaacaaacaaacaaaaaaacacttcaaaatagtattttgtgataggattttctacagtatttcatagtggaaaggcagagtaatgtattattgcagtatgtgtagattataaaatctaaagaatatcaaaaagttaacattggtctgattggaagttagtatcaggagagacaccgtatatgtgaaaatatactatattttcacaatgagcatgtatttatacagaaaaaaatacttaaataagactatctcataacataattggaagatagaggaagggaaaaaatgtttagccacaaaatccaaaaatattattggcagacttttcttgggaggcttaataagatagttgtagcaatatactaagcacgttgattcttcagcaggattccctgtgtggagccacaagaataaattttttttttcttttttttttttttttttttttttgagatggagtctttttctgttgcccaggctggagtgcagtggagcgatctcggctcaccacgacctccacctcccaggctcaagcgattctcctgcctcagcctccggagtagctgggactacaggcgcgcacacccagctaatttttctacttttagaagagatggagttttgtcacgttggccaggctggtctcagactcctgacctcaggtgatctgatggcattggcttgccaaagtgctgggattacaggcatgacccactgtgcctggccataaatctttattttgtttaacttttacttggtctgagtgatctccttgttctcctttgagcaggatttaggcattcttcactgtccctctccttttctcatctatcttgctggtctttggtggtgttttttttttttttttttttttttgtcctgtgaggtggagtccactttgtcacacaggctggagtgcaatggtttgatttctgctcactgcaacccctgcctcccgggttcaagcaattctcctgcctcagcctcccaagtagctgggattacaggtgcccaccactacacccagctaatttttgtacttttagtagagatggcgtttcaccatgttggccaggctggctttgaactcctgacctctaatgatcctcccaccctggcctcccaaagtgctgggattacaggcctgagctactgtgcccgaccaatcttgctggtctttatcttcctaatgtgtatatgctgtttagctttcaaattctaacacaggttcttccttttatatgaataaccttaatagagaatgccttgtatcgccatctcttaatgttcctataaacttgattttccagttaaattgcagctccctggtgagggaacatgtctttaaacctttgtgtgtgcctcattgtacctgcataattatgtaaagttctttttgtggtggtggtggtgtttttttagacggagtctcattgtgtcacctaggctagactgcagtggtgtgcatgatttttgctcactgcaatctcactcccaggttcaagcgattctcctgcctcagcctcccgaatagctaggattataggtgtgcatcccacacccagctaatttttgtatttttagtagatacaggggttcaccatgttggccaggctggcctcgaactcctgacctcaagtggtctgcctgcctcagccttccaaagtgctgggattacaggcctgagctaccacgcccaaccatgaaaagtttttaatgagaaacgctggtttggtctttatttatgctcttgaacaagtcacttagagtcttatttttctcacttgcaaaatggggacatcagtgcaagtttacaggactgttggattgaacattgtggccacctcataaactgtaaagtgttccataaatatgagttgttatgttcgttataaggggtatttaaaaagtggttgattactgtcagcatagggataaaaagcagatcacatgggagacagtaacagctcctgtctaggaccaaagcagccagaaattagagaaaaggttgagtaaataattactccacatctatacatggcatattacacagccttcagagtcatatccttaggtgctgatagaaagatctctgagatacattaagtgaaaaaagctaagtgcagagaagcttgttctaatttgtgttagaaatgatacatatctaaatgcaatgtggtatcttggattggatcttggaacagaaaaattacataggtagaaaaaatagtgaaattctaataaagtcttgagtttagttgatagtaatgctctaatgttaatttcttagttttgacaaaagtagcgtggttacgtaagatggtaggggaaactggatgaaaagtacatgggaattttctgtactaactgacgcttttctataaatgtaaaattattccaaaataaaaagtttgtttaaaaaatagtaggcacttttgcgtttggctagagtatctctgaaagaatatacaagaaattgccaacaattattgccttctgggaagagaactcccggcaggcagaagaggaaaagaaacttcactgcatacgcttttgtattttgtaccttgtgcctgttattgccatgtgcatgtaaattgctcaaggtaatgaaaaagacaggccacagaatgggatataaaaatatttggaaaagacatgtctcataaaggactactgttcaaaatatataaagaacttctaaaatgtaacaaatagaaaacttgcactgggttaagaaatgggcaaaagacctgaacagacacctcacccaggaagataataataagcctatgaagaaatgctcaaaattgtatgtaatgtaattaaggaattgtaaatttaaatgacagtgagatatccctacacatgtattaaaacaaccaaaatccaaaacactgacaacaccaagtgctggtaacaatacggagcaacaggaattcttgttcgttgctggtgggactgcaaaatggtatagtcactttggaagacagtttgacagattcttacaaaacaaaacatgctcttaccatgcagtccaacatttgtgttccatgaagtctacacaatgaagttgaaaattaatccacacagtaatatgcacatagaagtttatagcagctttgttcataattgccaaacctggaaaccaccaagatgtccttcagtaggtgaatggataaatcatggtacattcagagagtgaaatattattcagtgctaaaaagaaatgagctatcaagccatgaagagagatggaggaaccgtaagtgcagattactatgtgtaagtgcagattactgtgtgaaacaagccaatctgaaagactatatattgtgtaatttcaactatatgacattctggaaaaggcaaaacaatggagacagtaaaaaagatcagtggttgctaggacttaagggagaaggagagatgaataggaattttagggcagtgaaactactctgtataaaactttagtggtagatatatgtcattatatgttttttcaaaccaatagaatatacaacaccaagagtaaaccctaatgtaaactatgaacttggggggataatgatgtgtcaatataggttcattggccaggcatggtggctcacacctgtaatcccagcacattcagaggccagggcaggaggatcacttgagctcagagttcaagaccagcctgggtaacctaaggagaccttgtctctacaaaataattaataataataataataaaattttaagaaatgagctgggttggtggtgcatgcctgttgtcctagctactccagaggctgaagttggagaatcgcttaagcccaagaattgaagaccgcagtgagcgatgattatgccattgcactcgtgcctggtgacagagtgaggccctgtctcaaaaataaataaataaaatacatacaaacatgcattctgaagatccatgaatttctaagtcaagaatatttttaaacttttatttttaggaaactacaattctaatgagtgatattagcaagtgagaagaactttttggtcaacatttagtcctttcccttgagtgcactgcactcttgtacctttgggcagtaggaaatgggaagcatcaaagaccatcaacaacttgagaatattcaaaaatcaagataatctgtatttcagaattaagtacttacataaaacatcttagtaagaagacatatagatgtgtggggtgagggaaaggcagtacaggagaaaaatattggagcatctcagagttaattctttggtgataaaattttacctagggctgatccctatcacctttcttctccccgtacccccaaccctagaggcaagatagaaagacacaaaaacaattaatatctgggtctgtcctcaagtttactgggtgagaagtggggtttgagggttaggttttgactgtcttttataatgtcaatcaaatctgaagagtccctttttctcccctaaaatgatgattctacttaggaaactcttacacaatttcagtttttcactagccgaaagaaactggctctacaggtagagtttgagaatgtgggtgaggttgttctggtggtccccagggttgggtgttaggcaaacaattccttagagagagatctggcttggaggctcttggtgtgggggtgagggacattgttggggggtaggagtgggttcttggaaatggagttgagaaaaatgtcagtgagctaattcataacttccccttgagtttttaaagattctacttaatttgtcaaaattgtcctcaacttgtttaaaagttctgttttttaaaaagtgtacaaagagccaataacaaatgaaaatatactttcctctgtgttgtcaaaaattttattgtctgcaaaacaaaaactataattgtgactcttttaaaattataataaactatggtgaattataaatttaaggttttcagaaatatttttcaaatgattagtgttagtgtggatgagtccttgggacaggtgtttttttgtttgtttgttttcttgtatatgtgaaatctgaagtaaaaataaaccacctcttgcttaaaaagaggtttaggatgaagtggctaaatctcaaatttccctttttgcttcagtgtgtcagttaatctggctgtaggatatatttatctactgtgaagcccactgatgcatgcaaagctaagcagagtacaattttccccagtgggtcttctttctctgggcatttgtagctatgcctcagtgtgtggagtctgctggggaacgctaaaagggctaagatgtcagctattgtaaaggtactgagatcctgttttatgaagggaatgagacatccggtctttaaaaaaaatgcatatttcttatttcccataaggcagttagaagtctgcacaataatgataatacttaatattgtaaataggatatcaatttatgtggcatttaaagaattttgaaattcattgtattttgtttatcctttttctatgagtattcgaatttctattctcgtcttaatatcagagattttaatttgttcttatagttagttaacttaaacctgtggcctaggttagccattaactgaattagttcagattatttatcttaacctattgttgcgtatagtattttaggtttttgttgagatggatactattgtatatttaaaaatgcatagaacttgtcaaagatagcttaatttgcctttctacattcataaaaatgttaaaagttaagggatttttaaaatgtcattagatattcttatctgaatcatttatatattaccataaatcacagttgtattaagtcagccatgaagatttcctccttaatgcaaatgaacgcataaggtatctagaaagcgttaatttgtgagggaacaaattaaagcggttagaattgctgtggagctgtatatgatagatgaaatattttaattgaagacacaaatagttctaatatttctaatgagaaagtgtgtagatcatttaatgtcgtaggagaccaaagtagaaatttggaaaaagtaaaaatgactcctaaattacccagcaagttgtaaagatacacctttctcagcatgcattctcatgatagcataacaatgtataatatatctgattactgtcataattgactaccttgaaagataatggttctaagggtcaataaaatacacaataagaaagatttaattaatgtgatcaaggtaggctaaaaataatatttgttcatctgagtattaagattttttagttttaggagttctattttaaatataccatagttgggggaaaaatgatgcttttgccttgaaagcactagcagaatagattagtgtcacagatagtgtgaaactgtgacactgaatctttttggcttgtgttaataggttctgacctaatgtgtatcacattttcatttttaatacagaatctaaacaaatgctttgccagttgagaaactggcgtcatcgttccatggtgctcattaattattttctctgactggcttttatgaatttggttgaaagttagcttttaattggagaagctgagattttttgtgtacaggaagaaaataatgcaagagtagtaatgaaggctgctgctttctgtctagttccataaaaccctttaatttaggaagttcagtctatctttacaggttgcttgggctggccctagatagaatggatacattgggtgttgaaaactagaaacggacttagttcatctcactatataaatgaggaaactgaaagtaagcccctgtgtttggttagaatgccaactgatgttaaaaagattgaaacactctagaagctttaccttcagattattgccaacattaattattatgcaaaaaggggggaaaatttgatatggtaataggagattaaaatggcagagtgtggtttcctgggctaaaatgggtcagtggacagaaatgtagaattccagttaatgaggaaccatatttacattctgtctcagatgcattgtgcctggtgttagtcccatagattggactttaaatggaatcatctttttaacgtcctctcttttttggcctgctgtgatcatactctgttctagcttttttcttgttttaaaaatggagtttgtgacaactagctagcgctgaatggacttctggttggcttcttggtggaaggaatgtgttatttcaccctggacggagtcatggagtgtccagatcccagtgagtttcaagccaaactcttatgaaaacatagtgcctacaacttttgctagatgttcattgtgttcttaaaagaaaaatttcgggatcactgtgggtagggacaattccttttctctctaagacctaagcaagagagatcatttagactgaggtccttggtgtgttcttgttcagggaagatgacacaaaggggaatagaagtaatcagtaggccttgcaacccaatttgaaattcacccatgacaaccatcagccacaggaggcccaactcccatctcctctcttagtttgcctgtgtggtgcagaggaataggtaggtttggtttgtttatctttttttttttttttttttttttaagatagggtctcactctgtctcccaggctacagtgtagtggctcagtctcagctcactgcaacctctgcctaccgggctcaagtgatccttcgggctcagccccaccaagtagctgggactacaggcacgagccaccatgcccaactaatttttgtattttttgtggagacaggattttaccatgttgttcaagctggtctcaaactccagagctcaagcagtccactagcctcagcctttcggagtgctaggattacaggcattagccaccgcacctggctggcttgtttataaacagtttgtaagtggaagaggagaaagtgcagagttatccaaaagtgccatatgaacaagatgctaagccccctctccacttcttttagattaccaaagaaatctaacttcatagtgatcacaggaatatttctggagtgtagtttatattttccatgtgatttagaaggaaaggaaatcctctgcccctcatccgtcttaagaaggtgggaatgagaattgtactcaaaactttttagtccagaaacatgagcctgctgacagctgagggctctagctctctagatttgggtagaaaggcctgggggtgggaatatcctccaggcgggaatagccctgtgacctgatctcacttgaattttcaggtgatctgactttccagtgatctaagactgtagtgcaaagaagccaagtctcaggcagttttttcagggacaggccttgggttagctctgcctgaaggtagatgactactttggcagataatgtggaggaaggaacactactctttggaatgccctcagctgtctaactgtgaccgattgtgcctggcccagctgcaacttgatctcaacaaatgttcaaggagaggagctgtgatggggccacttagattgctgtatagcaatctaaggagtatagcagttgaggttccatccttccagcaaggtgtagatggcctggattttttgtggaaaaacagtggacaggcagttcatttttgtgaaattgatttggtatagcacaaattctaataatttttcctgtaagagttttactatagtatctcttattttattgagtaccttttatgtgctaaacactgtgcttaagagtgtgggaaatatcaagatgaaaaagacattaccttcaaaagaattactaaagactcagactttgtacttaataagcttatgatgagtataaaaatagaatactgtctagacattacattccatattaagctatagtaatatagagcattttatttgagtaggaaaaaaaataaaatccaaactcatttaactaaaacatgattttcagtttgaatactttaagtttcaattaagaattctgctttttcatggtaagaagttatcgtggatctcctgcacatcattgttctgtgtgtcctacttctaggataaagcctctaggctccttagtatggcacttgaagatcttcatttttctggctcaagctttgtttttttctcatcttcatctctaccaagtatcccacactctggccatatccccgtgactccctatttctagagctaatattcactttcacaagtttttgcctttcctagatgacactgaatttcttcttatccgtcaaggattagcttatgcttgacatctgtagcttcggaaatagacattcactgcttcttttgtatttccttaatgatctgtgcagctcgctgagcagcataccttagtaccatttatcatagacatttgtgtacacctctctctttttctgctgaattataaattccttgagggcaggtctccttgttatttatatttctatctgtatcttctacaatatgcctgaaatatagcaacattcagtaaattagcatttcttgactggcaatcccttacctttcttttgcttcttttttttctttttctttttcttttaatgctcatttcctaacatcccccttacctttcaagaaaggagtactgtcattgtctgctggaagatacagaactcctgttgaaaagtaaatttaggctgggctcagtcgcttaacacctgtaattccagcactttgggaggacaaatcaggagtattgtttgagaccaggagttcaagaccagcttggacaaaataacaagagctcgtctctacttaaaaaaaaaaaaaaaaaaaaaattcagctaggcgggtcgtggtggcatgcacctgtagtcccagctacttaggaatctgagacaggaggatagcttgagcccaggaggtagaggctggagtaagccatgatgatgcccctgtagttcagcctgggtgacagagtgagaccctgtctcaaaaagaagaaaaaaaatagtaaatttagagatgaaacctggctttggccccagtcttgaaataagagtcttagatcttctcaataggggtggaggactttagtgagtggcttcaattttgagaaccatatataagcctaacaactaattttttgtgatccctttttgaaaacttgtttatctcactaatatgtgatttattactctttgaaataggagcatattacatgttctgtttattactctatcaggagcttgttacttggggaagtggttgtagttggcagtcatcccaaggtactttcagccagtagaagaaactataggcatttaacctactgtaattgtttgttgagacaggatcctgttctgttgtgcaggctggagtgcagtggcatgatcgtggcttactgcagccttggcctcctgcgctcaaatgatcctaccacctcagccccccaagtagtcgggagtacaggtgcacaccaccacacctagctaatttttttatttttatttttttgtggagatggggtctcagtttgttgcccatgctggtcttgagctcctggaattaagcattccttccacttgggcctctgaaagtgctgggattacaggtgtgagccaccatgccccacgtataatgtttttataaacagttaagattttaagtggaggtagtagcgggacaggtagggtggaaagggttagccattgtaagcatttcttagggtacatgaattcctctcaattgtttctaatttcacaaaaatctcaatgtttttatttccaaatagaacaacattcttggtttcacaatatagttggttgagttttaagttgttgtatatctttggcatctagcataatgctttgcctgaaggaggcattaagaaatatatattgaatacgtgaatgaatgaaagctatttcttaccaaactcaggactaaaatgaggatttttttttttttggtaatgcaacaaggaaggaaaatagaaaacagtaagcatgtttattttgctctctgtttatgttgcatgatagcagttttaaacaattctcaaacaattaaatgtctgattgagctttggtttaggctgacagtactttgaacttttagatttgttctctttctgtagttttggaaaataaatattcttttgggttctgtttacctcataggatagataatggttatccaccctttaactggaagaattaaagatcaaaggttcaaagttctattcaaaaattatagtttagttcctcttgttgcagtaactttaatgtacttcattcatttatttatggagtgagctacataaactaataaacaaaacataagtgtattttagtcctgatgttagcttctgattatgaagaaaaacaggtaatttctatgatttcaacatcaaaatatacattctagtaatttttgatgaaattggcagtgacattagtggcattagcatcttacaaacaactattattacctgcatactgtcatggaagctattttgaaaatacttaggacctggtgaagatgtgaattatattggaagaatctgtagtaagtagaaaaaagcacaagcctgtaggcagatttttaggaaaggtcatactgtctatttttgcctagattttaattttttttcactaatgccttgtattccattagtgattgatttgggttaataagtataatctgtcagaatgttaatatattattataaattagtcaagttctgttgcttaattcctagcagagaagttttgtgcgagaaaggtcagtcattttggcgtgtggtgtaccatggatgacaatttactgaatggatgggatctatgataaagagtttagcaccctaagcaccaggtaagcagagagatgctaggcaataggagaagattgtaagatgagagagaagaggaaaacaaagatgtatttcttccaggccttaactcagaaaaataggaaaaaatgcctttttccttctctcttctgtccagttcccagacttagcatttacatagttccttactgttttggattctgtcatgattgtttccataacattgcctcattttatcctcagaaaaaaaagtggggcaggtattgttagtcccaccttatagttgaggaaactgaagcatgacaagattaagtatctttttacttgacactatcagtagtgatagggaagtattggtatccttgactccaaagcctgtttttaactatcatgtgtactgaccctgggtcctacatatacacattttcacaggtaaccaataaactttagattccttatgtagctgactttcaaataagattatggatctcagaggttgatgaatattctattattttttactgtggtatattttttattttattttattttatttttgagacaggttctggctctgctgaagagcagtggcatggtcttggctcattgcaacctctgcctcctagtctcaagagatgctcccacctcagtctcctgagtaggtgggactacaggcacatgccaccatgcctggctaatttttgtaattttttgtagagacagggttttgcagtgttgcccaggctggtctcaaaatcctgggctcaagtgatccacctgcctcggcctcccaaagtgctgggattacaggagtgagccactgaacccagcagtaaatattattatgtagtattttctaagtccagattttcttttaataattatttaaatgatatatgagagctataagatcttaccatctgggaggttacagtttatgtaataattgccattctcatgtcacttataatgcttcgttattttatttttctctatataatttaatagctgagaaggaagtattttggttaattgcagtagggtagctgagaagaagcttggggacagtataatgaagtaatttattaacagcttttattgactcccttttttgggtgtgagttgatttgaatactaaaggtttccagatttcatcattatttggcatcagtgtcactgctaaccatgtcatgtaggtttgttcttttaatgacacttttgtttatgaggaaaaacagagctaaagtagaaaaaaaaagccttatgttaaaattcaactgttaacacctttttttttttctttctttttcattttgagacagggttttgctctgcccacctctgcctcccaaggagctgtgactacaggtgtgcaccaccatacctggcctttttgttttgttttgtttttggtcaagacagagtttcactaggttgcccaggttgggctcaaacaatccccctgcctctgcctcccaaaatgcctctgattacaggcatgagccactgcacctggccttcttagcatctttaaaacccaataaaagaggtaggaaaaaaaggatcttaacatcttctttactagtaaaaattaggtctataattagatattattaactttgacagaaaatagcctcaagagttgctataattttaagctctgccatgaatgagcaaaacttctttgttactgtggattagagttactttcctacaagtatgatctgggttcaaattctggctcttgtttgtaagcatcagtttcttaatatataaatgcggatagtaattatacttacattgtaatattggtttgagaattaaaggacatacttgatgcagaaagtagtacctggcacattgatagtactctagcattttctgttattggtaaattaaaatttgtaataacatttcccccaactttggatgaaggccattttatttcatttagaatcatgccattattaatatgaaactattattaaaatacttgtataatttccatagtggttttatagactataaacatggaacgcttgcagatattttataaaaattgtttttattttgtgaagagtttatatttcaatagtctgtccatagaaatataaggggggggaaggcatattaaattaagttttgttgttgataatttcattgagtcatttttgtctgttatctttgttctatcagttcttgcattgcagaaagcttatcttgtattcagtacaatgatcaatttaattggctctgcagtgtctaggatgaggttgcttggccaggatatatttggcagtgtgaggaaggcaagcttctatgttgattataacactgccttgtcaccattgtgttctttctaagcacagacacagcttggtcccctggcagtgatatacagcaaacgtcaataacaacctttgtaaatgttaaataaaagagcaaattgaagggcagtgattcattaggaaagaattttgtctgagcaaattaactcttatttctgttaacccatgttaaagaatcactgactgtctcttgagactttggatgcagttgaactagaaactatacagatgaaggtcctcttttccctttagtgggtgctttggatcagcagtatgtgctcttcatttgaaatatctttttttttctttttttgatatactttgacatcttaccaatttgattaagcttcagacagtgctgttacccttaacttgcctcccagttaacagaaaccttctgaacttgcctgtggaaaaatttttaccatttttcagttagtggttgcgttttcagttttagatttttcagttagtggttgcattgtgcatatatgtgttacttcttcagacctacttgtctaaagtagccagtatattttcagatttttatgtctaatgtgattttcttttccagtttttcttgtcttgtttaaccagtgtaaaggcaatctaagtgtctttagagttagctagaattccagaaactgatttttaattctttcactagccatacttgaatttccatatctgtgtatgtacacacttgcctgaagatattttattttttccttaagatagaggtaaaaagaaagtgttcagattttcaaagctaacatttttttccttttttttcccccaaaggatataatgtattatctatcaaccactctctcagaataacttgtttgttttatcatgtactgtgataggttagtcatgaatttgcagttaatgaagggctatttatttcatgcctaccctcacaggttttctttcttttttcttttttgtgacggagtctcactctttcaccaggctggagtgcagtggcacgatctcagctcactgcaatctccacctccccagttcaagtgattctcctgcctcagcctcctgagtagctgggactgcaagtatgaaccaccatgactggctaatggtggttttgtttttttgtttgtttgtttgtttttttgtttttttggcagcaggtcggtgggtgggcagtgtttgtagagacagggtctcacattgtgcccaggctagtctcaaactcctgatgtgaagcaatcctctccgctcagccttccaaaccgctggaattataggcatgagccaccgtacccggtccacagctttttttttttaagtatcttcttcatactagatacgatactgtatgctatttttgagactccgtagtcaagtataattgtaaaccagctagtaaaattgaagtttcttttttcatccttgtgttatttggaaacaaaattaagaaatagagtctcttttcttcctcctactttattcaacagccctcactccatatggatactgtatactttggattttagaatattttaactcttaaaggaatgggcagtggaatcacaatatcactgatttagcagatccttggtaaatattcgtcatgtgatcctgtggcaatcctaaataggaattcacctctttctcttaagctttcccatagtactttatatctctttaaaaaaatcagttgtttacattactacattgaaagttttttggaccaccaaccttgtttctgtctcagaaccttagctaaatgcagggtattcaaatatcccatccttatttcctgtcatttcttgtcatgagtcttaggtcctactactatttacctgcttataattacacatttagtttgaagtgttttatgtttgcatgcttttctttcacattattccccctaactgaaatgcccttcatacatttttttgcctaattaaatctgtcagttcatttatcagtacttactgcatttctgccatttgctagatactgcgttgactactcggatgtacattggtaatggaagcatttatgactttgccgtcctggagttttcaacccatgcttgtcttttctagaaagccttgcctaaactcccaacttggattcagtgctcccttgctgttttgtctgtggctccctgtatatgttatgctgaaatttgctgtttgtgtacacttgcttttaggttggagttttcttgaagataggatgtcttgattcatttcttcccttggccctatccaatatctgatatatatcaagtgctcaataattgtttgttgaactgcttttaaactgtagatagattacatgatccctgccattgatgagctctcaggacttacagttctgtgtatgttttggcttttgttatagttgtttgaatgcatatctgtctctcctgttaggttgccagcttcttgaagaataaaattttatcagcatattttatttatattatatggacaattatatttctatatttttttgctatgccccaccatatctaattttacatatgggacctgtaagattttgatccttctcctaaaatgtttttggtaaatgctgatctcctgtgagagccacctgagtgaggaatctcagtgtgtaggaaagtgagacattctttaatgagagactggaagagtttggttgttaagtgggctcagaaaatgtctgttgtggcaagcctgtggccccatctactcaggatactgaggttggaggatcacttggacccaggagattgaggctatagtgagccatgattgcacctctgcactctagcctgggtgaaaaagtgagactgtctaaaaaaaagaaaagaaaggaaaggaaaatgcctgttgtctctcctctgcaaatgagctgatactgaaaggtaatctggaacaggagttttatggatatctgtttttgaaactgaaagaagtagcattttggcatgatctggagctgacatacattccagaggctatatagatgatgacatctaccagtgaggctacatgactgacgtagaaactgaggttctttcgctagtctaggacaaagatgaagcttaacttcgctgatggatagaaccagactttgtcactgtttaaataatacatttttggttgttttctaaatatgaattcggttcactctgaaattagagcagttccatgagttcactgaatttatttgaacaatagtgtttgccatggtttgaatgatggtatctgctccaaaattcatgttgaaatttaaccctcaatgcaacagtgttaaaaggtgtagttggcctgtgggaggttattaaattatgacagagcttcactatcataaataggattaacgccttatgaagtggctcaaggtcgaaaggcgcaccttcttgcccttccactcttctaccctgtgaggacacagcgtttatctcttgcccttctgccatttgaagatacagtattgctcccctcagaggaggcagcaataaagtgccatgttggaagcagagagcaacccatatcagatgccagtcctgctagccccttaatcttagacttctcagtctctagaaccatgagaaataaatttgtattgtttgtaaattaccgattctatggaatttttgttacagcagcacaaatggtctgacagtgttcttctttaaaaaggaataatgttcatggatacagctctattgttcctggaattcttggggaagattctttggagttttgtggagttatatataacttactaggttgtccttgccatatttttatgatggtgagtgaacacagtatacctatgggtgagattagaataaaatagagatttttatttgtgtattacatatttagccaacatttattgtctactatatgctattctatttaaaatgttttcacttttcctgcttcttatctccttgtttccttgtacaaaaaaaaaaaaaaaaccacccccaaacctgcccatgcttcatagtcctgttcaaacatcacctcatttttaaagtcttgcttgatttttttttttcacatttttttcaccatggcacctttgaggaaataaaaatttgccttgtgttatagctttaagtccccttcatcagagcttaagcaatcttaggagagatgcatgtttgatttcctgaaacataatcactggacttcatgtttgtggccaaaaaacaaaacagaaagacaatgtaattctcattataatgatcatatatactagtaactacagtttgttcagcacatacctgtaagccaggcattgtaagaagtgtttatattcattatttcattcaattcttttaacagcattattttatgggtatagaaacaaacttgagaagtcaactaacaaacttgctgcagcgactattaagttgtgattgaggaagtagaacgaactcagatttctctgactccaaagtacatgttcttaaaatacaatgctgtgctactactatagtttctcagcttcaaagagaaccaccagaagagccaattcatcccatcattttatttcctggttttgtttttgttaggacctttggaatgtatctgttaaatacaattaaatttggaatgcagtatttagaaaaatgtgtattcactagatctcttacaaactggtcataaactaagccttctaagagtgaggctcataaattaggatgtgttcattagttgtagaaaaaattgaacagagatttgaaagggatttattctttctacataaaatagataagcagagcagaccaactaaaaaacagctttttaaaataatttaatggaaaggggtctcagattattgtggagaaaaggttgagtggatgagaaaatcaaacatttaaactaaatgcaaaataattaccaacattgaagcaaaaaagacagatgtcattcacaacaatgaatgatacaatagtaaacttcctgcctttatgtgtgtttctttcttgttaaattcaaactttagctctttgctatgtcagaaaatttttgcttttacatggctttgatgatttaaatgaagtgaatgagcatgaacgaaaataattcttaagtgaatgaaagtctgaggcttttgcaatagaaagtatataattagcattatttttggtaatgagctttattttgaagctgaaaccactgctaacaatgtttaaaattttttaatttccttgtttctttaaatgatttatttgggatactaacacagagttaaataactttgaattccattgtaagattcttttaaagtattttgtttgaaagtctttcatttcttctaattaggtagacaatctccatttgctgctaaggcaactctaccacttctctttttttttttctttttttaagacaggatcttgctttgttgtccaggctggaacatagtggcacaatctcagctcactgcaacctcagcctcctgagtagatgggactacaggcgagcaccactacactcagctaatgtaaaaaaaaaaagttttaaggccgggtgcagtggctcatgcctgtaattccagcactttgggaggccgaggcgggtggatcacgaggtcaggagatcgagaccatcctggctaacacagtgaaaccccatctctactagaaaagtacaaaaaacaaaaaaatagccgggcctggtggcaggcgcctgtagtccaagctacgcaggaggctgaagcaggagaatggcgtgaacccgggtgaacccgggagtcagagcttgcagttagccgagatgcgccactgcactccagcctgggcgacagagtgagactccgtctcaaaaaaaaaaaaaattttttttttttttccatagggacacagtctcacattgcccaggctggtctcaaattcctgagctcaagtgatcccgctacctcaacctcccaaagtgctgggattatagatgtgagccactgtgtctggtttaattcttgagtctctcctctaaaggcctctggctcagaatctaaagcaggaagtttctgttcatggcaaatgctgctgattttccattctgttctagtggagtttttcatatactttggtttccatgtttttgattccactttgttccatagagatttatcattttcatttcctgttacttgatttcagcaaaacattgatgtgaggaaaatattaaatagtacagctatgacaaacaatgctgagactggctagggaatttgggagctagcatgtttgggtatctttggctccatcatcccctgtagaattctgggcactctggttgacttcaccttggccagcatgatgggggccttcttcatggatccgattgaactggttaccatgggtgttccagacttcccaggtattgcaggtaacagctacattcttctacaaaatgaagaaatgcaggcagccacattccagaagtccttgtgctggcctccaactgctaatatcctgtcagtgcactaacattttcaccagacacaatggcttgactctcaaaaatatttcttttttcttttttttttgtgagacagagtctcactctgttgcccaggctggagtgcagtgacgcgatctcggctcactgcaagctccgtctcccgggttcacgccattctcctccctcagcctccagagtagctggaactacaggtgcccaccaccatgcccggctaactttttttttgtatttttagtagagatggcgtttcaccgtgtcagtcttgatctcctgacctcgtgatccgcccgcctccatctcccaaagtgctgggattacaggcatgagccaccgcacccagccaaaaatatttattttttcttagagtggttgcatcaacctgattatatttctttttccgcgaccgccgttatgtctaagcattgccttagcaggaagaaactatcaactggataggaaatttgaatggggtgatgatacagatcccactgaggacagatagccaagctttcatgcccaggttcagcagcctgaccagatcgttatgaaaaattacttggaacttttatatgcagggaaacctaagaaaaccaagtatgatttgaggcctgaaatgtaactggtcttgttctcctttatccagtggtaaggtctgaaaataaaatgttgactaaagactttataatatttctataagttctattgtagtagatccagctgttaagcctgaataaaatcatatgactactgctgtgattggtaataggatgcacccagttaacttaaggccaacaacaaatgaagcaattactattttacagttacacgaggcaaacctacaggtagaatgagtgatgagactcatgaaataaataaatagaaagttattacatattagcctttaaacttaaagataccagacaagccaacaatgaatttctgaacagccatggtaatgggctagttaagttttactttattactttgtgacacatagctaatttctagaaagcaagaagttttctctttacagtggtgaatttaacattaatacttgtgttttcagtaaatacagaatgtgctgtacttaaatttttttctgcttattgtttatgtagttttaaaattattttataaccctttaagtaaaaggcatacactcttgtaaatagaagcaattctcagcttgttttcttcacatatagaaaactaaaactgtagaaagatattaaatcaactagtaactccagtgaatatggtattttataatctttaggtttatcatacttagattttgtgtgtagggaatctgattttaggtctgggcacagtggcttacacctgtaatcccagcactttgggaggccaagacaggcagattgcatgggctcaggagttcgagaccagcctgggcaacatgatgaaaccacgtccctactaaaaataacaacaacaacaaagaaatgctgggcatggtggcatgcacctgtagtcccagctacttgggaggctgagatgagaggatcagttgagctcaggaggagaaaattgcactgagctaagattgcgccactacattccagcttggttgacagagtgagaccccatctcaaaaaaaacaaagcatctgattttttaaattgagacctcaacagtccatagtaatttgtcataagtacagtgtttttcttccagaggtgcttctttgttgaatcatccttataaagttattagcaaaaatttggttgagccttctacttgcattataaaaccaaaaaggtaactgaatttttcagatttcataatctctactctccatcctctccagtataacatgctctgtgtcagtcctattggagaatcatttctcatgcatattgctttaagaaacaaaaaactaaaacccttcctttaatctacatattggaaaaacctcagttgctgaagttaaatatgtttctctgataatgtcagtctttggctccttagttagattccatctttctgtcattgatgtgccctaaaccagcctgcatctaccaatcttggtttactaccaatcttgctttattatctgatctcccttaatatctggtctccccagtgattctcaaaaggtcacagtgaggatctctatgctacatgttaatgtttaatggaaattttctatgacaaggcagtacacagaaactataagattatcaagattctttgtaattggccataattttatctgtccaatgtggctattttgtgtcttgggaacatgggtagggtcctttcttaatggaaacaaatcaaaacaataaatatatattctttcttactcttcacttgtactttttttttcttttctttttttttttttggagagagagagtcttgctctgttgcccaggctgaagtgcagtggcgtgatctcagctcactgcaacctccacctcctggattcaagaaattctcctcccttagcctcctgagtagctgggattacacgcacccaccaccacacctggctaatttttgtatgtttagtagagacagggtttcaccacgttggccaggctggtctcgaactcctgaccttaggtgatccattcatcttggcctcccaaagtgctgggattacaggtgtgagccaccttgcctggcccgcttgtactctttcttctttttttttattcatacatccagtaaatatttataaaacaattacaatatacaagaagttctgctaaactttgaggagacaaaaatggttaatattttcatcattaatagtttttggtcattcatagttcacacaagtaaaggcaacctataatagagtagcgtttatcatataaataccatcaccgtttatatagaaaattttttcatctccttacatttcaggattctgagtatcttcccagtgcttcctgcaccgatttaaacaaagtgagtcctgttactgagtttgagaatgagttgaccatttgtgaaatgttgagtgaatgagtgtgagtatatagtaatcaatagtaaaaactatttacctaataattcaaattagtcactcccagtgaaagtgtaagaatagatacagagaactctttctagaggttatggtgccccataggaagagctgtccctacttattcttcactattacgtcggttgatgagttaattggcatgtagggtcctgttttgatcactgttagaattctcgggcgagccatctaatgggatgaaacacacattttttgcttgtttgttttaacatttaaatactgtccctggacatcggaatatctaattctgaaatgagaacaattttatgagcttaccaaattcatttaacagtaatgttcttttttaaaaagggggatataatgttcatggatgcaactccattgttcctgagatgatccatgactgactcatttggaggggatcccttggagttctgtgcagttgtacataactcatttggctgtcttcagtatattttcattatatgtatgtccgcttcaagtgtgggctgttagtaagtccattttcttttatactaatgataggtatatactgattttcctactgtacatctataaacatgtaattgtactcctttttcgctaatcagatgacgagaaacaggtagctttattaagctctcaagttagaatcaagatcatgtttaacttctaccgcatttgacaaaggaaaaaggaggtcccatttcgttaagaaccttcatttatcctaggcaccacgcaaagtgcttttgctctgttcatttaatcttcataacactatgtgagaagtttgccattttttaaaatatttagaattcagtggggttttttggttccttctcagtaaccacaattctgctctgtacttcagtgtttttaataatagttttattgaaatatatcacatataataaaatcacccttttaaagtatacaattcaagggtttttagtatatttagagttgtgcaaccatcaccactaatttctgaacattttggttaccccatgaggaaaccccgtacctattagaagtcaattcctatttcctccttcacccatctcctagcaacagtttgtctttctctctgtatagatttgcctattctggatattgcatataaatagaaacacataatatgtggtcttttgtgactgactctttttacttagcgtattttcaggattcatctgtgttatgttacataatcaatatttcatttctttttatagctgaataatattccattgtatggatataccattttttatttatctgttcatcagttgactgagatttggagtacttctactctttggctattatgaataatattgctgtgtatttgctgtacaagtttttgtatggacgtattttcagttctcttgggtgtatacctaggagtggagttaccaggtaatataactctggtgtttaaccatttgaggaactgccaggctttttcccaaagtggctctgcaccattttacaatcccatcagcaacttatgaaggttccagtttcttcacatctttgccaacatgcgtctgttccttttattttagccatcttaatggtgtgaaaacctcactgaggttttgcatttccctaatgactaataatgaatataggttgggtgctatggcttatgcctataatcccagcaccttgggaggctgaggcaggcagatggcttcagcctaggagttcgagaccagcctgggcaacattgcaaaaccccatctctagaaaaattatccaggtttagtggcacgcacctgtagtcccagctacttggaaggctgaggtggaaggatcacctgagcctggggaggtcaaggctgcagtgatctgtgatgcgccactgcattccaaccctaggcaacagagtaaaaccctgtctgaaatatatattgagcataatttcatgggtttattgactacttgtgtatcttctttggaggaaactctgagacttagtgatttaatttctgaaatggagatagtggttctggccttgcactatttttgagaatgatgtaataaaaagatgtatctaatcccccagcacagggcctaacacttagaagacatttattaaacgttaatttcttctttcccattccttctccagtttcacagatgaagaaactgaggcttagagagaagacatacaagtaattcaccagggttcatcttacagttagcttgtgaacgctagattcaaatgcagatttttgtattcgtgctagattcaacactgtactcccccaacaacccctcctttttgcctatgctcctctactgtgaaatggctccttggagtaggtaaacttagttactgtatatgatactgtcttttatatctttgctgtaaaagcaaaaatagctgatttgtttaaagaaaccttttcaaggaatcgaatttaatagactgtctctttagattcatttgaaatgtaatgtgcctaaggaactgtgttttccttacactttgacctctctaggataaaatgtctgtaacagatgaaaggctcaattttggatgaatgtcttgatgcatgaccaccaaagactgtttcagctagaatggttgaagaactctggtttccagatgttattaccttaaagctaacctgtttttatatgtagtttatagtgagcaggaccactgacatatattattgaccattttgattttttttttgtggattttagagaggcagcatctgtaaattacgtgcatactgacttttgtttttgttttttaacttcacacaactccagagaaagaaaaaaatagaatctttttagacaaaagagaaacccctactcttttggcaggatttgcaaactcagatactctagagtgcattatcaggggaccagctgaggaattcattgaccaacatctccagttattgttgattaccagaagagagccgtcaattttcttgtgaagtgctgttattttaaacaacagagttgggatcagaactgtttctgaactgaaagtagagtgttaaagagattcttttttttctggttttggtgttttcaaattagtctatttttaattattaatattaaatgataatgaaaaatgtgcttgttgtgttacacacgttgctaagtactacatatattagctcataaaatcttcacaacttacgagttgtatgtattgcctgaattactatgtatttttcatatcaggaaattaaagtttagaaagtttaggtaactggtccaaaagtcacaaaattggtaagtcatggaattgggatttaaactaaattttatctgactccagagctcacctcctcacctttctatattattttttatttaattctgtattcatagtagttaaaaagcaagggttccattttctgttttgcttttcagagcgttattgtcagacatactgttaataagatatttcctgtgtctttgggggcaaaaggttcaaacgtaggtgctttcacttaggactgaatttggaatcaaaaaagagaaaatgtcttctggtggtcgcacaaggtaaacctggtggttaacagctttgaatgctgtttaattctgcctgttgctttgatgagaccagtcactgctctttatgttttttccatttctggtgaatgggtgtaatctgcattattttgagctttaaccgagctattgcatggaaagctcaacctatgtgttagttacttcagaaaattgtttggagaggttttatgatctttttattatgttgtttgggggatgggtgggtaacattgtaccatttttcaaatggtggtgttactctgtttagaaagcaagcaaattttaagtccaatattactgtttttacttactaatgcttctgtaaaccaaaggaatggttgtctttgtatcctcataaaagcaatcactcatcatcaattttaaatgaccacttataacaataagtatatctcattatgcttttcctgctgtacttttggaactggcacatttgatctctgttcatccctacatgatactctgaagatgactagacagagcctttaaagttatgtcaggccacaaagggagattataaatgaggagaaacttcaaggtcctctctaatcgttctacagattaataaattgaactcattgttataatttcatctgataaaggctaaacaacaaatagtaagaacctgaagtagaatctgagtcttctgatttgggtctgatgtcttcttctagtctaagatttggaaaagaagttaggtatgcattttaaagtgaatggtgtataataaaccaccagtgagtttatcttgtcagctttctctttgtggaatcatgatatcgtccagcctggcatggtggcatgtacctgtagtcccagctacttgggaggctgaggtgggagaatcacctgagcccgggaattccaggtagtagtgagctaaaattgtgccactacactccggtttgggtgacagagcaagccccctcactaaaacaaacaaaacagtgtataataataataatatcttattttgactaatcactagatttctttcccaaagggaatctctgttgtagtgggcgtattttcatcaaatgtgtacatttttttcttttagactgtagaatatgtaatcactattagccttttgtgcaaagtgtagtatttatatctacaagtaaatacttatgtatccagcatcctaatctgaaatgtgaaataattagattttctatatgttgtttttgagagagatcaaataaacatattggcagcaaaaattaatcacccaagtcaactttcagggttgtcaaagggtcaattcagattcagctacgtgtgttacactggtttccacatgatttctggctctgatgattgatgttcctaatggaatctaaggacctttaaggtgccgaattgccctctgaattatcaaagaaatctactggttaaacacgtgtgtgcccattcttgtcccaccaaggatttgagtttgctggtttgctttttttaagaatgaaacctatttttcctgatttttctttttaaattgtgtcatctgtacatggcatatagtcaatcagttattcataatactaagttatccaagatatccctgcctacatcctctctgagtaaaaggagctgacaagagctctgtggatgctacctaacagatcatggagctctgcctatgtctaattatagcaatgtttgctgaaaattgttctatttatcttctcttgtaattatgcactatacagagtcacccctcacacaccaggagaatgtgaggaaaacaaagccagtgactctacatttaaatttttttcatggtcacctaatttttatttgcaattcagttttagctaggttattttagaaggatgcaaagcctttttatccttcatacaagattaccaactaccatttttactttcatcctcctttgtttcatactattgtttaacagttgttttgtgtaggatacaagccttgcatgccaactttgatgtggcagaatgaatcatgttaccattgatctgagcctgaacagaatagccatcttcaaataggaagaagtttctagcttcaggttgttttagcactgcgtgccttgcttagcctgccgtgtaaagtcagttgcctcactcgaaacaaccctgtattaatatgcacaacatgaccattttcagtagaaggttattagaatgctagtttgtatcctctagtgaatgaaatgatgtgtgattatgaagtcatcaggcatggaccagtaagactccagagagcctgccccctccgaggtcctcagggtgccattgattggtggccatgtgtttgtgcccgatagactgtgaaatggtgtgttgctacacggctgtgttgcacctgcgccccaccgaggtgattgattggtttggtcatgtggaatgttcccatctggtctgcagtaatgtgtttttttttttttttcccatctgtgaatagcaagtgctggctgaatagttacagcaaacagtttcagaagctaaataatccttttcctctaagaacaaattgggatatgaaggagtttgtttttgcttaccttgccttttgtaaaggtagtcattctccatcaggttcctactccttctgtctaggatgttatgtgcttttctctttttacctatttttacctcctcttcataatagattacgctttctgtatttctaatttgtgcaagtttaaagcaaaatctgttcttttttgctgtttgttgttttgatatgccacttgaagtgatttgcaattttttaaaagatagtttctgtgatcataattggattatcagagtactgatgtatttttaagctttcacttaacctcacaagagtggtggtttatttattgaaaactactgatgttgcagtttaaatgtcaagaaattatttattaggttctttttttaaaagattctatagttatattgggcggtcttgtttgatatttcttaatcttagtcctttttcataattgatctattcattccacctaatgactaattacatatcagagcacatcatcaaccacattcatcatagtagaatgtaataatcaatgacatttcaacaaaggaaaaaataaatatgcaaataaggcctcattaacatttgcatgagttgtttgaataatcacgttgctgacaaggctgtaattaacagaaattgatgctgagttcagtatttgatagtgtgttttctcagcattttattgttgtcactgcgggggctgaaatgaagttctgctctacttgtaccttgactggaatttgatgtgcagggctgtgccaggtacgaaaggcttctgggagcccttgattcatctgtgacctacacttaatgcatataaagattctttatttaaattgccttatttttttaatgaagcaccattagattttagcaattatgagacaactgtagaaagaaaacaaacatgaaaattcaaatcattcattattttgccagaaatggcttatatgaatcagatacaattaagacttcaagatttaaatttgctcataccatggaaaactgatgccattaattttttttttcctctctcttaaatcttgcccagtggatcactgtcaagaggttggagcttactgtaattgaaaatcacttgcttagggaaaaaaatctaattataaaatgtacagtttgagggtttttgtgtttttttttttttgaatagctgtgcacccccacattcctcctccttttcctgtactgtttcctgtttttgtcatggatattaactgaaatgctctaaacacaataaagctgtttatgtcagttttttggatgactgcaagtgctgattataacaagtttaaggaatttcctttgttgaatgtgtacccatgccatatggctcaacatggaacattaacttgacagggataatggattgtggtatatggagacaattttgcctgcagctttactataactcattctggttggggatcacaggtttgtagtatgggatgcaacaaacatccagatggatttactttacataaaagagttgcatttatttttatttccttcctgtaattggaaaaagaactttttttaaaagaatcaaaatattaaaaagtaaacgaagggaaaattgttcaaatgaaaacatgtattctgagcagtttttttggtaaaatgctatgaaagagactatttttgtatatttagcacattaaagtcatggtgtatataagctgatactgcttttgtctttacggtagtatccaaaatgaattttcctctcaagattagaaagttgtctgtatcaaccttaaaggtgtttcaggtttgtagacataaatgatcaagcagtgtcaattatgaaattattttagtaatgcttattaaatagtagccctctctgagatgaattggatttgtaagatttgagatagaaaagctttttaaaaaagtatccagtttttctttaactgcagtatatcacatataatagaagaaaaggtttgttatttcgccaagcagtaataaagttgctgactgttggcttcttggttttatatgtatccctgtgaaagttactcttaatttatctggtgggaataagaaaactaaaagccactttggcagaatgatcatgtaaccaaaggctagttacctagaatgcttaaatacattgttgttaagaactgacatctattctagctgtgttagagggggaaaaaatctggattttttttttttcatgaaatgggcttgtaatgctaaaaaaaactagctgacttggttattttcactttctttttaaataatttagatcttcatttatcttccactctgtgtttaggtggaatatagagcttatgtcatcaattaaattatgtggaaatctataatttgtctaaataaaatcattgatctatactattgatctgcagtatccttgatacattaggtaatgtgctgtctctgagcacagtagataaagacagctatcccttgcagcttctaaacactaaaaattgctgacatctttgcaagtttattttgagtacctaggacatacacagaagtcagaggccaagctttttaaccatctttgctgtgtcaaaaaacactggaagtgggaaggaaactaggctgggaggccatgttttcttttttttctttgctcttgggagacgtttgctctttatttctcttatgaagtcacagtggcctgtcataaccatggattaaatgtttgaacacaaaaacaataattcccatgatttaagtcacagcttttaacagatcgacgtatatttcttatttctacattccaaggtatgaaaaatagctatcaatttctagtgtattatctcacactaatacatataaaggaaatatgtgaacttaccctcaaagaaacaataaaattttcagagacatcaaaataagtattttaggtttgaagatcccttttccttcatttcgtaatagatgttttctttttttgagacaaggtctcactctgtcacccaggctggagtgcagtgttgctatcatgccttatggcagcctctacatcccaggctcaagtgatcctcacacctaagcctcctgagtagctgggactgccacactcagctaatttttatagagacaatttcccatgtcgcccaggctggtcttgaactcttaggctcaaatcatctgcctgccttgtcctcccaatatgctggaatcacagacaatagacaatagccactgcttctggcagtttttttttttgtttttttttttttttttttttttttttgagacggagtttcactctgtcacccaggctggagtgcagtggcgcgatctcggctcactgcgagctctgtctcccgggttcacgccattttcctgcctcaggctcccaagtagctgggactacaggcacctgccaccatgcccggctaattttttgtatttttagtagagacgcggtttcaccgcattagccagtctcaaggtctcaatctcctgacctcatgatctgcccgcctcggcctcccaaagtgctgggattacaggcgtgagccaccacgcccggccctggcagtgtttcttaatgtgatatccagcattgcttataaataaaacacatttttccccatgtattttaaatactgtaatttacaaaggatgtattaatgaataatgaaatttttttccactttggtaaaagtttgacacaggtataaagggcttatattgaaaaatatggtattcaaacaaaatattttagaagttactcatctaaattgcctaaaatattatttctaaaaatatttgtggattaactgagaatgtaggaatcgttgtaggatttaatacattttaaccattgatatttggttgtggtggcattgcttccataatacagtgactctgcaactgctatctagatttttttcacttgtagagtgtaataatttgcaaatgttttgtttatttttatattggcagagattataattctgaggtcctatgcttataggaaagacttaaagaatattaggtcgggcacggtggctcatgcccgtaatcccagcactttgagaggccaaggctggcggatcacgagatcaggagttcgaaaccagcctggccaacctggtgaaaccctgtctctactaaaaatacaaaaattagctgggcatggtggcaggcatctgtaatcccagctactcaagaggctgaggcaggagaatcatttgaacccgggaggtagaggttgcagtgagccaagatagcaccattgtgcactccagcctggctgacagagtgagactctgtctcaaaagaaaaaaaaaaaaataaagtattaccaccagttctacttgttcttctcttttcagtggcccatccttaagccagttctctccttggtagagaacaaagacaggcaaaagagaagaatttccagtttttccattttacttttacttgttaatatcactgatggctaaatatttcatgaaattatactttgatgctcatgtctaaaatgacacttcagcgttaactaaagatttctgtttttcatgttttttcatttaacactgcttctctacagctgagcctgggtttcagtgtttaaatcggatcttggaagaagctttctgtaagcttggaatgtgccttatcttaaagccttcttctcttaccctgttaaccattcctggcttaaaaccttcagaagtcatgggatgtgggtttgcctggggagtctgctgcctccagtggaaatttaggcaactgctatggctattccagacaagtacttcacagataatcagatctgtttcctatctaaccgaaaggaaaagtgtaaagcttagaggggtaattcatatattccactttataaaccattctaacagccagttgtaggaacagggcagctgtttgtttttaaaatcacttattctcaaaagagttcatttggagacagttaaaataaggcaataggcagaaagtggtagagctagaagaggcctaactatgtttattggggttcatagataaaaagcaaatgaccaggtattttcattataagccattatgtagtcatttcttttttaagcgcgtgctaccaattgatgttttcagttatgaagagttttgctgttactaaatgatcaaaattttaggtttagaatattgtaactaatatttctgaaattgagaaaaatttaagtaagtgaatatatgattaaattaaccagtagctgagatcatttacctatttcagttgagaacttgagctaaaattaagctttatacataatcccagttccagaaaggaccttgagaggtcctctagataagatcatatttagactgtcccaaacacattagcctataatttagacaaaattaatctcagtcagtctcagtctgtttttctctctcccttctcacctctccttgacttctctttttctagttactcttccttctccaatatcctttcctcttgctctcgtaatctctgtccccttactttcctctgctctaaaatttcttactcatgtgtaccacaagaatgatggtcttttataatccgttttatggctattaattacatacactaaattttcaaagcaaagacctaatgttctattgtatagatgtttcagaaatcatcatacatataactagatttcagctgcatgttggtatccatccctaaacagtttaagggtgttagcggtgattatgataattgggagcagaagacagattctcttgactaggcaaactttagtgaatcttagtccttttccctggaaaaattaatagtatcactcattacatagggctttgctcctgcataactaaaccaccagggagatcttccaggttcctagccatcacctttatttgcaaacactaaaaaatctctaatgtttacttctttaaaccaaaaaaaaaaagttagagcattatagctgtggcctgcattcatagaaaaagtatgcttgcactaatgtttaggggctaggaatattaaagcatttgctatgacactcaagaaaaaagtaatagtaccaaaaaagctttatagatgttttcattctttaatttccataatctccctatagaagatctggaaattacagtaagccagaaaaagagacagtaaacttcattcactcacagtcctatcattcagtcattatcagtattaacatttggagtatagtagatgccgtctttcccacagaaatcggacaggcactttgccatttaattaaaaacagtttattcctcaaaaaatcaacataattaccatatgatccagcagtattacttccaggtacatacccaaaagaattgaaagcaagatctgaaagagacatttgtacacctatgttcatatcagcattattcccagttaaccaaaggatggaagtaaccaagtgtgtgttgatgaatgaatggatgaacaaaatgtggtatatgcatacaacagaatattattgagccttaaaaagaaaggaaattctgacacatgctataacatggatggatcttgataatgttttaattgaatgagtatgctaagtgaaataagccagtcataaaaagacaaatactgtataattccatttctgtgaagtacctagagtagtcagattcataaagacagattatcgggatcaggaggaaccttaaaaggttcatcatccaacaacccttgagtattttaatctccttttattcaacaaatatttatagatcatgtgctaagtgtcagacgttatgctaaggactgtggaaacaaaggaaacaagtttgataaggttcctgcattcatagatctaaggcctaatagtaaagccttccatcacttagggcttgctgattacaaagtgccgtgtaattattgcagatagcctttatttaactatttatttgggacacatagtgggctaagcctttgtgtatatttatgcattaaattcaaattctatgagatataaacaaaattattttattttatatttgaggaaactgatgctgagataattggtttgcacaggattgaacaatttacattgcaaacccaggtctatcttactctgcaatttgattttaaccagtatattatgacctctgacctcaagttcattacttccctttttttgcctttttgcatgcctttacatctctgtcaaggtattgtccaatctgtgctttgaacatctctaataatgtaatacgttctctcaaggtacttatctaatctttggatatctctggtaggtctttatgatgtgttttttaaaaaaatcagtctctatataattttcccactttggtcccagatgtgttttgaggatcacaccaaactgtgacagccggtccttcagatatttaaatcaggctatcaccctttttctccagaaatacttctccactggtatcaaatcctgtgatttcaaatgtatttattttcttagtcactgtccgtgaacaagttttagattgcttgtatttttcttactatggccccagatattgatgcagtttctccagatacagagtaatgacaggaaacactcttcagtgaaagtggtaaaagcaggcattaactaaccattccccactcgctgtttgattgattgattgagatggggtttagctcttgatgcccaggctggagtgcagtgtcacgatctcagctcactgcaacctctgcctcccaggttcaagtgattctcctgcctcagcctcccgagtagctgggattacaggcatgcgccaccacgcccaactaattttgtatttttagtagaggtgggatttctccatgttagtcgggctggtctcaaactcccgacctcacgtgatccgcccacctcagcctcccgaagtgctgggattacaggcgtgagccactgcgcccagaccactcgctgttatttttaattaaattaacagttatttcactggaaacagctataaatcttgcaactcagagaagaactatcttttccttttaaattatgtgagccttataattctgcactcaagtgtcagaaatcagtcagcctaggcacatctcccttaatttgcagtggcgggacacaggggcagttgctgtaggtaggtaggaacaggaagattagctagattatggaaaggttaggcaaaaatgtaggaactcttggttgaagaatatttcaagcttgaatgacataaagggaagaagcacaaacgggaggaatagtttgggtgtttaacagctcaagggagaaacgatatagctacagtccttggttttgtgcagcactctttttgaagccagtgatcacagcaaaaacaagaggaggtgagataagagcttctgtgcagtagagcatccacacagaagggtgcaggatgcagcagcaaatggaagttggctatatacaggggaattgattaaatatgtaaacatattatagataaaagacccattatcgctattagagaaggaaattacaaatataggaaggaacaaaaccagaatgaatcctgtggtgttggatgggaattgattatatcagtatttactcacacttttatagatagatagatagatagatagatagatacagaaagaaatataaatataactgtgttacatatatatgtctatacagattccctcagctgtgttcactcatagagcctgagaatagagcctggagcagcatcttgttattctggaaaggaaggatgtgccaaaagccaggctaaaggggctcccactggccaaatctgtacattttgaacaacaaaataaatagtgatagtaatagatttataattctttgaataaagtaggaaactataagtctatgctgatatataaattatgctgataaatgaataaagttttgtgagaaacaggatttttacctagtctcaaaataccttctcacaaaatgcttatcaactaaagtgggaaaaggtaacttttcagttgaggagccttagcagacaccacctaatgaagtggtcgattcaccatcaataatgggataattcagattcatgtgccacctaacagagtgcattgagaacacagcatcatttctgtgttactctttccaatctaatcttaaggaaataccatgcaaaataaattgagggacattctaagctacagtatgaaggatatgaaagtcaagaaagttgacgagaatgaataagactagcatttgatagcacaatgtgactgcattcaataatttaattgtaagttttaaaataactaaaagagtatatttggactgattatatgtaacataaagtataaatgcttgaggtgatggataccgcatttaccctgacatcattattatgcattgcctacctttaccaaaatacttgatgtatcccataaatatatacacctattacgtgcccccccccaccaaaaaaaaaaaaaaaagaagtaaagctaatgcatgattctgaacttggtccttttgttaaaggacattattgagacatttggtaaaattcaaacagggtctgaagatagtaatgtataaatgttaattagatgattctgatggttctgtcatgcttatttgtacagtacacatcagcacatacacaccgaagtattttgtgggtggtagagcatcgtgtctgctgcttattctcaaaaataactaaggggaggaagtttcatttactaacaacttttatgtaagcttgggacattttaaaaattaaaccgaaacagcaacaaaaaaggattgttttgaacctgaatgtggaaatctcaatgtcagaatatttaaaaaatggattttgtgttccatgtatagagaaggaaaaaaatcttttaggttttaagctgggttgtaggttttctgactggggccctgtacatttgtgtggcaataggttaacaagagaaaggcagacagaggtttattcacatgtgcattgcctatacacatgagtgtacccagagacgagttactcaaaagactgtttaaaatttggagtttgtatacctaacttggtagaagaaagagagggaaaagtcagggcacttatggtaagcaaatgactttttgtaaaaataaatgggtctttaggataatagattggagataggctactttgtgacagtgtctctctgggtgtggtgcttacttctgtctccagtaagagagattagagttgctcctggggagggtttttttgacaattgagttcttttaggaggctctgcttttaggcagataaggatttcagaaactgaaatgccttcagcacaaaataattcttatgccaaagtgtaatattttaggatagcatatcctgatccaccttcacatgcactgggaaacttctattagtttttgaacagtggagtgtaatgaagatgatgttcttgtatggatagatgggagcaaagagaaactagaggcaggggtatcagttgggagccaaatgcttatgtgttcatccacaggaatctaaactgagatggtgattgttatgggcagaaagaaagggatagatacgaggcacattctaaggattatcttttggaatttgttcactcttaaaatgaaagtgacagaaagagaaatagatgatgcgtagtacaaataagttcacattctggaccagaacagggcgtattcctgaacttacttgaaaataatttgatgacatcttactgtttaatgtaaatgcttttaatgtaaacaagtagcatttaattacataaattacttagagttcttacactttataggctttcttttcttatacttgtgttcctaaacttgtgaccgttttgtactgatgattgggtaagtcaaatcatcaaatgacgtaacttcgtttgtttttccctctctttttgagacagcttctcactctgtaatccaggctggagtgtggtggcacgagctcagctcactgcaacctccgcctcctgagcccaagtgatcctcccacctcagtctcccaagtagctgggactacagtcacacatcatcatgcccagctaacttttttgaatttttttgtagagatagggttttgccatgttgcctagggtggtcttaaactcctgagcactagagatccacctgcctcaacctcccaaagtgctgggattacaagcatgagctgccatacctggcagacctaacttctttgtgcacatgttatatgggttacttcacatgcatgaattcttttaaagattttagcttatctgtaaggaatatactatatactatgagcatttaaaaatacttttcctgtatcaaatacaatgtttattgtagaaaatcaaaatatggatgagccaaaagaaaataagaacatcccttatttaagaacatttaaacatcttaataagaacatttccatatgcccagggctactgtgctgctttagtcttctgctctaaagttattctgcagggtattctgtccatagctaatattgggagaaaggcaatctaattaagcttatttacattaatgagtattggtaatgtgttacagtacagagaacctaggatttggaatcagaacctgaatcttagcagtgtgctcagccttcactacatttatgacctttggtaatttagttgacctcaatgattctcatttataaatgatttctcatttataaaatgggaataataaaacttgattatcaggggattggtgagtgtgaaataagatagaaaatgcacagtaaatgtagtttgaaatatgtaaaaaaaaaatgtgtactagggatcattgataatgagtgatggacttctaattcttacattatttgctttttgaagtttcttggtcacccatattgaccacagattgatagaatcttagctgttcatttaaaaaatatattttagagaatgaaaaagggaaaaagagttggtgtaggagtcactttggtaagcacgctgacatagcctcagtttatatactcagggatgccttcctagagctgttcctgattctctctttctttgaatccacctgatctctaaaagctaactctatgcccaaaggtcagtcagcctctccttatgctactctgctcctgctgcgtgatagttgagggtaggaaggcttttgagtttagagcagcgtttctgaagctttattgcttataagaatcatccaaggatcttgctataaaatgcaagttctagttcagatcatctggtatggtacccgagattctgaatttttacaaacttcatggccttgcctctgatctgaatattacactttgagtggagttaaaaaacatgaatgatgttttttatgtgactttttatttctaaagctatttgtaacttagggtattactcatattgttattacatataccctttaagatttcatgttaatttcttctatttaatacagtcttgttctctgtgtaaagcctcaaactcattagttgccccagggtaataatgagggtaaccagtactagcataaagtggttacacaggagaaccaataccaaaggaaaatgtaactgatagtagcaaggtttttctttcattcttaaaactttgtcaacatctctcactaatagtaaattaaatgtgaaatttaaaatgaaattactagatatacaaatttgttacattttcaccatgttacagagtattcatgtaaaaatcacttatatttaatagccagtgtattcatattgttttaaattaggattttgtcttaggagagttatcaagttctatttatttctgtgatacaaaaaatattcaaatttatattatagaactctaaggaaatgaataccggatttagtcaaggcagaaataccaagacacaagggggcactgtcttaccataatctgactgattttaatttagctttttgtttgctgtgaatgtctttcgtttccaaaattctgtcttctttgtagttaatcatgaaagcttaaatattatacattcctctaaagctgtaatacttaaatcaactgagctttcagatttcacaaatcaaatgtgctcttagcaacatttgggaacctttcattgtatttggcgtgaaattgggaagagtggatgataattagagatggtgtaacacactgttagtgtttaggtctgcggtggggaaaatcactgtaaaaataattcagttgatttggagaaatatagtgcctctgttaggcagaaatgagttgggataaagattgaactgttataagctgcagctgcatttgccataaaataccaagttggtgctgatgaatgttttgtttttattgtcatggaaacttggagctggagaatggatattctattcatttgggaaaatagcagtgccttgcataaaacataagggccttccaaagcagttccttaaatagatattggctgaatataatccaaaaagttgaggaagtaaaagtgaaataaatgcaatcatttctggatcacttcttccattctcagtactaacaatgtaactatatattcagttattaagcttattacttctagaaagtttaattccagtaagcatggtatttgtttaacatcagtgtaatagttatctaaccctttagagctatctttatatttatttccttagttgtaagatatcttttgggaactctaaacctatatcctattaaacaactacttctgatccccaaatagtttgttttttaaattaatcctgcttatctgctataatctttcattgaaatattttaaagcattttatactttttttaaagctttacccaaaataaactcttaccataaaagcactaagtgagatctttgcatgttctagggaaaaaaaacagaaagtataaaataaaaaacctataaaggtgcagttaaatccttgtgcatattttataaaattatgaatggaaagagacagtcacaggaacagaaaatgcaaaggagttttgggttcagttatcacatatgtgataatagcaaaatacaaatatggaaaatgatagtaaaatgtagataaagtgacaatacaaattaaagcagagttcctaaactttataataggaaaaggggaaattgtgagttataatggttttaccaaaggttactggccaagtttcattatctctgcaagggaaactagactttttttttttttttttaaacaaagtcttgctcttctgcccaggctggagtgcagtggtgtggtcatagctcatttcagcctccaaatcctggactcaacaatcctctcacctcagccttcgaatagctgggagtacaggtgcacgtcaccatgccctgctaatttttttttattattatttgtagagacacgatcgcactatgttgcccaggctggtgtcaaactcctgggctcaagccatcctcccaccttggccttccaaagtgctgggattacaggtgtgagccactttaccaggtcgatttttgttaacagtataataaaaagaaagaaagaaagaaaggctagagtggggttattttagatagtttagtcagagaacccttctctgaggaaataatatttgaataaatgcaaatgcacctgtagtcccagctgtttgaaggctgaacccagggtttggaggctggaatgagctatgatcacaccactgcactccagcctgggcagcagaggaagactttgtttaaaaaaaaaaaaaaattgtctagtttccctcacagacttaatgctgtgacaaaagaacaattcatacagaggggctaacaagccaaaccagcagccttcagtgggagggaacttggaaagttggaatgttcaaggaaaatgacaaaatacaagtttacaaaaattgttttttcaaaaaatgctcaaatggccaggcacagtggctcatgcctgtattcccaacacttgggaggctgaggtgggtggatcacttgagtctaggagttcgagaccagcctgggtgacgtggcaaaaaaaaaaaaaaaaaatacaaaatttagctgggcatggtggtgtgcacctgtggtcccagctactcaggaggttgaggtgagaggatagcttgagcctggaggtagaggttgcagtgagccaggactgtgccactgcactgcagcctggttaacagaatgagacctcatctcaacaacaacagaaagctcaaatgtacttacaagcattataactaacaacaacgtgaccagttttcccacgtgagacgggtctaggtgtagtcttaaatctatgtttacattgccaggatatacaaatccctcggagaaagaacaggagtgctttaagatttttcagtataaattttactgttagttagcatatagtttgtcaaaatattttaatgaaatcagtgactttttaaattgaatataaaagtgtcaaaataaatgtaaatatgacgtagcttgcatagtgagagacagacctctaagaagcagtaaaatttaataatagcaattttcaccagtgtttttcatgccctgtggttatctgtagcatatatttagagtatatgtatgtgggcaagggttggggccaggaattaaagacctacacaacaaaatacatgatactgaatttggagaactggtcacaacatgccaaagaaaatagaagagaactaggaactggacattgtatttcataactgaaatgatgagaaagaactggaaaattgccagccttttaaccttttagaaatagctatgtgtgtagttagtacaggagatcattttcttagagcagtttgttctaaattcaaatatgtcagcagacttagtggaattcaaagtattttagaaataaaacatctaatgttggaaataagagagcacaatatcataaaaacagaggtagtttaacaaagtttttagattgtccaagagtttatcaaacccattatctattatggtaaagtctcgctgagtaggatgtttttaacttaggctactccaaaaagtaaagatagtagcaaatgtagatccaacttttcaggttatcttctacctcatgcactactctaagcagtctttgtttgttggaaagtctgattatttacagaagtcaagttttgttatgttctatctttttctgatctgtaaaaatgggtttgctagagaaagactaggagaaagcttttttatttttttcctttaaagggggtgtgtgaaagggtttctaagaggtataaaaaccttaggaagtttcatagtggtcctaactaaatcattacttttcagacatttgacagtaggcactccatgagagcaggaaaacaaggtgagtcctgaagttacccccactctctcactgcctgtaggaagattctgggccacagcaaaaagacgagataatcaaacgcagcctggcagtctttgtgagttgagaagacaaaaatcagaattcagagaagctatgggactaggatttatagggtaaaaaggaaggagcagagagagagcaagggagctcaagatctttagagtttggttccaagtctttggccaagtactgacatgtacatgcatgtatatgcatgagaggaaacaacttgagaccagggaaagctcacacaaagctgggaataattctttctccaatgaaccaaagtggaaagatctcataattaacagggcatgtgtagtcttcaaaagggtattgtgttggtggtgctgaattagacctggactaaagggtattcttgacccactgttagaaatattaaaggcaaacctggaaaaggagcaaactgattccaagtcacttaactgcttgccagaacaaagtctgacattctttgaaggaatacagcaaaatctagcacccaaaaatataaacattttaaggtctggcattgacttaaaaattactagcatgaaaagaacaagaaaaaaatgtaccctgtaacccagagaaaaagtaatcagtagaaacaagagtccaggaaattagagagatgatgtaatcaagcaaagatgttaaaatggcttttataaatacgcttgatagctcaagaatgtagaggaaaataatgaataagatgtagggataatgaatgctatgaaaaaaacggaatttattcatttacctcttttccctccctccctccctgtctctccccctctgtcccttccttccttccttccttccttccttccttccttccttccttccttccttccttccttccttcttcccttcccctccccttttccttttcctttcccctttccccttttttctccttttttggaggcaggtctctctctgttacacaggctagggtgcagtggagcgatcatagctcactgtaaccttgaactattggatcaagtgatcctcctgcttcaccctcccaagtagctaggactgcaaggatgcaccatgcctggccaattttttttttttttttttttttagagacagggtcttactatgttgcccaggctggtcttaaactcccagcctcaagccattctcctgccttcgtcccctgagttgctgggattatatgtgtgagccaccacacccagccccctaaatgtcatttttagagagaagaaaaatacagtatctgaaatgaaaaatacactggatgatattaactgcagcttattcacttcagaagaaaaaaaatcagtgaatttgtaggcatagaaacagaaactatccaaaatgaagatcagaggacctccagcttctatctagggtgtggaaaactataaagaatgctgcttttggccaggcacggtggctcacgcctgtaatctcagcacgttgagaggccaaggaggacagatcatgagatcaagagatcgagaccagcctggccaacatggtgaaaccctgtctctactaaaaatacaaaaattagctgggtgtggtggcgcatgcatgtagtcccagctccttgggaggctgaggcaggagaatcgtttgaacccaggaggtggaggttgcagtgagccgagatcatgccactgtgccactgcactccaccctggcgacaatgagactctgtctcaaaaaaaaaaaaagcctgataaactacaaacttttaacttttttgaacccttcaaagaggcccaagcacacagtttctgtaagtactgaggctgaactaaaacagcagagaactacctccgtcacaagcctaaggagtactaagcaatagcagtctgccactggggcaggggcaaaagcttgaggacagacccactctcaagcacaggtttatagcatctgttataagctgaggatgaaatactaacagaaaagttttacagcaccccagccacgtgctaaacactaggcacaacaggtgatcactagagggagtggaagcctctggtaaactcagagtcatcacagcaacagtcacaccaagctaaactcctaactgattgtctgaatttctcactctaaagtccttatatggaaagaggcatacccacttccaggcctaaatatactactgttctacccacagtatcctgcatccatcaaaattataagtcacacacataagcaagagaaaaacaaaacaaatactttcaagaggcaaaacagttaacaaaacaagactcagaggtggccctgttattggaactatcgaggcaaaacagttaacaaaacaaggctcagaggtggccctgttattggaactatcagacaaagatttgaaaatagctctggctaagatattgaaaggatctagtgggaaacatagcatgcatgaattaatggggaatttagctgatagatggaaataatgagtcaagttgaaatggtagtaataaaaaaaaaaacagaggtaaataattcctttgtggtcatcagtagacaacccagttgctgaagaaatgggtgaacttgaatataggccagtataaattatccaaactaaaacacaaagagaaaaaaaatgaaaaaagatcagagctgcaggacagtatcagtctaatatgtgtatgcttaaagtttcagaatgagagggataaataataatgcagaagaaatatttgaagagataatggccaagaatttcccaaaagcaatgaaagacatcaaaccatagatgcaagacttaagaaacaacaagaactcccctccacacacacacacacaccacacatattcccttagacatatttaaagtgctgaaaaccaaagatgagaaaatcttgaagacaaccagaggcagaaaaaaaaacacatcatgtatagaacaacaaagataaactacagcagacttctcttcagaaactttgcaggcaagatgatagtgatatctctaatgtattacaatttttaaaactgtgtcaacccggaattatttatctgttgaaaatattttcttaaaaaagaggataaagacttctagatatatgaaaatctgagaaaatccattcccagcagactacaataactgctggagtaagttcttcaagcagggggaatgtcactccagacagaaacttggatctgcaccaagactccgcaaacttttttcatagagagccagatattacatattttaggctttgtgggtcagacagtttctgtcacaactactcaactctgccattgtagcacaaaagcaactatgaacagtacataaacaagtgagcatggctgttttccagtaaaactttatttacaaaaacaggaagcaggccatgagtcatagtgtgccaacccatgatctatacaaagaaatgagagctccagaaatggtaataatgaaagtaaatataaaagacatacgtttcatccttttaaattacactgtgaaataactgtctaaagcaaaattagtacattatattgtcggttttataaaatatgtaacagtaatctaaaagatgggaggaaggatttaacatctgttaaagatgtatattgtaaactgagggcaatcgctaagaaattaaaaagaaatgtaacttatctaccaatagtggctattaaatggaatgctcaatctaaaagcaggctgagagctgggcatagtggctcatacctgtaatcccaacacttggggaggtgggaggattgcttgagggcaggagttccagaccagctggggcaacatagcaagactctgtctctccaaaaaaaaaaccaggtatagtcttagctacttgggcagctgacatgggaggatctcagcccaagagttcaaggttgcagtgagctgtgatcacgccattgcattccaccctgggtgacagaagaagaccctgtgtctttaaaaaaaaaaaaagaaaagaaaaaagaagtttgagaaagataaaagaacaaacaacaaatgagataaatagtagacgtgtaagaaaatggcagacttaaatccagccatatcagtaatataatgcaaattttcaaaatgaaacagagataccaagagatagaggaagcaagcatttggcttttttcattctctgttttccagtggtttttgcacataattttaagaatagggtcttcgctagatgaaaacatttaaatagtgaactacttaacatctgtttacacactgctaaccctggcgctcctttttactgaataaaaatggtttgcccttctttcccccgtgagcttcaaacaacaaccaagctatcttggttgttactaaagttactaaacttgggaccatcagacccaaggtgctcccctaaaaccactttgcccaaaccttagggaacaaggaataggcaggctaaagattatattcaaacatatctaccctttttcctctatgttacaaaatctaaaactctgttgaaattcattttagactgttcttttatgtttcgacttctcagctctctctaccaccttttctggatcttgcatactttctttggtgaatctttgtttttttcagttgtgaacagattatggctatgtatacaaagagatccagttacccattcattaatgctaagaagagtgacgccgttaaattttaatgaaatgaaaggcataaagaattttaaaacctctgaaagtatccaaaagtttcctttaaattctttgcctagaatctaatttttttctcttctaattaagactttgtccttaagcatgaatatttaagatatatatagtcaatatagtattgtataatatagtcaaatgtattttctagtcagtacatttcagttcaaaaataataactaaaatttaattaccccttgtttgtcactgttccacgcacttaagatgttaatacattttatcctcacaaaaaacccagtgaggtagaactatttttatccttgtttcacagatgaggcaactaagggacagagctgttagataataagcaacaaagtgggaatttaaacctggttagtctacatctagagtcttcgttcattaccattaccccatgccttctctctaatttactgttacagaatgttgggatttttttcttttcttccttccttcattttttccttccatccttcattcctcattcctccattcagcaaatattctattctgacacactgtgacctgaatttacttgtgtatccagttataatgagttaatatgtaagatttttattttgagttatgccttactcacaaatcaactttggattatgacccatcaagaagttgagactggcctttacctattttcaaactcaaacataggatggcagtaaattgcaatactggagacagctcaatgaaaattgaacatgtcatattttgtcctcatgtagcaagaaccatatttaagtcttagcaggccaggcatggtggctcacccctgtaatcccatcactttgagagactgaggtgggaggctgacttgaggccaggagttcaagaccagcctgggcaacataagagacccccatctctacaaaaatgttgtaaaattaacctatgtgggtgtgtgtgcctgtagtcctagctacttggaaggctgaagcaggaggattgaacccaagagttcaaggctatcgagcgccactgcattccagcctggacaacagatcaagaccctgtcattcataaataaatgagaacataaaacacatgcatacagtcttagtagaacctaaatgggatttaaggctctcttctgggctttctccatgtgtttcaacaaaatgaaatagttaccatttgatggctatttatgtattttctttatacacaaagtgtacaaaatgtgcttcatttctatattacataggtagaggctgttgagtctcagtaaaaaatttcattgacattttgtttttcttaatctgaataggattaagtcttggtaattttaaatatactgacttcagtttgctgtattcagcaaatatattcacagctaaatgtctcaaaatgtattaaacaagtgtttacactttggttttataactgtacatcatctttattacaaaaatccctatatttttagcagcttatcctttttactatgtgcagtgtccaaattaatgttccaccagaagggtatgtcttattaatagcgaagagttgatgagcatatcaatttcatgggacattaaaagaaatcatttaatccacacttgccccacctcactctattttttaggtaaaaaaaactgaggtctagagaggtttaatgacttatgtatctcacatagctagttcacatcagagacagaaatagatcctcttgactcttatttccatgtttgtttcattccgttggcctgtttatgaccaaatagttgatgaatggtagcagttccattgactagtttctttccttctcttccagttcttgctgtcaggggaactggctaattaacaatcatttattatacactattttagagcacagttctcttaagctgtctctctgccttcatatggctttatgccatagatggaggcttggagtagaatctgtccctggcacgcaaacaacacaagtctggaattccagaccagtgttctctgaacaagtggcatctgccttctggtccctgggtgccataaaaaacagagttaaacactgaccttgcctggtaaggtcatggtctaaattaaatagtcaaaatacaaaaaagatgtgaggtaataatgggatttagcaacagtgagcctaatgttctgcttatcattgtataatgcaagaaatttcttagacgagcattgatacaaggatttggtggaaacagagtcagtgtgtcagaaggagtaaattatttaagagtgtgaatactgagatacattaatgtcaggaaggaaatgagatgccaaaagtagatgtatttgataatttgttccctctatcttcccccaaattatttggtgatgtgattgttacttgactttctttttctttgttttggagtaagtggagtaaatagggttaaggcattgaatgattatctcagtttatgtagtccttagaaagttgtaaaccattaaattattttaaatcgttttttaagaatgagataaacattaagacaccaaggtgacttgattatttttaaagagtacacattcatgatgggtttttttttttcctgaaaaacagctcccctagttctgtaatcttttgacttgctgtaaaaaatgaaaatgtctttatttctaaattctaaacaacatgtggttggggaaatgtggtgacattaagaaaaatactcatattctgaactttaggcaaagcaacagtgcaatacagatgtaaattatgttatcaaggacaatttagaatatacaactgttaagaaaagtgattccaaagtggaaattagattttgagctacctttaattatagtttacttcttttttttttttttttccttttttgagtcggagtcttgctatgtcaccacccaggctggagtacaatggctcgatctaggctcactgcaacctccaccttctgggttcaagagagtctcctgcctcagcctcccgagtagctgggaccacagttgtgcaccactacaccgagctaatttttgtatttttagtagagatggggtttcactatgttggctaggctggtcttgaactcctgacctcaggtgatccgcccactttagactcccaaagtgctgggattacaggcattagccaccgtgccaggcccagaatgttctggtcagtgactgaaattgatcaaaatgtatttatgtaattcttccccgttcattcatttagaattttttactacccacccacctcaccctctcaaattgaattgtgcattttaatgttctcttctggccattctaatgatggaaatgtaaactgttttctataaaccttctcatcctcacctatttatatttaatttgcaaatctgatgttaaggggagagaagtggagagcatgaggaagggtagttgagttggtgaatgttttgcatcctagaatacttcatcacagatgttaaagtctcagaaagtcgtttcttttttttttttttctttgagacagtatctcactctgttgcttaggctggaattcagtggactcactgcagcctcgacttcctgggctcaggtgattctcccatctcagcccccctggtagctgggactacaggtgtgtaccaccatgcccagatgattttttgtattttttgtagagttgggtttttgccatgttgcccaggctggtctcgaactcctgggctcaagtgatccacagcctcagcctctcaaagtgctgggattacagatatgagccagtgcacccagcctagaaagtcatttataaagcctattcaaattgcccaggtctgactgtgtgcttttatcagggtaataggatgctccattggcattttagcacttctgccagaattattgattgggaagctgcttacagttctgatgcacatcacaggaagctggtgcaaaattaagatggcatatgtgatgagataaaggctgggttagaaaagtgattacaactgggaacttgctaatcactgacctctatagggatcctgtggtttatcactaatctcactcacacttggcattttcctatgctgctgcctcatcattcatagctgtgtgagtaatttggcatggagtgaacaagaggagggcatagagagtccagcagctgtgcctgttggcactagatatttaagcatcttcactgtagccagcagtgtggttggcacaaatgttagccaataatgcttaaacaaattgttgtgaagaaaataggcaagcatttatttaaaaatcccctttctcttttctttaaaaacaaaaaatctggtcaattaagatcctttttagattctttttctgtacatttgagcagattactaccaaaataaagtctataattctgacagtatcttctagacaagaatttctgaatagtttattaattaaactgtgcagggtctgtgtgaggtacatgttatttggttgattttcctaaaagagtgagtggggtcattgatgttaagcgacatgttactttcctagttgactcaatgagagcgaagcaagagctaagagacgaatccagtaatcagaattcccaggtctttgctctcatactctatggcattgcaggtttgcccactttgtaagttagcattttgtgtttctccagatggttagtatgattcaaattgtatgatattttaataggatttgcccacaaaagaggagcaggttctccacgagcaaaaaggttaggtaaataatgagttttcaaagacactcaagggggaggaggatagtctgctcataaaactgtcatcagatttagatttgtgcacaaatatttagatttgcctatgtaaggatttcatattgtttctctgaaaagtaaatatggaaaagctcacatgacttacacactgaaatatttcattttgaacatagtaatgttgatctcattaacttttttgaaacatccaggaattgtttctaggttaagcttttagcttttaagaaaaaccagtctaatacttaaattataacacatggagtttttctgtgtaaaatatgctgaattcaaatttatgaatgcaaatcagaatgtcttacaaaaatgaacagaaataatgttggcttccatacaaatagagaagctattctattttgtactgttgtgaaggcaacaattgtttcttgaatagtatctattcattgaaactaataaacttgtctggaaatttttaggtatttactggactgctgcagaaagaaatgctgagcaggctttatatgccataatatcattatctctgtctgtttcctcatcaatacattattttctattgataacaacagagcacacaccatgagagtattgtagaattgctttggtctaaatttgggtgttgaaggcagagtgaaactgaacaccattctccaagtgtggattgtggctaatctgctctgaggttgctaatgaagacatacctgggactgggtaatttttaaaggaaagaggtttaattgactcacagttcagcatggctggagaggcctcaggaaacttaaatcatggtggaaggagaagcaaacacatccttcttcacgtggtggcagcatggaaaagtgcagagcaaaggggggaaaagtcccttataaaaccatcagatctcatgagaactcaccatcataaggacagcatggaggtaaccacccccatggttcgattacctcccaccaggtccctcccacgacgtggggattatggaaactacagttctagatgagatttgggtgggcacacaaaccatatcaggcaccttctaacctttgcggtatttttagtaaatatatattatcaaatactagatttctgtcactaaaaagagctaaatgtctaacaaatgtagcagtacttctaaaacttggtcatccagtaggctataagctttttcattgtttggcacctattgagggtagagcttgtgggggtttttttgtttgtgttttgttttttgttttttgaggcagggtctcactctgtctcctaggctgaaatgcagtggcatgatcatagctcactgcggcctcaaactcccaggttcaagcagtcctcccacctcagtctcctgtgactacaggtatgcaccaccatgcccagctaagtttttttttttattttttataaaggtcagttctcactatgttgcccaggctggtcttgaactcctgagctctagcagtcctcccacctcagcctccctaagtgctgggattacaggcatgagccacagcacccggccagaagcttgtgtcttactcatctcctaacctcttcatctgtcagtgactagcccataaatgtttgatggaatgtatggatcttagattcttctgtccagtcaatgtttggatatttgtaattgagatggggagaaatgggaatgtagaactgtgcctgtccactcccaccttcactgtgactgccgattgtatcttatgtcaaaagaatagcattagtttgtatttctgtaagcattgaaaggttataacttaagtatattagtggtagagagcaagataacttttttttaagtctgagaatatttgttagggtaactaatgcctctaagagtttatgagtctggagaaaataatttcttgaacttcagtcatttgctgtttcttgaataaatgttttaaatactgtataaattagtcagaattatctgtcatttcttgagcaatttttagtttaggtcagaaaatgctgaatgtagttaatgtaaaccatgtaagtttagctacttaaaatacctttgcacacaagttatgtgtctgatggtttaatatacatatatatgtcttattcttgtatattttccaataatatgttgctattctactagagttgggtttcttaacctggagtccagagaatcccaggacagaaggaaaatcagtgaacttgaatgggaaaaaattgtcatctttatttttaccaatctctaagtgaaatttagcatggccttccattttgaatacggataacaaaataatccagacagtacctacagtttttgtcacagtagaacaatagatattttcatatcataattgttgcagatatcttaagctattatttatgctttcaaattattattagtcctgctgctaaatcttattaatgtgttaataaattacaggaaatgtgaggtttttaaaagaacattttgatgattacgtgtcattgtacattaaaatacttacattttgttttgtacatttataatcgtgattctgagaagtccgcccaagaggcccatgcacatgtgcacacaccgatacctatacacactcacacccccgcaacacaagagtgtagtaaaaaccctgtattagactatcccagagaattctttgtaataattttttcataggtgcttcaaggaaaattagatatatgttacattactagtagttcttaaactgttttcagctgaagttgactggttaaaattgtctatacttcatttatgtatatttatgttaaaaaaaaaaaaggttggtagaaacccttaatacagtagccagagatttttgttgtcagatgcctgagataaaagaaagataatgtatatgattaattttaattcatgaaaatagttcttgtgaaaagtaattttgaaagaattaaaaatgaatgcctcctaagtcttagactgagtatgcattattttatttcaaggatactcaaacttataagtccttaagaaaataactagtttctaataaatgaaaggtgaaataaaaatgtatttacagttcaaaatcttatttgaatagattaagtatcattttgaaaataagctatcaactttcatttcagaagaaacttttactttgtaacatcttcagcttatgttaaattagttttcattctctttgaattcaatgtcctttatgaaaggataaggaattttaataagcacaggaaagtaagtttaaaactttaggttttttaaaatgatctatcatatgggtagcctcgacacagataattaagattgtatttaaaagctgtacattattaaaaacagagctaatattcacctttaaccttgttcctttttccacttcaactttttttttttaaagagttcttactaggacatttgattcaaaatacaatacagtattaacttgtgatggagtgtggtggctcacgcctgtaatcccagcactttgagaggccgaggtgggcagatcacgaggtcaggagttcgagaccagcctggccaacatagtgaaaccctatctcgactgaaaacacaaaaatttgccgggtgtggtggcacgcccctgtagtcccagctacttgggaggctgaggcaggagaatcactccaacccaggaggtggaggttgcagtgagccgagaccatgccattgcactccagcctgggtgacagagtgagactcagtctcaaaaaaaataaaaaataaaaaatgtagttcactaattaaaaaaactctacaggtgaataggatgttcaaaattgtttattgatatgatacataattatttttaaaaaccttagaaatagactagtatcattttcattaaagtatacatgtcatgctgactaattgacgtagaagttttacaactctaaatctgacatctgttaaccctttagatatgcaaaataatccttgaaataataatgctaggccaccgtggtagctcatacctgtaacgtcaacactttggaaggctgaggtaggagggttgcttgagcccaggagtttgagaccagcctaggccatactatgagaccctgtctctactgaaactgaaattttagaaaattaggcgtgttggcaaacacctatggttccagctacttgggaggctgaggtgggaggattgcttgagcccagaagttggaggctgcagtgagctgtaattatgtaactgtgctctagcctgtacgacagagcgagaccttgtctcaaaataaataaatgaattaattcaataaaactagttactacaaaataaaaccattaaaggattgtacacttgcaattctgacatacacagccttccctgcatgtaatcaaaatggatcagaaatcttcttggaacaagaagatggcagagactgaagggaactgccaacttagaatgactggcatagaaggaattactgaaactcagggaaggtaattgtgttcttctttggcaggtccggtttctaaatagatagggaatttcagagaacaacttcattctgtgctttgcaaaaaacagaagattgtggggaggggtctggtggagagggcatgacttagagagaccttgaggctgctgcttcaatccagcatgtcaaagcaccatgtttgggggccttagttactgagcctcaaaaataccacatttgcaaattcatttagtatattgaatacaaatgagtgagtaccctactgttaattgttaacgctgtgagacttaacctccattctccctcaagaactggcccatactattactgatacttggccatgaaagttttgaactgtgggtgtattagttcgttctcacgctgctaataaagacataacccaagactgtgtaatttataaaggaaagaggtttaattgactcacagttcaacatggctggggagacctcaggaaacttacagtcatggcagaaggggaagcaaaagtgtcctccttcacatggcagcagcaaggagaagtaccgagcaaaaggggaaaaaccccttataaaatcatcagatcttgtgagaactcactatcataagaacagcagcatgggggtaaccgcctccatgattcagttacctcccaccaggtccctcccacgacatgtcgggattatgggatctacaattcagggtgagatttgggtgaggacacagccaaaccgtatcagtgggtatagtcacaataagaatttttttttcttttttgttttttgttttgagacgagtctcaccctgtcacccaggctggagtacaatggcacgatcttggctgaccacaacctctgcctcctgggttcaaatgattctcttgcctcagcttctcgagtagctgggctaacaggcgtgtgccaccacacttggctaatttttgtatttatagtagagatgaggtttcaccattttggccacgctggtcttgaactcctgacctcaggttatccgcccgcctcggcctcccaaagtgctgggattgcaggcgtgagccactgccccccaccacagcaagaattcttacatgttgctgggaagaatataaatgggcgtggtgacttctgagaataataaggcaatcaatgcctataaagctgaaagttcgcatcctttaatctaccagtttcccttctttgtgtctatcctgaaggaatgtatgtctgtgtgtgtgtgtgtgtgtgtgtgtgtgtgcgtacacgagatgtgcaaggatatttgtttcaatattgctcatgacaaaaaaatataaaaactatctttccgtagggaaatatataaactggttttatttgtataatggaatattgtatagcagtaaagatgctcaaactagggatctgttatcaacacacagctcaaaaacataatatatggaaatacaggtttcaagataaaaaccatgtaattccatctgtttaaatatattaaatgcaaacagtaatgtatattgttcgagaacatgaatatatatttaagagtataaaacatacatggtaatcatgcacatcattattatgataatggttatccagaggtgtggtttgagctatgtctatactgtattaatttttttttttttttgaggcggagtcttgttctgtcacccaggctagagtgcagtgttgtgatcttggctcactgcaacctccgcctcctgggttcaagtgattctcctgcctcagcctcctgagtagctgggactacaggcgcataccaccatgcctggctaattttttgtatttttagtagagacagggtttcaccttgttagccaggattgtcttgatctccttacctcgtgatccgcccgccttcgcctcccaaagtgctgggattacaggcgtgagccactgtgcctggcccaatactgtattaatttttgagagagaaagaagagaagaaggttcagtctgaagcaaacatgggaaaacattctaactagtgggtacatgtatcatattgttggctatataaatgtctttcattcttttaaatgtgttttaaaatactatacgttgaaaataaagtatttacatgctactttatatagctcaagtgatcctcccacctcagcctcctgagtagctgggaatacaggcatatatcaccatgctaattttttattttttgtagagaggcttcactattgcccacgctagtcttgagctactggactaaagcagtcctcccacctcagcctcccaaagtgctgagattacagacgtgagtcactacatcctgcccagaatttgactcagactgactgaagtgatagcaagttttacaaattattgaattgtatcctcttatttctaatttgttctttctattttaaaactgcaatataattaccatgaatagtctagcagtttgattgtctgtcaataaatgaagggttttatataaagttaatttctttgttttataggaaaaacatcagagagaggctcattttccctgtacagcagagatactggattaccaggctgtcaagtaagtttaatgattaaaaaaagcaatgagatggtttttaaacacataaataaaggctctattaatagatgagatagaaattatccaatttatttcactactgtttgtttaatttgtaactaagtgttgttttttgctctctttgcttaaaattgtttcagttccccagtttaccaggctgtctttatcatcaaagattttcataacccacctccattttaactggaaacaaagctaccgctttccaaaatgcttgtcatttctgagaaatttttttgcatattttctcacagaaaacgtaattggtggtacataaagaatatatgattgatctgcatagcttaaatatcctgtaatgtcaaactgatcattaatattggaagtattttgttttcaatcctgcatgtaaccaatttttaggcttcacaccctccctgacttggaatctttgtttcgactctcccaccttctctagcattttgtgcttctgctaatgggcatcttttctgcctttttcctcatatctttagactgagaatcctgaacacacaattcacctgcagattcccatcagaatcaagccaaaaagaatagaaaggaaaggcagaacatattaaatttgttttctgccatctgcatgctctacatgagggcccaccctaatttcaggcatgggcatgtgagccggttttaactgccatgctaataatactccatttaatacatatttcataattgtgcctctaagagagttttacataacatcctgttttgtgatatgccttcccattataaaataatgtattgtagtaggctggccacggtggctcacgcctgtaatcccaatactttgggagactgaggtaggagaatcacttgagctcaagagtttgagaccaacctgggcaacatagtgagaccttgtctctacttaaaatgtaaaaatcagccaggtgtagtggtgcatgcctgtagtctcagctgcttgggaggctgaagcaggaggatcacttgagcccaggagttgaaggctgcagtgacccatgattgcaccactgctctccaaccagggtgacagtaagactctgtctcaaaaagagagagagagaaaggagggaaggagggaagagaaggaagggagaaggaaaggaagaaagagagagagaaaataaatatattgtaaaaattcaggatcatatattcccatgtccttaatggcaaataggcatggtctgaataagtgatttgttaaatatcatagatttgggggtagttactggaccaacactcagatttcttggcttcagaccaagcagtcttactctattttcatccaagtgattttttaaagttttagtgttgttaatgattgctctattttccgtttatggttagctttattttattctagtcatttaaaatatatatagattagcattgtgtcatagccagtgttttgccttaccagctcttactagctgacaagagccgaatctgttaaacttttaggaatttagcaagtatggttgacatcacactgatatcttaaaattggctattatgagctgggcactgtggtttatacttgtagtcccagctacttggaaagccaaagcagaaggatcacttcagctcagtagtacaagtccagcctgggcaatgtagccagattgcatctctaaaaaaaaataaataaaaacaagcaaaacaatggccatcaaggaagtatttacactgcactgtggaaattcaaaaatgttacaattcagggcttccatttttttaaacagttgttaaacatttaccagcataccgctcatgcctagttaaaaattgcagagaaccacagaatataagtgcttattcagatcacagtaaaaaatagaaaagcagcaattgaacatctagcccccattaaggtatctttctgacctttttcaaaggtaacagtgctttaaggccaaccaagatacacaatttattctgtatagttttagcaatatccattgatgaaaaccaaaatatcctcttttttggtccatatcaaatgtggattggtgattgtaatatttctgcaattcatagttgatatcagaactcattcttttttatgatacaagttactgtttgaatttcatagtctgaattttagttcataaatgacttggattggaggccgtggatctaatttctgatcttggctatagtactcattttgagagttttgtaggccacctaaccatcattcttctgaatctcttcagagtacaacaaaatttgaaaaactaagttgtggccaggcgcggtggctcacacctgtaatcccagcactttgggaggaggccaaggcgggcggattgcctgaggtcaggagtttgagaccagcctggccagcatggtgaaaccccatctctactaagcatacaaaaattagccgggcgtggtggcaggctcctgtaatcccagctacttgggaagctgaggcaggagaatcgctggaacccgggaggcagaggttgcagtgagctgagattgcaccattgcactccaatctgggcaacagagggagattctgtctcaaaaataaataaataaataaataaccaaactaagttacatcatttggacaatgaatgattgataaaagtaactacaaagaatcctgtaggtttaagcttctaagctgtgcaaactgcctctgtgacatatcattaagctaacttgtctgccaccctgcttcagggccttaaaagtcttttcgtcttcatcttaaatctaagatagcagcttagttaggcagtattgaatcttacatgtattctcataagaatacctcataaccataacaaatttgtttaattatcagatatatgaaagtgcttttctcagttcctaatcatacagtagaaggtcagtaaatgtcagttgaggggggtaagacagaggtttagagtgaagagacctaggttcaagtcccatctctgcactgatttctatctgaaagataggattagccatttctgcttctgcctacttagtagatctctgaaggttaaactgtatgggcttatgaaaacatttcaaaaaataaataaataattttaaagttctcaattcatgtaatccacataacaaaagatattttggatctttaatattatttttaagagacctaaatgtttgagagccactgggctaatgttaacattactgctaaacttgaggggggagaaaacactattgtaagctttttgagaccacagctaagtctaataaatcatagttcatgcttatattaatgtttttattatgttcaaatgttttcacttacgtatttataccctcttggcaaaggtattgctgtttagttagagtcagcaataagttctattaatgtaattgtccagttttgcaaaggtgaatcttaacagtttttaccaaggattaatgtgcatttgtaccacatttaattctcatatcaaaagacatttattttaaacctaaatgtgtagcgctctaataaaatttgctaccatttgctgagcactaactgaaccagccattgaactaaacataatcacatttaattcttttaacaacaactcattttgcagattagtaaacagaggttctcctaaggtattatgcttaaggctacatatctagcaagtggtaaacttaaactcatgcttgagtgttttgactatatgactatacttcagcataggaatccatcagatttcaactccgtgcccttattaccttccttcatttttatttgtttgagaaggagacagggaattaaaaattttttttttttttgaggcaaggtttcactctgtcacccaggctggagtacagtggcgctcacaagacctcctgggctcaagggatgtaaggtttagagtcaagagacctaggttcaagtctcatctctacattgatttcttcatctgaaagataagcagtttctgcttccacctatgtagtaggtctctgaaacttaaagtgtatgcgcttgtgaaaacatttcaaaaaataaatacataatattaaatttctaaattcatgtggcccacataacaaaaggttatttgggtcttcatatacctccctgagtagctgggactgcaggcatgcagccgccatgccctgctaattttatatatatatataatatatatattatataaaatatatatatatataatatattatatataatatatattatatataatatataatatatatattatatattatatataatatatattatatattatatattatatatatattatatataatatatatatataatatatatatataatttttttttttttttttttagagatggggtctcactgtgttgcccaggctggtctcaaattcctaggctcaagcaattttcctgcctcatcctgacaaagtgctgtgattacagacaagggccaccactcccagaggaaatttaaatttttaacaaatgtccaggtgattttgattcacatggactagagttcatgctttaagaaacccaactcctctgtgtatgccaactcctctgtgtaagccaataggagttatccttggaggaaactatatgattactgtttagcaaacagtttataaacattttggagagatcaggaaggcctatggaaaagagaagaacaaggctactagaatgtttgatacaaaataacaatattgctatatacaagatttaaagatattcagatgagagaaagatacctttttttttttaagaattcataggagcagttcgtgagccccagagaggaagcccaaaattcagcagagtggaaagattattctgcagcaaggataaactattcaaaggaaaacatgtattccagacagtatttattataatgagtcagaggagggacaaaaaatatactttaactaactggctgccattttgtcttacctattcacaagcgacaaaaaaaatccaaggaaatataaatagtgactccaaaattatacccaaacaccacattaaaaccatttttcttcaacagaattccccaaggagcattaactctgctattaatgtacataaaatgctgctgacatactgcaaaattcagactaatttaataatgcctgatgggccttacttcatgttaagatgatgtaataatatgttgctaaatgagtgtcatcatattacattcacaacaatcacattaactgatgagccattaaaaggaaactcatgtggcagtattactggaaacactgatagatcattctgcagttaaatttttttattgatgaaacacagagcatagaagccagtgtctttattaataataggtatatcactttaaaaactaccacagttaagtgaaaaatccttttatcagtataacaaagtttttcatttatacctcttaagcaagtatttattcacatagtttcataagtttttctctaagtgtttaaatgtagaaggtggcagggtcttggtttttttcagaaagtgtgaagttcatctgagttcagatattatacccttgaaaaaatgacagctttaaaaactgtaccttacttaactcttagttgtttggagataagcttataccatttggtttttccttgttcttttttcctgttatacccaatctcatatgcagacatttataataataaaataataaaagagttgatgtatcagaaagacataacaatgacagatgtgtatacgcctaataagaaagcttcaaaacgaagcaaaacaaaaattgatagaattaaagagagagataaacaaattgacaatcatgcttggaaaattgaatacttctgtcttagcagtttgcagaataactagacaaaaaacttagtaaagatgtagaacaaaattaactatcgacaaccttgacctaaatgatatgtatagaactctgcatacaacaactgaagaacataaattcctttcaggggcacacattacactaacaggctggaatcatacgctggtccataaaactagtgtcagtaaattggaaaggtttgaaaccatacagagtatgttctctggacacaaaagacttaaataaaaactctgatgagaactcagggacacaaagaaggcacctgtagacacgggggcctccttgaaggtagagggtgggaggagggagaggatcagaaaaaatagctattgggtgctaggcttacttcttgggtgatgaaataacgtgtacaaacctccccgacacgagtttacctatataacaaagctgaacatgtgcctctgaatctaaaatacaagtttagtaaaaagcaaagttgtattagaagtcagtaagactaggtgtggtgactcatgcctgtaaccccagccctttggaaggccgattcaggaggatcacttgagcccaggagttcaagaccagactgagcagcatagttagactctgtctctattaaaattaaaaaaaaaaaaaagaaaactagtcaggtgtggtggcaggaggctgaggcgggaggattgcttgagcccaggagttcgaggctgcagtgcgctgttattgcactgctgcactccagcctgggcaacagagcaagactctgtctcaaaaaccaatgtcagtaagatatctagaaaaacaccagatgttcagaagttaagcaacatgtttaaatgacccattgttttaaaaagaaaccacaggaaattcagaagatatttctaactgaataataatgaaaatgtgatataacaaaatgtgttggtgcatctaaaccagtgccttgaaggaaagtatacttttgaaagcttgtattagaaaagatgtacagtgaatgaccaagattctgccctaagaacttagctagaaaaagaaacacaaagtaaacccaaaataaatagaaagaaggaaatactacaaataagagcagaaatcaatgtaatagaaaaaactaacaaaaccaaaatttggctatttgaaataaatcataaagttaacccctagctagaccagttaacacaaggggaaggagaagagaacaagaacacaaattaccagaatctggaatgaaagagaggttactgctatgaatcatatatacattaagaatataataaatattataacttagtaaatttgacaacttagattaaataaatgaattccttgaaaaatacttaccaagaggagacaaattgaaacaaaatctgaatccatgtatatctttttttctttttttttttttagacagagtctcactctgttacccatgctggagtgaagtggtgctatctcggctcactacatcctccgcctcccaggttcgagtgattctcctgccttagcctcctgagtagctgggactacaggtgcccgccaccacgcctggctaatttttgtatttttagtagagatggggtttcaccatattggccaggcgggtctcaaacccctgaccttgtgatccccccgcctcagcctctcaaagtgctggaattacaggcgtgagccactgcacccggcctgtatatctattaatgaaagttaattcatatcaaaaaccttcccacaaagaaagcataagggtcatatggcttctttcaaaatgattaattctttcaaatgcttaggaaaaaaataataccaattttatacaagttagtttagaaaacagaggaagagtgaacatttctcagctctttttatcaggtgagcaacatcccagtaatactcaaacaacacgtgtggtttgtaggagaagtgaaagtttggtttaagatttgaaaatccatgtatttagttcaccacattataacagaatcaagaagaaaaacaatgtgatcatttccatagatacagaaaagatatttgacaaaattgaatactcatgataaaatctctcagcaagctaatagaaggtagcttcctcaatttgataaaagacaaacatgaaaaaaatctatggctaacagaatacttagtgatgaaagactaaatgcttcccacctaatgtcagcaccaaggtaataatttttgttctcatcattttatgttttggccagtgtatgaggacaagaaataaggttatagaaattgaaaaggagtaagttgaatttgctgatgacgtgtttgtgtacataggaaatcctaaggaatcatcaagaaaacttctaaaactaaatagtacttttagctatatcacaggatacaaagtcaatctaaaaaattaattgtatttctgtacactatcagcaaaaattagaaaataaaattaacagaatagtactgcttatagtagtatccaaaagcgtgaaatactgagggaagaatgtaacagaagatggcaaagcttcaacagtgaaaactcaaacatctgttggaaggcttactgtcacttagatgttagttcttcctaaattgggttatagatttcaaggccaccctgggcaacatagcaagaccctgtctctttaggggaagaaaacaaaacaaaaactaaaagacttctgcttatcaaaagacataggttaaaaaaaaaataaatcggtaagccacagtctagaagtccagtatttgcaaaacatatttaacaaaggactgatatacaggatatataaagcattccaggctgaggcaggaggattgtttgaggccaggagttcaaattgcctgggcaacttagcaagattcccatctctacaaaaaaatttaaaaattaactgcaggtggtggtgtgcccctgtagtcctagctactcaggaagctgatcactcaagtgattgaggggtatcacttgagcccaggagtttgaggttacagtgagctgtgatcatgctgcttcactccagcctgggtgacagagcgagatcttgtgtcttaaaaaaaagaattcctacaactctgtaaggttagctaaggcttctacagtttttctctttgtaacaggaggtttaagtacagtgaattagcaagtttccagtcccttctagacttatgttgtatggtaatgtcaagaacaagatcatttccactttgtaacaagattacactggcctgctgtttcgccaacaggattaattaaaactagttgtcttaaacagcaattttgatctttgtttatgtaacaacaaacctaatagtagcctcagtcttgggcagaattattagaaatgtaatatttagaacaagaaagttgatactgtattgtattctgagcaaacctgtttcagaacaggcataagtaaaccaactcattcagagaactaagaagttagttactcaaataacatgaagagcatcttttaagtgtttgaagcataattcgacttttctataactttgaaggttaaaaagttggacaataggtagaaattaagcattccagatttcagcttaattttaaaaagaaatgttgtcatgtgttgagctgttaatggcgtagaacattaaaccttggtagataaatgcctttctcccactggatgtttccaagcagagggtagacatctactttactggtattttataatagattacagtacctattgtttgactgaaataaaagaccttaaaaggggcatggtgttgcatgcctgtattcccactcctctggaggctgaggcaggaggattgtttgagcccaggagttcaaggttacagtgagctataatcgcatcattgcactccagcctaggtgacagaatgaaaccctgtctctagagaaaaagaaatagaagaccttaaaatgttcctcaattccgtgagctctctagtgacaagtaaaaggctttccaaatggtgttgatgatccatctgaggttggtgaccagaaattactgttgacactaacctgtatgattgtgtatgtgcttcaacttttattctaatactacccagcaaactacatgtataagcacagacagcaaatggttgaatcaatatagtgatcaggattgcaggccagttagctaggttaacaatgatgatactacataataactagcatgtatcagtcacttgaccctataagcataatttcatttggtccccgccatactcaagtggtgatattgttgctgctgttgcgtctgttattattattcctcccatttgatagctgaggaacctgaagcctcaagaagttatataattcacccaagatttcatagctggtaaatattagaaggataggagaattgatgtagtgataagagaatagttgaagtactagaccaggtttcaaaggaaggaaatgaagccatgattaaactttgtgactggaaaaaaggtcaagatattggttgttatgcagtgaaagagcaggtgcagtaagtaataagggaatgatggcactataagaaaaggaggttatgtcaaagagttgaatattggacttacagatttcacaagtcaagtggtttccagggctaacaatctagtcctcctttggggagtagattggtgatttagggaattgttggagtcacgaagattaagaagacgtaagactagctcttggattgatgtggaagctatccagagatgattgactcataaggtagcatgtgaaaggggcctacatgcacactagttggcacacagtaggcattgagaaaatgttgtttgaatctgaaccatgtgatctaggaaagagtatataagtaaggctaacaagccatcagctgcctgcagagtgatgtgcattttgtgggttgtttggaacataggtaaataaattgttttgtggaaagaaagtctgatcttggagtatcaggcaatagacaatttttttttttttttttttttgagatggagtcttgctcttgtcacccaggctggagtacaatggcatgatcttggctccctgcaacctctgcctcccaggttcaagcagttcttctgccacagcctcctgagtagctcggattacaggtgccccccatcacacccagataactttttgtattttcggtagagagggggtttcaccatgttggccaggctgctctcgaactcctgacctcaggtgatccacctgactcagcctctcaaagtgttgggattacaggcgtgagccactgtgcccagtcaatagacacttttaatgtcctatttttgttaaaaggccagagagagagagagagagagagagagagagttggattaggcagggcctacttggcagggaaaaaacttcattcattctttcttttatttttattttatttacttatttatttatttatttatttattttgtgaaacagatctcgctctgtcacccagggcggagtgcagtggcgtgatcacagctcactgcagccttgacctcccaggtttgggtaattcactgcagcctcctgggactacaggcatgtgccaccacagtcggctaatttttatattttttaggtagagatggggttttgccatgttgcccaggctgcattcattgtttctttctttctgttctctccatgaaaattgatgattatacttttgatgatacttagtgctcgttggaagcagtttcagaaagtccgtttattctttcgtaaacttatttcaggagaaaagagcctgttaaataatgggtagagatttgatgccatctcaaaacagaaaaaagaggtgacaacatactggctattacatgataagggattattgtcaattttggagcatgtaacaaggggtaggagatggcagaacaaatgaagccggaacaacagaatgttgacagctgtcatagctgggtgataggtacatgaaggttaattgtacttttttttcctacttttgtgtattatgaaatgttctaaactaagaagtttaatgttttgaagacgtccagtacgtaatgtttcattttataaagtatggcatgcctaactatatgtctaatgctatattgggtttttttactcttaattatacttacaaaaatacaaggaattgagaagagaggatacttagttgctccatgttaaagctagtattaaagagaaaaagagtggcttcaaagtattagaactcttctgaaaatagtagtgctacttaacaccatttccacgaataccaaagagaaataagatttcatctcctgttcttctaatgttagcacctcacacagctggcttctttgtattcattaaagaaaaggcgcaaaggcatactggtaacacataggagaacattcagttagccctttttaataagagagttgtaaattcaggcattcagaaaaactactcactttgaagtagacatgcttagagtatgctcactactaacctcacaagactgccttcaaaaaatcccctatagcatttttggaagttggactttttatggaagcctatacattcctaaaggaaagtcattcttattccatatttgtaattattcaaatattgcatatattaaaatgacatttagcttgttctcttcatatttcttttatttctaagaagtctgtctgtattgatctacatcccggatctctctactgtgatatcttctcattggctgataaaagatttgggagggaagttgagaaaaaaaaaaattagtgaaaaagaaaaattaagatggtaaaatttcctattgcgactaataattaaagaagattaggaaactgaaactactagattgtcacgttttagcactgtaatattacatgcatagtttattttctttttttgtgctagaaagactgggctgattgactgggcacgggactcatgcctgtaatcccagcattttgggaggctgaggcaggcggatcaagaggtcaggagtgcaagaccagcctggccagcatagtgaaaccccatctctactagaaatacaaaaaaaattagtcaagcatgatggtgtgcacctgtagtcccagctactcgggaggctgagacaggagaattgcttgaacccaggaggtggaggctgcagtgagcaggagaattgcttgagcctgggagacagaggctgcactgagccaagatcgtgccattgcactccatcctgggcgacacagcaagactccatctcaaaagaaatttttttttttttaaagattgggctgatttcgttggcaggatacatttgatggatgactgtcatcttctcaaacttgcatgacactttatagacaatatttattaagttttcaagaggatatgttgagattataaaatttgggatttgtaaaagaaccagtgtaaaagttggctagtggtggctggtggttttttattgacctaggaaaggattagaagcatctcaggttttctttcactttgtttttctgtttccccccttcttcctcccccaaattaatatattgtccaaagtgttcataatgacttggaactattcaggttgcacaaagcatttaatgaaatcttgtcttagacaaaacactagagaggatcataattaatgtctcattttctgccagttgctattgattactcattcaagatccctttgttctcagaatgataactgtagtttgcatcactatctaatgagattctcaggatagaattctttaacaacatgctgataattgctaacatatccctgaaatttcaatgtaaatgaatttgcatcataatacaattattttacaaatggcgatattttccaaatttgaaatgtgttagtttttttaatcatttgtagaaaattaacagaagactgacatattattaaagcccaacatttattttttgccctgagttgccctcacccttcgattttgatttgattatgacttggggtgagagacttctttatcattcttgggttactctgtcataatctctgaaacttcaaatggatttacagctaaaacacaatgatttttcgaaattagaacaacaactgcaaatatggtaatactataataattctccttttagaacaattttgtttcttgatccctcagtgacaaaagaaacacgtggtactatagcataaagaatctgcgaaatcataacagtttatgtattctgttataattgtgttttatacctttctattcctttaatttccacatactccctcccccaaaaaataaatcttttgaacagctgcttgcctttatgtatttaaaactgcataccacttcaggggtgtaagataggcttgaaattaaggaattctgtagaataataacacagcagaggttccatgaattcatatcagtattttaaatttttggagatatgtgactataacatatgaggtactctccatctaattttcttaaataaattaataggtagtacttccaaattttaatcataaaatgatgctaataattttttttttttttttttttttttttgagatggagtctcgctctgtcgcccaggctggagtgcagtggtgtgatctcggctcactgcaagctccgcctcccaggttcccgccattctcctgcctcagcctcctgagtggctgggactacaggcacccgccaccacgcccgcctaattttttgtatttttagtggagacagggtttcactgtgttagccaggatagtctcaatctcctgacctcgtgatccgcccgcctcggtctcccaaagtgctgggattacaggcgtgagccaccacgcctggccgatgctaataatttttgacctacggttaattaggcccttatttgatgtgaagttatgagtggcttggcgtttaagccaagccacttaataaaacccagttccgacaaagtaagcctgtttttcaacacttaattttccctttctgttttttttattttttattttttggtctcactgtgttcccccgactgacctcaaactccgaggcttaagcagtcctcctgcctcaccctaccaagtagctgtaactacaggtgcacatcactgtgcctagtttattttcccttttgagaataaagaatatccaaattatagcagtatgattctgaatcgcctcctagcttactgagcagcaccattttacataggatattcttctgcctccctacaaaatcatatttagagtaccttctaatataattaacaagagttcccattaaaaaaaggatgttggccaagtctacctactactttattcctttcatttactttttgtttattatcaccaccaaagcttacactcatcaagttcacatctggaaattaagctgtttcttacagatgaagagggagaaaaaacttaaaatacatgtatcacataggctgttaaagttccttatttttaaaaattggaaattttgttcacaggctagaggtttgtcatatgtaattcaaaatataacttacttattgtagattttatcccataacctagggcagtcatctaggctgcgttagtgttttgggggataaccctttattaattattctctagtattagatatatttttcacagagaaaaatgtctggatgactgtatctatattttagatatatgtatttctataaaagatagtctagatgactataaaaaagattattttccaagaatatgttaagaaattcatactatgtaatttcagaatactaattctttcttgaataagatagctcggcacaataaaactgctttgcctagttctatatcctctgggatcgttctgtattctttttgccggagatacctccaggacaagatcagtagtaatcaataatgcttctcatttgttttaggaagacagaaaaatcaataatatgagctgatacctaattttattttaggagaagaaaaataaaatagttgatgtgtgtttcagtgttgcctaaatgtttgaagaatcaaataaagaaaaatatattattttattagtgttagaatatcaaaatcttaggcttttatagtttagcacttgattttttaattgtatttttttcattgttttgttaaatattattttgtagactgtcaagtccttgtggacaaaattttgtcttaaactttttgtatttcttaagagtactgaagaattcattttaattaacaggataaaatatggtcttgtattcttaaaaagaaacaattttttctatatttactttgcctcatcttatggatcatgatacagactaaacacaggaaaatggttatttctgtgattaggacagctgaaagaagtgtaacctgtgcatcttttttggcattaatattcactgtggaacaagaagacagggcatttcctaaccacatatccagatttgtctatagtgaggaaaaaggtttatcaacactaaaactggtagctagtaaacttgttttttccaaaaaaatttgttctcctttttttctttctttactattgcatagataaaaaatctgccaatatgtgttctatagtcatctcagccttaggattgtaatccacaaattcatttataaatcacttacatgttttcaagttaacaatcttagaaatgatgcatgttcccgagttactatggaagtcttgttgtattgaggaaagggctttctgagcagacctagattcaaattaggatttcactacttgttatcactttaatatgtgaaatctatataatacttaagattgctataaatcctaaatgagatagtacatttgaaagtgtattagggagtcctcaatattttattcttctttgctccaactttttattttgaaaagttaccaacccacagaagaggttgaagaataatacaatgaacacccatgtgaacttcatcaagagtcatcagttaacatttcaccacatttgtatatacacattccttttctttctactcattctgcgtgtatgaatatatgtttgtgtgctgcttatgactttatatacacaaatgcacacacttttgctaaatcatttgagaataagttgacattttcctatttattcttgatcttaattgatactgcttgaatctgtcacaccctctttggatttagcatctgtcaatcctctctagggatctgtcatttctgcccctattctcttgcgtatttccaacatcctttcttaccatagccattgggaattgtaacccagtcagcttggattcagggcagacaaggtctcctgaaatcttagatcacttacttaagacaaaaggtttatgcccaggaaacagaataaaaatatcattcgtctcatttattttgtaatatttagaatgtagtgagttaatggggaaagaaaaaaatgaaactgagttttttgtattaactagggccaataactgtgctgtacacttttatttttaggccttgtttacttcccccaacaaccttgtgagctgtttgtagaagagggaaacagactcattaatgttagataatttgttcaagattaccagtcaggatttggactcgggatacctaactccaaaaccagtgctgtttccagaacatgagtatttgtgtagattttcagtgtacttttagaaatataggaaatacacttcctgttcatcatttagattatttctttcctctctcagcccttattatgactactatttgatttctttgaagaaataattcactggctaacttttactcatctgaaagtttatgtttaccttattaagcaaacagacttctcttcaccaccctgcagacttagtcctttgtccctctgacgtattagattagcagccaaaaaaaaaaaagttctataaagggccagataacaaatattttaggttttaacagaccatacgttttctgttgcaacactgaacgcttaacactgttgcatgaaaacagccatagccaatacataaatgaattgtgtttcatttgagactgtttttcaagaaaagtattttcaaaaacagacccactttctcctctaagctctggttttttgacccctaatataaatcactctcttatattcccataagaatttgtatgccagggaatgttagtgtaagggacactgttgagagacatacacacatccctccttctgatatatttgtttgtgtgtatgttatgaccagcttcatatgtgccttccccatgagaaaatgcagatgaagtaataaatgcagcaggtacctcaaaacatatcaatgaaagtcagtttggcactgagcaggaaaaatcctgttgaaataccaatgatatttaaaggaaactttaaggtacttgacccctgcccttaagcatgtggtaataatatgttccatctagtgtactacgagccatattctgatcttgccatttaagcaatattgaatgtgcccagcctgagcaaaataaaagaaggaaattcaaaacagatgtgacaatggaaatttcagtataacatctatgggagatttaatgattcctaggtcatactactctcacataacaccatcagaaaattcatagctgatggtctgtcatataaataaaatacatatatgcctattgttatatttatattgatcattttctcccttttatcatttcttctggaggttattattttaatggagactacttctcctttaggtctgataattacatctttctctcccaatgtaccaaatgttgtatctattggaatttgtacaattaatgctaaataattaaattaatattatgtagccttcatattcacattatattgcctggtaattgaaattgtcttctctctactttcctcctttataagggaatgtatcagctttatctaaagaaaagtgtacattttgaggagtctggaaaattacattcttaattatgagtatttctgaaagatgtgatgaatgacctttggctggtttagtacattgtttgcttcatgctccaacattgttgaataagctttaaagaaactgaagcattaaatggaaatgaaaagacatcatagcagaacttaggagatgtagcagaagccttaatcagagggaaatttattattgtaaatacctacatttaagaagaagcaagcaccaaatcagtaacctaacttcataccttaagaaacaagtaaaagaagaacaaactaaattgaagaaagcagaagaagaaaggaaataacaaaagattagaacagaaataaacaaaatagagacaagaaggacaatatggaatcaacaaaatcaaaattggttctttaaaaatatcaacaaggtgactcacaccttaattccagcactttgagagaccaaggcaggaggatcacttgaggccaattcaagaccaactggggcaacatagtgagaccccatctctacaaaacaatttaaaaattagccaggtgtggtggtgcacatctagtcccagccactcaggagactgaggtaggaagatcacttgaacctgaaaggttgaggctgcagtgagccatgtttgtgccactgcactccagccagagcaacagagcaaactcctgtgtcaaaaagcaaacaaaagtaaacaaaaagatcaacagaattgacaaacctttagctagattgactgagaaaaaaaagaacagtgtcaaattactaaaatcacaaatggaaatagaggacattactactgactttatagaaataaaaaggattataagagattattgtgaataattgtctgctaaaaaaattgaataatctggatgaagtagacaaattcctagatataaacacactaccaaaactggcttaagaagaaatagaaaatctgaacagagctaaaaccagtaaagaaatagaattagtaataagaatcctcccataaaagaaaagtccaaggcaggacccagtggctcatgcctgtaatcctagcactttggcaggctgacgtgagaggatcacttgagccctggcgttcaagaccaccctgggcaatgtggtaagatctgatgtctacaaaacattttaaaattaaccgagtgtgatggcatccacctgcagtcctagctacttaggaggctgaggccagaggatcacatgagcctgggaggtcaaggctgcagtgagccatcattgagccactgcacttcagcctgggcaacagagtgagaccgtctcgaagaaaaaaagaaaagtccaggaccaaacagcttcactagtgaattctaccagtcatttaaagaagaaataatgccagttcttcccaaacactgcctaattaattctgtgaagccagcataattctgataccaaagtaagacaaatattacaggataaaggaaattacacatgaatatcctttttgaatatagatgtaaaagtcctctacaaaaatactagcagagtgaatccagcaacgtattgaaaagattatacatcacagctaagggagttttattccaggaatgcaaggatagtttagcctatgaaaattaggctgtgtaattctcaccacactaatagaaagaaaggggaaaaaaacccatatgattgtctcaattgatgccaaaaaagaatctcagctgaacatggtggctcacaccagtaattccaacactttaggaggccaaagcgggcagatcacttgaggccaggagttcaagaccagcatggccaacatgatgaaactctgtctctactaaaaatacaaaaattagccaggcgtggtggcacacatctgtaatcccactccttaggaggccaaggcacaagaattgcttgaacctggaggtggacgttgcagtgacccgagatgataccactgcactccagcctgagtgagagtaagactgtctccaaaaaaaaaaaaaagattctgacaaaatccaacactctttcatgatgataacatttaacaagctagaaataggagggagggaacttaactccatttggtaaaggtcatttacaaaaaacccacagctaatatacttgttggtaacagtgtgaaaaccatctcgctaagattgggaacaaaacagtgttttctacttttactgattacattcagcattgtactggaaattctaaaccaggggtatccattcttttggcttccctgagccacattagaagaattattgtcttggacagtacatcaaatacactaacactatgatagctgatgagcaaaaaaataataataattgcaaaaaaatctcataatgttttaagaaagtttacaaatttgtgttgagccacattcaaagccgtcctgggccacgtaacccacaggctgtgggttggacaagcttgttctaaacagattagtggctgggcatggtggctcatgcctgtaatcctagcactttgggaggctgaggtgggtggatcatgaggacaggagttcaagaccagcctggccaacatggtgaaaccccatctctatgaaaaatacaaaaattagccggacatggtggtgcacgcctttaatcccaggtactcaggaggctgaggcaggagaatcgcttgaacctgggaggtggaggttgcagtgagccatgattgtgccagtgcactccagcctgggagcctggatgatagagtgagactccatctcaaaaaaataaaaaataaacagattagctagccaagaaaaagaaataaaaggtatccaaattgtaaaagaagtaaaactatcctcatttgcagacgatatgatcttatatatacgaaattttaaggaattcacaataaaactattagagctaataaataaatttagtaaagttgcaggatgtatggtttattagtaataaaccaaaaataaaattaagaaaacaactccatttacaatagtatttaaaggaatcaaatacctaagaattaatttaatttctttaatttttttttcatttcccttgaaaatcactaagaattaatttgaacatgaaatataagacttgtaccctggaaactacaaaacactgccagaagaaattaaacaagacttaaataaatgtaaacacatctggtattcagtccatttgaacacttaatattaagatgtcagtattccccaaagcaatctgtggattcaatgcaatacccatcaaacttccaatggcttttttttgcagaaatgaaaaagttgttcctaaatttatatggaatttcaagatcccaagtagccacaacaatactgaaaaagaacagtgttggagtagttaccctttccaatttcaaaacttactacaaagctacagttattaaaacatatagaccaatgggatagaatttggagtccagaagtaaacctaaacatctatggccaattgattttcaacaagataccaaaactactgaatagggaaatagtattatcttcaatatatgggactgggataactggatatccacatgcaaaagaatgaagttgtacttcttcatcacaacatatacagaaattataataattatcattattttgagacagggtctcactctgtcacctgggctggaatgcagtggcattatcatagttcatgcagccttaacctcccaggcgccagcgatcttcccacctcagcctcctgagtagctggaactacaggcgcacaccatcacacctggctaatggttttaattttttgtagagatgggaccgccctatgtggcccaggcttgtcttgaactcctgggttcaagagatcttcctgcctcagcttcccaaagtaataggatcacaggcgtgagctgccacgcctagcctacagtaatgaactcaaaatggatcaaggacctgaatataagagcaaaaaactataaaattctcaggagaaagtctaggagtatatctttatgaccttgaatttggcagtagattcttagatacaacatcaaaagaatcagcaacaatataaaaatacttcattaaaattgaaaacttctgtacatcaaaggacattatcaagacagtgaaaagacagtctacagaatgagggaaaattttgcaattcatatatctgataagcctagtatccagaatatataaacaactcttacaattcaacaacaagaagataacccagttagaaaatgggcaaaggacttgactagacattcttcccaaggagatattctagtgtacatcaagcccatgaaaagatgcccaatatcattagtcattagggttatgcgaatcaaaaccactgcaaatgagataccactttgcccctcaaggatggctgtaatttaaaaagcaaacagaaactaggcaaggatatggagaaattggaacccttgcacattgctagttggaatgtaaaatagtgcagcccctgtggaaaacagtttggcagttcctcaaaaagttaaacatagaattacacatatgacccagcaattccactgctagttatatacccaaaagaattgaaaacaattactcaaatacttgtacatgaatatacatagcagtactattcacagtagttaaaagctggaaacaactaaaatgtccatcagtgggtgaatggataaacagtttgtggtatagccatactaaatggaatattatcctaaaaaggaatgaggtactttgatacaagctgtaatatagatgaacttcaaaaacattctaaatgtgagaagtcagacacaaaaggccacatattgtatgagtccaattgtgtggaatatcctgaataggcaaatccagagagacagaaatggattagtggttgccatgggctaggggagggtggaatggagagtaagtgcttaatggatctggaatttcgttttggggtgatgagactgttctgaaacctagagaggtgatggttgaacaacattttgaatgtactaaatgccactgatttgaaatgaaatgaaaacattcagtgtttatgttatataaattccacctcaactttttaaaaagctcaaacaccaaagaaaagtcatttaaatgagagtttttcttgactgttagactggaggcagagattgggctattagggctactgttccaaagctctgctcctgctttttgaccagagctgaggttttatttctcagttcctttgtgatacttggtggctgaaacaactactttttaagagtatggtgatggcagtaaggggtattaaatatatgatgggggattcgtaaatgtaccagaggaatcacagttcttttcacttgagagtatcttctcaagtgtattcaaccccccttccttttgaggtcttctttccctctcctgtctttcaagtctctgtgatcctatttcatctcatctaccagaaatcttggtgcaaaattctgccaaactaacctcgtttgttttgtgagagggttactgcattagtaggttagagctgctgaatctctgaattataaatgaagcacttcacaaagtctcataatgtcactgtagcatacctcagagctctctcctcacccttgtcatcctgatgggttttctcttaatcatatttttgatgcctaagatattaaaaaggctagcatatacattggttgacagattaagaatctgaaaaagatgggaatggatgataatggtggacgaagtataacaagatgaattttatcagagataaatgttaagtcttgtatttgggaccaaaaagcacaaactgaacaagtacaacattggagggacatgacttaatagcagcagatgcaacaaaatgaagaaccacgtaagcatgtgatcattcttaaccccttaatgcgagctaacataaatagattgcttaaatatagtgttaaaaaagagatggtgaggaggactctcaaacccatgtcatgagactcaagtgaaaaaagcaggaatgggccagctgcagtggctcacaccagtattcccagctctttgttaggccaaggtgggaagattgcctgagcccaggagttcaagaccagcctgggcaatatagggagaccctatctctacaaaaaacttaaaaattagctgggtgtggtggcacatgcctgtagtcctagctgtttcagcaggctaagaaaggagaattatttgagcccaggttccaggctatagtaagctgtgatcgtgcccctgcattccagcctgagtgacagagcataatccatctctaaaaagaaaaaaggaaaggaagaagaacagaatttctgctgccgtatgtgttcatgaaagtattaaagcaaagactagtgaccatttttcaaaaatattgatgattaaaaagtgtgataccacacagccactaaagtgtctttcaactctaagattttatggatctacataattattaaaaagcagacaatgtggctgggcgcagtggcttacacctgtaattccagcactttgagaggctgaggtgggtggatcacctgaggtcaggagtttgagtccagtctggcccacatggtgaaaccccgtctctactaaacatacaaaaattaggcatggtggtgcgcgcctgtaatcccagctactcaggaggctgaggcatgagaatcgcttgaacacgggaggcagaggtcgcagtgagctgagatcttaccactacactccagcctgggcaaataagtgagactccatctcagaaaaaaaaaagaaaaaaaggccgacaatgtgagggtggagaaaaaaagagaaagtaggtatgggctgaaagcagtggtctaattgaattcaaaacgtacttaatgggtgcgttctaagttaagacattgctgaagttgtaaataattcagaagtgatgaaattttcaggtttgggtcagtatcagcaggaaaataacttgtttccttggccttattttatagtctagtctcctgagacaagatctggggcttgggagcccagcacagctatcttcttcaggaaaacctgggacagcatactattcattctctgctacaagttccaggaggagaccactccatgactctgcagcgcttggtgagtgtatcacacaacaaatcccatcccacatatgttgttgttgttttttcctcccataatctgtacttctggctatgcttttttttttttttctttccgtttctttgtttaagacagcgtctcactctgttacccatgcaggaatgcaacagcacaatcttggcttaccgcagtctcaacctcctgtgctcaagccgtcctcccacctcagcctcgcaagtagctgagactataggcatgtgccactgtgcctggctagttttttattttttgtagagacagggttttgccatgttgtccaggctgctctcgaactcctgatctcaagtgatctgcccacctcagcctcccagagtgctgggattacaggtgtgaaccaccgtgcccagccctgtctgtgcttttaattagaagagagttggattcgtgggtatcacattgatgtcagggcttatttgcacaagaataatacatccattaaatatttaataaatgaaattatcaaaattcttacttttataaatacattgtaagtttttaatgaaaggtttggccatgaataattttggatgactgttcaatttgtaagccataattttaacaagtttcaaacagccagtgtaatactcttgcttggtcctcacatgagcaactaagtagtgaaaaatgagacttaactagttttccttcttgtaattagaatttcatgttctaatgttaataacttaattctttactaaaaatgatataacaaaatttgcaaggtggttttatatacattctcatctcatcagttcaccaatcctgctagtcagttgctataaatagatttaacataaaaactgagggtcaaaagggagggcaggcacattcatataattagtacttaggataaaattttaagattttctaactccaggttcattgtcttttgcatattacttgcttctgcactccactttgtttttaattgaggttaaatttaccatattaagttgtacagttgagtagcatatactacattcactacattgtgccgctgtcacccctatctagttctgaaacgttactgcaaaagcaaactttgttcatatgaagcattcaaacctcattattttttcattagctcccttcttttatgtcttacacatagcctaaccaggccagtgccttttgttttactgcttacagcaagccttaggtattctctgatgctttatccaaactgtgtttaaatgtcagaatttctggtgatttctaccaaatatcttttaaacaagatacttaaagctgcaaagcatttttaaattaaaagtgggccagcttctaatatatagtccaccaaaagattatgtcacatttttttattgcacaggcatttgatgactgcttcatatttatgtatctactttctattaacctgtgttttggtgaaatattcctggtctctgggtctagggtttgcttgtgggtataaaagggcactatgatagatcatcatattcagcatagagaactctgattagatgtgtccacttctcagtatcatggatgatttagtatgtttactattaagtcagcccaggtgatttagaccagtatactttttgttattaaagaaaggataaattgtaaatgcatttttccatctccagtcttgtttcctacctaatgagttagtcagaataggaacattgattggagtctagacgtgtcagtgttactctagaaaaataacttgttagtatgctatgtgagtatatactgtgacaaaaagcacttagtacaagctaatacactattaagttcagggggaaaattagttattgaaataactagggaagaggggagtaaatttcagaaaaatccagacttaaaattcaggttttctataaattaaaacttgtatcttcttcattttaattttgattatgatgatagacactattgattgtctcttccatgccaggggcattgctgtacacactacattttcacaaaacctctgtgaggttgtaatgttaacttcatgttacaaatgaggagctaagacccagagaagctaaataatttggccaaggcttgagttgggatatggtagttctcttggtgcccagggaggtccaccgatttcctgtgtaaatgtcatttagtgggttcttactacattctttatggctgtttctcattgttagccgctctttcttagcattacagttattgataaaatctcagcgtttaaaagcactcttgagatgatctgcatcaacctcagcatcttcacaaactatttaggtgctttaggaaatcagcatgctgcataacagtatctaattacccaatttataatcatttttccccacattttaatggaaacctaataataatggctaaaatttgttcagtctcatacttgtgttaggcactcccctaagcgtctttcacgtattatcacaatacatgaaatacacaaaaggatgtgttaccccctttttacatggaggtaactgaagctcaaagagggttaagtaactagctgctatatgatggagctggaattagaatccagccagcttactctctttttattctattcacttatatttatgtatttttcttttttgagacggagtttcactcttgtcccccaggctggagtacaatggcatgatctcggctcactgcaacctctgcctcccgggctcaagcgagtctcctgcctcagcctcccgagtagctgagattacaggcacaagccactgtgcctggctaatttttgtatttttagtagagaaggggtttcaccatgttggccaggctggtctcgaactcctgacctcaagtggtcctcctgccttggcctcccaaagtgctaggattacaggcatgagccaccgcacccagccatctcttagctattatattttgcaacttcccagaagtggtcggtgaatcccaggctctcatgattttaaatcagacattttgtatttgattgtatagtggtgggtaaccaaatacaaaagaaaaatttcttttcacatggcagtggaaaaactggcctaaactaatcttttactaataatgacctctaagtagaatgataggctctaaactggtaggggcagttcagttgactgttttcgtacaaggagtatggcttttgttcaagggaatgctgtattagttgtgagtagttggggttttataaatacagagtgtgccagatgttgttcatctttggcacttctgttttaaggaaatataggcttgcctcttggggtcagaaatgaatacttcccccctttgctgttgtgtacagttttcttcatatgctacatataaagttgcctttttaactttgcagcctcctgggatattcactgtagagaattcccagtccaaagttaaatgggttaaactggggccgggcatggtggctcatgcctataatcccagcatttttggaggccaaggccgatgatcacttgagaccaggagttcaaaaccagcctgggcaacatagtgaaacacctctctacaaacgaaatttttttaattagctgggtgcggtggcacacacctgtagtctagctactcaggagaccaaggcaggggaattgcttgagcccaggaattcaaggctgcagtgagctgtgctcataccactgcactccagcctggccaacagagcaagaacctgtctctgaaaaataaatgggttaaactgcatgttttattgtatagtgtcatttatggaccaggaaaatataatcccagcactttgggaggccgaggccagagaatcacttgaggccacctctacatccatgggtttctcatctgtggattcagccaaccacagatagaaaaaaaaaaaaatgtaatgggtgattgcatctgtactgaacatgcatagacttatttttttcttgttattattccctgaacaatacagtataactatttacatagcattttcatagtattaggtattatacataataatgtagagataatttaaagtatgtaagaggatatgcataggttatatgcaaatactacaccattttatttaaaggacttgagcatctgtggatttttgtatcctcagggatcgtggaaccaatcccactgatactgaggaatgattgtgctgtgattgtttaattcccatttttacagctttcaaaagtattacactttacatcagcttcctcatgtgttctctcttcctaataatgagcccctcagaaaattctgaatttgatccattttttgtgtaaacctggaaccctgtgtttatcactttgttttacagtaaataagatgaacaagttttatattttacatataagtaaaattaactcatcaagtgagactggttaacatatgaaatactcatgttttcatttatattgataaattctgagaaagaaatatactttctctgtcaagttatttcctggaaatataaacattcaaggacaaattgtacagtaattaatgctgtagttgtggttatagccacataatgttaaaagtaaatgtgtcaaatactgaatgatactgcatttgtcaatgcccatatttaatagtttatgtatcatatattgacattataaccttcattttatttctttatttcaaatttttaaaaaactgtaggatagcaagcatagcattagctctcagtttttaaaatatgcttttaagcctaattctcagtgtgatgcaatcactaaatatgactctgctaaaggagtcatattatcaacatgacctattacactaagtgcccctctgcaaatgaaactgtaaagtacctagtatagtacctggcacagaacagcttctttttttttttttttttttttgagacagaggttctctcttgttacccaggctggagtacagtagtgccatcttggctcactgcaacctccatctcccgggttcaagtgattctcctgcctcaacctcccgagtcgctgggattacaggcgcccgccaccacggccagttaatttttttgtatttttagtagagatgggtttcaccatgttggccaggctggtctcaaactcctgacctcaggtgatccgcccaccttggcttcccaaagtgctgggattacaggcctgagccaccacatccggccgaacagtttcttaagaaatgttcattcccttccctcatactagtttgttgttttctttcttgtattggttcatttgctgtcatcttcccaaatttatgggatatgtattttcagaatgtatcacttttttaggagaacctgtttttcactgggactagttaaaaggaatgaagccctcattactgtattttgctgcttactcccaaatattggaaaacaagaaagacgctaggggaaaagttattctgttaatttgaagtcttgatttttttctggtatattatgctgaagaaatgtattgttttccatctgcagatcccttgcaagcaaaaaaagtcagaaaggtgcctcctggtttgccttcttctgtaagtacctatctttttttaacttgatggtaaacaaactgatttcaagtgttccgtattaccttgctacaagggtacattcgattgatgcgagtgggcatactttacatagtaattgttcagtgcttaacaaaatcattgattgaggtaaatccacatttaatgtttggtttttagatttctctgcaatgatttgtagcttactcatatgctcttactccttgtccctgtcatttgaattcccctcttgggaagaggactaggccagtagctgtcaaagatgatctcctatgcaggtcttttgatgtttaattagtcattatgttgctgaacaggaggacagacagagattaatagctgaaaatcttagaaatttacatttgtaataatcccaatggagctaaagacattaagattcggagtacatgtttggctcagcttgcctcagtaggactgaggttattaatatgcataaatcaccaagtcagatgttcattgtgaagcccttgtgggttttaaagccttcattaagcctttcctaacttcagcctagcatcaggaaagctttcaagcaactagtttgttgatccctctttgctcaaaaatgtatcctttgagaataaagggctttgatgaagaaggttggaaaggtttggtggaacaatcattaatggccatgataatctaatactgtaggggcgactgtgctattaaatatactttattctttaaaggagtaaaagtacttgtaaaggaacctgcatcgtaaatctacctacaatttttaaatctctggtgcaaaaaacggaagtttttttttcttctccctttgcttagaagaaatggtgagtgaggctgtttgattgaggccccagtgccttgtagggtacatctttttgttgtgtaaatggatgttgggcttttatttggcagtacttaacccatgggcgcaggtgccgccagatgagtcagctcatcgaagtatagactgaatggaatatccggcttggcaagtagtaatctagaaggagcagcatgggtctgagctttttagtttttattaaggctgaagtagagatacaatctttttggttgtctgccttccttcttttctgtgttattcccctgccttctctaccgtgtgatacatgaaaagtcgaatttgaaatcctctctgtaactcagttccagatggatctgagttttatgcagcctagggcagctgtgctctgaacctgcagcctacctggaaggttggcttgcagctgcaggcattcttaaaagcttttgcttgcataagcacttgggcccactagagactgcttgataaacaaaatgaacacaatgcctcaaatcgttattcccgaagacaggaattttttttcagcagcagctaaaaatagttggcaatttacattttaacagttgtgtgctatgcaggggtaggtggttcaacagcataacagatgatttctgttaaattaacagaaatcatattaaaactgacagtactgctaaaacatgtagcagtgcaattttcttgtaatttattactgtaattcaatgagagtaataaaagttaaattacacattaatatttagtagaactatacaggttaaaaaaacagattagtgaatgaaaaattcatctcatttcttaacctgacattaagaaacagtgtatgttcagtgttccatagttctttgattttaaaagcagtaggcaaaatggacagaacagtctggaaggagagtagacactggaggtcaccagcatttcttacattcgtaatcgtaataacattcattacttggaggtagtagttctctgtattgtctcaggtatctggaacaagtcactgaattctgatgaaacttgatttctttgagaaccattaggaaattttgcaggccaagcctacttatatattgtattttactagctatattagtatatattaaatgttattaaggatgtataaataacacattcattttaattaactgaaagtatgttttagataaaatgctgtgttgaaacctcagggtctttttgttttattttggtttttttgaggcaggatctcactctgtcacacaggctggagtgcagtgacacagtcactgcaaactacagccttaacctccttggctcaagcgacccttccacctcatcctcccaagtagctgggactacagggacaggccaccacggctggcttttttttttttttttgtagagacgaggaggtctctgtccaggccaggatggtcttgaactcctgggctctgtgcttctcctgccacagcctctcaaagtgctgggattgtaggtgcgagccaccacacccggctgaaatctcaagtatttaaaaaagaaaacagaaaaaccttaaagacagatatttttcccacttctaggattaactgaaaagattttaaaagaaaatactttaataaataatgacaaaatatgtcctaagaacacttaaggttatactgtttaccttctcaggatctaaaatagaattttaagttgtgatttcctatttcagagcttttattgaaaaatatgcaaactataaacttttgacatgcaaactataagaaaaatggagtattaaaaatgaaaattgactatgtatattttattttatgataatttgaatattatactttccaaaccatattggaaatttggcagtagcattcaggatttcatcagtttcctacttgttcattctatctttaatctgtaaaatatatgtgactttttctaaagaaacagtgaaaggactaagtatcgctgatactgatacaaaaaataataggcagggttacttagcatgcaaagcattgataatctgtataatttgatcatgtagcattgattagagactttttttgtaaactgttttatatttaggtatcataagtgcataactcagcttctctgttcctctctgcagaaccactgactagtaacttttgtttgtggatgaaggtctaactaagctgtattaaatatcattagagcagtatagtcagtaacattaagtgaatggttcacctaaatctgcccagctcagttactgattggctgtatagccttagattagtcagcccttaggatgtttggagtgggaaattcgaagttcctttcaggtctaaattgctacatacttacggttttaaaactgatatgctcaataaataaccaaaaaagaatagtgagcatagttttcttcctcctgatgaagaagtgatgtttttaaagcacatgagattctccacttgcttttctagacagatttaaagattgggaaaagtggacttttgtagcagcaacagtagaataatgcttggacaccgagaattcaaacatatacaaacaccataattgtcttctaggacctcactatcttatatgagaaacaagcattcagggaattaattatattgcagtgaagcaagtaagggtgtgtaccaggtgctctggtgacatagggtaggtagaactaaccctactatagtgacttcaggaagagttgacatttaagttgtgtctggaaagatgcgtagcagctcatctgttagagaaggagagaatggaccagacaggtaaaaggcctggaggtgtgaaaaaataaacacgtgttgaggtcacatctaaaagtacagcattactagattatatacaagttgcaacctttgtaattttcctatagcaaacccactcttctactccagaggtagattgagtgggggcacacataaaatcagtacagatatgagaagagataagttgtcatagcagtctatcctggataaacaactcaactgttctggccaagagataatggaaggcatttatagttgttaaagttttatctgggagtttccaaaggcatgggtggtactttggatttgcagggtgttttacttccgttttagggttcttaaacctcccctcccattctctaactgccaactcttgtctttgttctttgcatgtacatcagctgtttttcatctatatgagatcttcactaagatacaaagttcaagggaattttgaatctctgggtggggatttggggcagggttttttcctggtaatttgtcgggggaaaaaaaggaaacatttgtaatatatttgttagcatcctttacagcctcagtgtcactgtgttgttagtggtgcaagacttcatgtgtgaggaactttgttaaccattacccatatcctaatcttcaaccttttgccaaacaactctataactaatattccctacttacaaataagaaaattaagactcaaagacataaattaacttgccaaaaatcacacatagggccaagattacaacctaacttaatatcaaacaccattttctttttgagtgttaaaatctgattctttaataccttggtttattcagaaaatatcttgcttagtatattaaattaaaacttaaatttattctgtcaattatgtttttactgatcaaatttatttttatttggctttgttgtttaaggacctacagtagtagaaaaccacagacttcccaattaagcatgtgatggattttatttatctgccctcagcttttttttttttttttgagacagagtcttgctctgtctcccaggctagcgtgcagtggcatgatctcagctcactgcaagctccgcctcccagattcatgccattctcctgcctcagcctcctgagtagctgggactacaggtgcccaccaccacacccggctaatttttcgtatttttagtagagatggggtttcaccgctatagccaggatggtctcgatctcccgacctcctgatccacctacctcagcctcccgaagtgctgggattacaggtgtgagccaccacacccggtctgccctcagctttttattttgtaaccttggagaagttgctgttgagttctcggaacctccagtttctatttgtaaaaggggatgataatgcctatctcagatgttattgtgagagtattatgtacctactataagtgtggtgtatcctagatactcagtaaatgttccttcattattctagctagttcataccactacagcctgaaatttaaagaagtttagcatttcatttttaccaaattttgatgaaaagcaaacaaaaaaaagtttgaagatatataaaaaaggataagtattatagtgaaataaaaagttttcacgttacctccacctgtgtatataatgtatgtgcctggcacctaatgactgcatggtaaattgtagcagttccttttgttgtttagaaagcattcacttgcagaaaaacaatctacaaaaggaaggaaaacttgttgaatcaaatccggctgcccctagaattcattctaattatttttgttttctgaactctcaggagtcgacactttttttttccttttctaaatcactcgttgaacatctttatggccctctgaagcatttctcagatgcagaaaagtttctttgctctttattctttatttcttaagttagtgttaatatttccaaacatagatcattttcttttatgtgctgcagtagataatagaagaagcaagatatatcagaacaagtctttccaaaatgtaagtaaatacctggagagatttgaaatcccttcctagacccaaatacctaaagttgtattcttgttctatggcaattgaaaatacctttttcatatcaaatattaactctgcatcaaaatgacgtgtcttacaagttttgaatgtaacttgtttgcagtcccgtacgtagcctgatgacatgattgtttcttaatcaagtgtcatgttaaagagtgtatgtatatattcccacaaaagctgttactgtaatttcttgcttaaactctcaaagtgtaatttaccccatcaagaaaaatattttgtcagggcacggtggctgtagtcccaaggcaggaggatcacttgagcccaagagttcaagaccagcctgagcaacctagtgagaccctgtcactgcaaaaaaattagccaggtgtgattggcaccccctgtggttctgtctccttcggaggctaaagtgggaggatcacttgagcccaccatgttcactccattgcactccagcctgggtgacagaggaagagtctgcctgcaaataaaaatttgctagctcttctccaccactataaggagctttattgtttctgacatgaatcaaaacagcttagactctactttttcttggtttgatgcagacagttacaaagttcagtggcccttgaattagtcactgactgtaatttagaaagtgatgaggccaggcatagtggctcacgtaatcccagcactttgggaggccaaggtgggagtatcccctgaatccaggagtttgagaccagcctaggccacatagtgagaccttgtctgcacacacacacacaaaaaaatattttaaaaaactgtccaggtatggtggcatgtgcctgtggtctcacctacttgagatgctaaggcaggagtatctcttgatactcctgaaagagttcaaggctgcagtgggctgtgatttcaccactgcactccagcctgggtgacagagccaagactctgtctcaaaaaaaaagaaaaagaaaagaggtaagaaagtggtgcctttctttctcctaaagtttttatggaatttcattttgttgggaatggctctttttaaaaaaatgtgaatttttagtcatttgttatcgtaaatttgaaattgtagggataccttttgagacaattggaaatatcctgaggtattcccaaaccataaagactgctagaccatgtctaataatctagcgtgctgctatacatactaagtagaataagaatattcaaaagaaaaaaatactaaatcctgagggtgtctaaactgaagatttttttttttaataggaaagagatgacaaacagaactttctgggatgggtggaaatgaataattttaaaactatgatttaagagcttgctagccatctgaaccagtaagaaaaaggtcaagagttagaactatagagaaactgatagctccaatttatccatgaaaatagtaagatgagcagcaagaaaaatactctgtgagtagagtcgtatggaagtcactaggaagccaagataacagagtgtgtttataggcaattatccggcccggccaggcgcagtggctctcacctataatcccaaaactttgggaggtggaggcgggcagatcacttgagcccaggagttcgagatctgcctagccaacataatggaaccccgcctctataaagaaatacaaaaattagctggcatggtgttgtgtgcctatagtcccagctactctgagagagcgttgcttgaaccctagaggttgagattgcagtgagccaggatcacgccactgcactccagcctgggtgacagactgagaccctgtcttaaaaaaaataaaaataaaaacaaacaattatccaaggcccttaagactagcaagaaatctactgattctggaataaatagtatttacataaagtaccagcttttgctgaacttcatgagtaaaccctccagatcttgaacatgagttagaataggtatttgcttagttccttgggcaaacagcatagagaacacacaacaactgtatatacttaagagtttcgggctgttagatgaggtatctctatttgaaggctactgtgatacaaaatttccaaagtggcttattcagtctctgaccttacaggtcagactagcagaaaaatctttgtatgtaaagtacgtaagtggattatcctttaatccattccaaacttatattcagtttagtcgttaagtgaaagatttttttcatacattaataagaagtagccactgtttatgctgacagtaaccactgttcagaacagtgtcagaattaatagcctttaatgtgtagttctaagatgttgatttttgtgagaagtcggtaatgtctttgatgtaatttcaaaccaaaaagcagaaggaaaagtaaccagtgagtgagtcctatggatccagttgtactgatatggctgtatacagtgatacttgttattgttattttctgacttctctattccttttaaaagaagaacatggctgcatttcatttacaggtagcttttaaggtttattgaactctttggctgctggtaagatcttagagacttcacaaagcagatgtaggataaagcccagtatgtgtgcatgtttgtaactcatatggtttttaaaggctatatggttgaattatgtaaatgccttagtctgtcaatacaataaactctggcccagtgcccagggtcttaaggcactaaagaatacaaggtaatgaggccaggcgtgatggcttatgcctgtaatcccagtgctttgggaggccgaggcaggcagatcactagctcagaagtttgagaccagcctggccaacatagtgaaaccccttctctactaaaaatacaaaaattagccgggcatggtggtgcacacctgtactgacagacactttataaaactttatttatgaaaataaataaagctttatttatgaaaatagaagtttgccaacctgcactagatttaaagaaaaggtaaatgtagttccagtgaaaaacagacctaaagagttaaaaataaaattaaatacttcttagtcctgattcttggttttattaagatccactaccttgtattctctttttttttttttttttttttttctgagacagtctcgctctgttgcccaggctggagtgcagtggcacgatctcagctcactgcatcctccacctcctgtactcggaaggctgaggcaggaaaatcacttgaacccaggaggtggagagtttattgtattacagacacttaacttaaacttagatatatttgtgccaatcaccattttttttcctgttccaactttctgatagaacctaaagctgggccatagtgcccagcagtttgggaggccaagatgggaggagtgtttgagcctagaagttcaagaccagcctaggcaacatagcaagaccctgtctctacagaaaaaaaaaaaaaagaaaaggaaaaaaaaaattggtcgtggtagtgtgtgcctgtagtactaggtactcaggaggctaaggttggagggatggcttaagcctgggagtttcaggctgtagtgagctgtgatcacaccactacactccaacctgggtaacagaacaagaccctgtccccaaaaaaacaaaaaacagaggaacctaaagttaaagatagttgctggcagcttgggaatcggttccaacccaagtgtgactgtgaaaccaattcttttgaatcatgtgtcatgtttctggtctaaacataaaaccttcatacaaaaattaagaatatcttccatccctagaaaattcattttttcaatgttaatccctatgaatctaagtaaattttatatggttcttagtttcctttttgcttttatgaggctagtattaataataaataataaataggccgggcgcggtggcttaacgcctgtagtaatcccagtattttgggaggccaaggcaggcggatcacttaaggtcaggagtttgaggccagtctgaccaacatggtgaaacctcatctctactaaaaatacaaaaattagccaggcatggtggggcatgcctgtaatcccagctacttgggaggctgaggcaggagaatcacttgaacccaggaggtggaggttgcagtgagccgagataaagatcacaccattgcactccagcctgggcaacaaaagtaaaactccgtctcaaaaaacaacaacaaaaataataagtaagaactaagaaaacttcaagttttctgacttgagcttgacaattttttaaactgtcaaactcatcattatttgaaatcatgattttcagtatcttctccagtaacacaaaagatattttaaaatttcaaaaatcagtaacttaaatgagatttagaaaacttatttgctactagtatgggctccatctagtagattcccagtcaggagaatatgaatcccttctgtcaaaatcaacaaatatatactaagtccttatcgtgaatgaagaactattttagactttagggatttaaatatgaataaaatatggaccctgacttcaagattctttttttttttttttttaaagacagagtattgctcagtcgctcaggctggagtacagtggtgcgatcttggctcactgcaacttccacctcccgggttcaagcaaatctctgcctcagcctcctgagtagctgggattgcaggcatctgccaccacacccagctaatttttttgtaattttagtagagacgggtttcaccatcttggccaggctggtcttgaactcctgacctcgtgatccacccgcctcagcctcccaaagtgctgggattacagttgtgagccaccgcccctggccaagattcttatagtcaaaagataaccttgttctttggacaaaaatatcctttttttttttttttttttggagacagagtctcactctgtcacccaggctggagtgcagtggcataatcttggctcactgcaacctccacctcctgggctcaagtgatcctcacacctcagcctcccgagtagctggaactacaggcaagtgccaccacaactggctaatttttgtattttttttgtagaaacagggtttcatcttgttgcccaggcaggtctcgaactcctggactcaagcgatccacccaccttggcctcccaaagtcctgggattacatgcgtgagccactgcacccagcctggaaagaaagaacttaaaaaaaaatttttttttttcttttgaaacaggaattcagtctgtggtccaggctggagtacagtggtgccatcatagctcgctgcggcctcaaactcctgggctcaagcagagaggcagtcctcccacctcagcctcctgagtaactgggactacaggcacatgccactacacctggctacattttctattttttgtagaaaagaggttttgctgtgttgccagggttggtctcaaactcctggcctcaagtgatcctcccatcttggcctcccaaagtgctgggattacaggtgtgagtcactgcggccagcccaaaatgttttttgttgcataattgttgttcaccaggcacatgatgtagtatttaggaaatgctttttgaattaaagggataaaaataaggactacaaggccattattttatgtatctataataggaaacatcacctgttaatgacttcctgctctaagctgtactttttaacttacttctctgattgttcaaaccttcaatatgttaactggccttctttgtataagaaactgaattatatgtcccatttctcccttcaattatgcagttaattcctagttaccaaaataggagcattttaccaaaaccaaaacagaaagcaggaaaattacaggtaattcagccatcagcattaattctacattgttttaggatgacctaattaaaaatatagggccatggtcctcacgcgaaagaaaagtatggaaaacaacaatacaggaattatttttctaaaggaaataagttacggtttcattgacataaatttgaaacagaggacagtcttatatttctcttactagaattctcttcaagaatttaaccattcgtggtcacctgtgtagctatcatctttgtctaaaccacctttacctctttcttaaattatggcaacagctttataactggtcttccagttttattttgtttttatttttagacacaggaacatccttttaaaatctaggtcagatcatatactcctctgcttaaaatcctccagtagcttcccttattataaaaccaacatctttaaaatggcttataagacacctgccacctttcagacttcatcttctaccactctgcccctcccttacttcactctagccatactctcctttttactgcttcttaaagatgtcaagcacactcctacctcagggcctttgcatttgcagtttatggaacacactttccctcgtatccaaatggctagttttctctttgatgtcatatcacactgtcaatgaagatcttttgtgaccatcctatataaaagggcaacatacccctagtacctcctcactcttttcctgatgtatttttctctacagtacttcatacaatctgatatggcctaattcgtttattctttatctgtgttacccaggagcaacataataaagcagggattttatttatgttgtttattgcacctgcagcacagaggtgcataacagatacttaataactatttgttgaataaatgaacaaaggcaaatgattagcaatacagccatagctcttctttctagaccatgcttagctgactcagacaaggtatgagctacatactagataatctaaattatcttcaggagaaagatagctacataactgtatgttttaactcactgtattataaaacatctaacatgcttaaactttgtaaacacttttcagggaggaaaagagagagctccaggttttcatcagaaaactaaaagtcttttcagcagcaaagaacactgtagttatttctatttacatggacagtgtgccccttggttagataggaattattagataggaattagatgagagctaggaagtcatgcatttgttttccaatgtgaggtcttagcattagagtatcgtgttcttttattcatataatctttattcccattttaacaacagtaatacagtttgaaccttttttatataacaaccatttcagtctgaaatcaccagtgttatggcaaggaagcgtcctcaagatcgcgcacctataaagttactgtagtgttgccacccgtttttcactctttactcccttactttatcctgtaaactttccaacctacatactcactacagccacatttgtgtataatagtcctgtttactgctctactaaattctccagccaaaaggagcaaagaaacaagtcatagatgggcactgcatctttattacagaatagtgcaggagcctcagcccacttacttaagatgagctcccatattgactccttaactctgtgttgcgtgctaaaattataacaaagccatccctggaggagattgtatattatttgaagggcatagccataaatgttttgttttccaggtgatgctgtattcaccatgaaatatctgacttgtagattaacttgcacattattgagaaaccaaaattgttattgagtaaattaaacaatgacaaagttaggtaagagttgttatctatcggtaggatgtcactgcttttctttattttgttttactattttgttcaagataaagttgatagggcagggagcagggagcagtggcccacgcttctaatactagcactttgggaggctgaggtgggaggattgcttgagcccaagagttcaagaccaggctgggcaacaaagtgagaccttgtgtcaattatactttaaaaataaaaagaaaaaagaaagattatggttttaaatgaacatattactaggcaatggagttatatataactagccttttagatacttcatttgctggcataaatgttattagaatacaaagcttttggactcttgtcttagaactgagaagttgtaattatgttttcaaattccttttttggttcagcctttcatttcctgtgagggtttagacttttaattatgcctcttgcaggtatgattataaaaatacaatttaaggctgggcatggtggcccatgcctgtaatctcagcactttgggaagtcgaggctggcagatcgcttgaggccaggagttcaagaccagcctggccaacatggcgaaaccctgtctctactaaaaatacaaaacttagcagggtgtggtagcacacgcctgtaatcccagctactctggaggcttaggcatgagaatggcttgagcccgggaggtggaggttgcagtgagccaagattgcaccagtgcactccagcctgggcaacaaagcaggactttgagacatacacacacacgcacacacacacaccacacacacacacacacacacacacacactttaagattggtgtggacacctggtatcatctatgccagtggatcacagcttgaatcttgaatcttgaatacaacaagattcaaaatacatcagaaaaacctaacaaattctgtggattctatactttaccaaaataaaatggtaattaaacatcaggtttctttcactggaattatttcaactcagtatggcaatgcttcatttaccttttaatctgaagttctgaactgcagttacatggctttgagttttcttttttgcttttgttcatttgttgttgttgttgtttttctagagacggtctctctctgtcaccctcgctagagtacagtggcacaatcatagctcactgcaggcatgaactcctgggctgaagcgatcctcccacctcagtctcctaggtagctgggattacaggtgcacaccacccagtgaattttttaactttttgtagagacaggtcttgccatgttgcccaggctggtctcaaactcctgggttcaagggatcttcccaccttggcctcccaaagtggtagtattacaggcatgagccaccataccctgccttgatttttccttttaagagagaaaaatatttatcataatggaattttaaaaaaagagtctgagagacaaaaatctttcaaaataggaattcagagttttggggtggagtgcataataaaatgttttattagtggtgaaatggctaggaagtctttggcctagtttaatggtttaatgcctgcattttacagaaatggaaaattaggctcagggagagtcaacgacctaccctaagctctcttgcctcctgagaggcagagctgaaacctggatccctgtctcctgactcccagtttagtgctctttcgcgttacatgatataactccacagttttctgggacctgagtagcccatcttatattacatagaatactaatgaatgatagggagaatacttctgccctactgcatacacatgtgctactgctacatagaacaagtagcttaacaaatttcttccaagttttatatctgtttcccagtgtctgtttagggacacttgtcattgttaggaatagtgaagcataaccaaatactggtcaagcactgcttgttttgcgttgttctttgttgaaaatgtatgactgacaccatttcccatctttttccctgttgatgtcactcttcttagatgtcttttcaaagtgaagtattttttggcttttgttaagaatggtcaccagaatttactaataagaaaccattcttaaaagatacgtcttttcataaattcaagatctgtatgatttcttccagtgaatatagcaaaaattagctttgcttttttactttattgtcacaaatgtgagggaggatgttttggtagactcaacatttatttagaggcaagaagtattaaaaaattactaccactagcaagaatttttactgaaacaaaaatatagattggggaccaaaaaataacttaatgtataagttacttacagctttggattgcagatttttgaaatggttctgggctaagatgcagatgttaacttctggtcttttaaaaaatgaatttaaaatagaatagaatatcttggtgctgttccatttctcataaattgaaaggatctgatgtcttccagttcagaagaaaaaaaaatcgcacaggccaaaagaagaaacaaaaaaacgggtggcactttctttaagagacagctaatttgacccaagacatcatgttcacaaaaattatttagctttacagatgattttgaatgatagctttgtttgcctacagttttgttttgttgttagattgcctaacgagtcaatagcgcaaagccttgtgtcagtcttgaaagctcttcagaagtgctggtttcttaaggaatttaaaaacctgagggtcatcctcattgttttttttaatgtgtgcatacacacacctttaggcagtcctttgattatggagccatctgcaggaaaattatcaagttgcaacatagttaatgattctcttactgtgttacttcaagtggtaaatgagaagtgacaaactgcaattcacgtagggaaggaaaggggaaagaaagggacagccaagagatgcaggggcagggggaccccccctctttaatttttcaaagaaaactgctttgtcgttgtgagtttgtgatcaaaagaaacgtgcaatttgcttcagattttacatattctcagtaattatatagttctgtctcatttgaagggttatctaatgattgccttttagaagctttgtatgatctgtcagttctgttcatgttgatgtcggagggatacaatttattcacctcagaaagagatttatttgctttcttctccaggaggtatggctgtttttacatatcctcattatagtcgtatggttgtcaaaaggaaattaattgttcttttgccttaaaaatgcagtttacagaggtgattgtttccattggctatataggtaggtgttttctgttttgttaatcattaagcatttctaaaactcaatttagacttgagatatttgtaaagaaacagtatgacatctgatatcctgtatctgagacagacgctattttatgaattttagcatgtgtctttacattgtgttgagaagtgtatatttatatgtgttgatatccaaataagttatttaccagtactcagactaatctttaatatccactggttattggtttggttaagattttggtaatcacaattgaggcttaattggaacagtttttttcatggagtgccacttgagtaaagatcacaaaaatcaagtctttgatttttaagattttcatacagtggaaagatagtaattagaaggctttttactgatagactgggttatcagcaagatgggagtgattgttgaattaaaagatgcactattgattttagatcaataacactattaactttaaataatatgcattgaatgctagtggattggtttgaaaatgatgcattatttcactggagttttatattcttgatttctttcttgcagaagtaaattttctaaaatgtgaggatattagaaaaaccagaataacaactttctgaacatatttacaaagtagcatatactaccagagaagtctgcaatataatgttcagatataaaacctggaattttgatgtctgacttaattagcaaggctaactaaaatactgcacatttgagagacagcattcactcacatgtcatctctttacaaggtagatgaggaagaagaggcattggggaaggttcttttgctttgaatttgttcagttgcagattctctcactatcctcttaaatctatcctcacccctacctcccttgcagccaataatttattacttaccgagttcatcctttaggaaaatatagtgttcattcgtggagttattcatgtgtcagcttttaagtttggcttcatttattactctgaaagtctgttttccaagatttgattcacttagaaataatgttgaaacttttcgtgaggaatattatgagtgggttttaggtttacttttccagccagatcttctggcttttgggacagtggaatgttgcctgtttgttttagaagaatatacagtaagattaaccactaactggcctatgttaactaattcaagatacataattcacttcaattaaaaattttctttccaaaactatttagaattttgtgttacctttagaaacattcttgcttacggatcatttaaaaatagctataactgttgtagtgatccaaatatcaggataaaaatgagctaataaagtagataaaaatactgcgtggataactctaagaaattttatatagctctccaaggaagatctgtttcccaatcaacagaaaagtaagatggaagagggaaattttgcctggaagcctggaatttaaactgaagtttccagagagctcttacttggtagactttttgaaaacatcttttcctatatcgtcagtaaagaagtaacttgtttaggcaaagcacgttatggctttttcttgcctagtttaggtctgtgcttaatgactactggaatagcagcaaacataacatcctgataacatttgggaggaaaagccatatttgaaaattggtgaaatgcaataatctttaaaccaggaatcatcagtttgctaataaaaggtatatggctccaagttacgtattttgtcagggtcctctggcattttcactagtcattttgctagtgtgtacaatgattcctatcttgctgtaaaacttggtgatttttttatattgttgaactaggtgacatgaatattgagtcagatcacataatcttagagtaacacataagtgattatgtagcgttgtgggtggaaacaattctggataaaaagtgcatgacagttcagaactactgtgcaggcagcctgtctgaaatcaggtttaaaaattggccctgtctccagctgactcgttttgtcagactgagtcataggattaacccttgacatgttcctttaaaaaaaaaaaaaaaaaaagcaaagattaaacaactgcatttactaaagcagcacttgatccatctatatgcatttttttcctgtaatatgattctccttaggacaagaaattgtgctacagctgttgcatagattaaattaatttttaaaaaattgggagcagagaaaaaaagattttattatacaagataatttataatggcaatcaagcaatgaccatctacatcaaacagttttagttttttggggggtaaggcagacttcaagaaaaatgctgttttggagcgacaaacttaaaagacttttccatagcatacaagtagaatataggggcattttatgtagattaccaccagttttgttgatgatttactgtttttgaagaatgagattttaatatcatataattatagatacaggcatagagttttgttgttgttgtttttttaagtttttatatctatgctcaatttaggcagtagtgtataccaagtgactacggtttgtattggcaggggaggtcttacctacacatgtacgagttttatatttatgttttttaggagaacaatgaaaagtagaagcaaaagcttttaattagttactcaactctctttacaaattatgtttcacattcaggtttcatgtttaacactaaatcttacttaggtgtttaataaactgattaggtttgtgcaaaagtaactgtgtttttttccattaaagaaatttgattatactatttggcttttacagtgaatttcttttttatctgaatgtatgtttattctcttcagattatcatataattgcctctaaaataaagaactggtgttaaaatattaaaattttcattgtgctttaataaccaaggttgcttagttgggtttacattatgatgtttgttttatcaaacaacatagtaagtaccctctctgttttctgcccggcatcagggaaatgggcttaactgtcataggtggatgttttttaaccaatataagaaagttttctcagattgaagcgatgattataaaaatgttgaagtattgtcagtgctttgtggctcccctcttctccctattcctcctcaatttctattgaaaagtaagtgttatttttaataattaatagaaaaagaaaattttgattcgattttgtttgattttcctttttttttgttttgagagtagccgatctgtcagtagagaaagactgtgtatggaagactaaaatttacttgaatggttttaaggcatgctattgttaattgtgaatcaaagctttttacacagttctccaaggattgaaatgggtctttgtggtctctcaggagggaggaagttacaaaccactccgcagactggcattttaatagtctgctgtacagcgatgttcttttgcagctgctgcttagccttttctatatctggagagtgtggggaggttttattgttgttccaatactatcagcttttaaaacattgtgaagttagttgcccttattgtctgatttagtttcgttactataatttgatcaatatgttagtaaaaatgaggttggggggatagggggtcccttatagtatattcctagaatatttcacagaggatttctgcttcatgaaaggtacctttaaaaaaagtgatgtgcccccttttgcagcttgtgagctctcctctgattaatacaatcccgttagaacctacaaggcatagagggaaggatagtacaaagaagttttgatgaagggaaatgacacaaaaagggaaagttgctattctgtttttccaggttgtaattacagcaaacgattgattggaaaacatttaaatagcaaaacgtgtctgtgtaagagacacatgtttttgtagacaacttttaaaaccttttgacttcgaagtatgagttagaaatgtctgtaagacatttattcccacacttcttatttttcctttctgagaaatgtgagcattagcataaaaatatgaatatacaaagtattaagaacaataataaacttagaggaaagacttataggaaactgtttagtttattctctcatactttatatgaaagatgtgtgaattttttttaagaacagtcctattgcaggacattataaacttttgattggtgttgtgtatgaagaattcaaggagctttataactgaaaatctgtattattaagtgtttccattttaaaaacaggtaatttagtttcaagataatctatctgatttttggactaagctttttaataaaatgtgttcctttcagttttcctcaacataatttttgtagcttaaagtatggtttgttctagctagttaagaggtatttgcatgatggtctgctttctccaggaagtgattttgtacaagatttaactgtctagatccttcttgttacacatgattcagtgtttccaattcctgattacttgatcatgtgtttatcaaagttgaagcaactttagaccatggcagatggtaacgctggaggtgtagcaagctaggtttctctgccacaagtgctctaatttaattaaaactaaaaacagattagcagaaaatctgtcagtatgccttccttttgtgtgtgtatatatgtatatatgagacaaatctaataatttcttgggttatttttattcagggcatatttatttagcgcttaaaagtgacttgcatttttttaatacctcaaattttgtcttattggtatcctccaccaatgcaaggacttgatggaaattgaaagaggttacttacagcataaaccctccctctgtgctctgtgagttggttcagtcctattttgcataagttccttttgagtagatccatgtgtgaatgcatagtactgaagacttactccctttgcctgtgtggatatatgtcttggagagaggctgtgtgcattagctacaaatagtaacattttcaaaatcaacatgtattgtgcttatcctgtccctggaatgggcagcaattctttgatgtattactacaatgggaaaacggtaagcctttttctttgtatagcttctaactcacttgtttaaaggaaagcagtatacattactcgctttttactaaaatctgtgaggttttgttttatccttttatgcaatgtattagattgtagatttcttttttttttttttttttgcggggggacggagtcttgccctgtcacccaggatggagtgcagtggctcgatctcggctcactgcaaccttcgcctcccgggttcaagcgattctcccgcctcagcctcccgagtagctgggattacaggcacccgccaccatgcccagctaatttttgtatttttagtagagacgcggttttatcatgttggccaggctggtctcgaactcctgacctcaggtgatccacccgcctcggcctcccaaaatgctggaattacaggcatgagccaccgcgcccagcctagattgtagatttctttagaagtagtgtcagtaaagtcctgtctgctacatagctactcaatagttgttggctttcattttatttttaagatagtgtagaaaataaacttgagtttctgagttgttattagcctgatatctttactagcaatgagcttgaaagtacatttgtttttatgttttcgtatattgtgaacaaatccttacataaaatatgtatatacacacatatgtattgagaattatttgatgctttgtagatggaaggaaaagatgaaagtcatctaggatattcataaaaataacaagtatgaagctctggtaatgattagggaagcagtcagctagtaagggccgtatttcctgtttagagtttcaggtccagagcctgacttctctgggataccatctgtttccaatcaaactagaattttgaccttgtgtggattcatgaaataaatcactattttttaaaagaatgcatttatacattttccaaagaatgcactgtacttctggttgatttatagcaagcacatgactaggtgttttaaaataatacttttttgttttgctaaacaagagttctattctttaaattaattacctaatgttaataatttactgtgtttctacaaaaaaatctataagccagaggattttatatattctaaaaaaaaaagagtaaactcggaaagtttcaataggagctatctttgtaagatacttgataaatattattaaaaggtacactaatgaataacagtgttggtttatgtcagaaactcagtgttttccttctaaatctttcacaaataattttaccctcaggtgtcttatgaaaaaatgcatatatgggcttagtgaagggggggagaggggagcatttttaatgttaatgttttaagttatagagaatattcaattacattttactaaaatgggcttaaaattagatatggttgtctcttcccttttcatcacttggaaatgttttaaagtagcctatggctacaactaggatactaagaactaataaaagcactttttcattcactgattgctttagtaagggctctttggactgggccagtgtttggttgtgaacttttgggtaagctttcaaaaaagataagcaagtcaaaatatctttaaactcattaaaaagtgtatgttcaagctgcccatataagcagagctttggataatgtaagaagtagatttagatggatgagtgaaattatttaatctctatataattttcttgccagctgtctttcaaatgtgaaaataattttcttttgtgtctgattttaagtaaaacagtctgaacatggtatgtgggtatgtgtgtggggtgtgtgtgtgtgtgtgtgtgtgtgtgtgcacgtgtataagttcagtaaaattaattatgtaggaccctgaaccagactaactcaaaatgagtttagattttattctttggaaagcacaggttactgtattacatttctctttgttctacattgggaggggggtagggggagctttgatagtggtatttccaggcttatggtagatggcatagctggtatggtagagagcctggaaaaattgatagtctgtgcctaatataggtcaaaggtgacttttatgttctggaaaaatatataaataaagagatgatatgttggcttagtcctccaaatcataagaccctagacttgtatgtattttatttttacccacctctagtttttaaaattattctctagtagttattagaagtcattggcaacattattattttgtgatgacttcagttttcttcaataagaaaatcgtggtatgtaattacattgtctcaagattatataaatgtattattttagtgtatattgggaaatgtctgcttgtcaatgccttaaaataaaaactagcactttcattaacatttctagactcttaagtgaaatatatgtcttcacttaagttatagaagtttaatatacttcttgtcatgaacaggttaaatttaaactatttaatctcattttatagatttattttaaaatgatagaacaaaataatattttgaaatactaataataagttcacattgattcatttttaacatcccatttcaggttttatgagagagtgacaaaccctaagtggtcctgctcttaaacagaaagctttctttcccttttttccagtttttttttttttagttttcgagttgattgcatatatttaagggtatttcagatcttttaataaaactgaacaaactctaggaagagaccaaagaacttttttatattttattacctaaaattgtatggccagtattttattcttggatatgtaacagacttgggcatgtaggtgtagaaaagaaaagccaaaaatgttaatgcagtttttcctactgcttaaaaagagaaggggttaatgttttgtattatatgtaatttttgtgtagctgtattctttatcatgttgtaaggtattaatgtgggtttatagtaagtatgaaaactaaaactattttgcaccttatactgttttgaaatataaaaaatagtagagaacagtgggtttctgaggttccttctttataaagaactctgcctgcattcagttttctcattaatttgagtaaattttgtcctttacacagaaagtgagaaaaaagtcttgagagcaaaggaaagaaaagttttgggggaaaaaaaggactgccattttttttttttttttttttttttttttttttttttacttttaagattctggagtgccttactccatttttctgaccagtctccatttttcttagttttgggactaaagatgctacagagtattccaggtataaaaattgccacacaaacagacatgatggccttttcattgtatgaggaaattattttaatcttctgagaaacaacacagaaatccaagttttaaaattcaagctagacgcacattttgaatattaagcttctttgaatggaatctgggaaaaaaaagaaactaatttgattgtaagggctattctgtgggaggaactgtgctgggaactttgtttatctgatttaattttcacaaccactgtcatttagctgttactagctcattttataaataaggaaaatgaggttcaacctcacctattttgtaagtactgaggtcagaatttgaacccaggtctatctgtcccccaaaagcacattttctcctttgtatcatccaaggacatgtaaattagtctccatagcaaagggccaaactgaatttatcctgactacccatttacattaaaatatactacattggatccaatgtgtatttggatatgtaaaaatacatatatatactacattggaaagaaaacgtaactgggaaaagcacaaggccactcttacaaatcttttgcatgtgtggtcagagtaacaatttcatgaatactaattgatgtggttagtcaagcaaatttttgtcaacttttgtttaagaatttaaaattaaaactttcagatacgttttagcaagtctcctcttctaatagaattaatcatactgaaaattggtttagccatggttttggcacctgcctaccaatgaggttttttttttttttttttttttttttttagaaatagagtagcaagtaagtaaaattacattgtaaatacttataagacttatttttaaaacaaacattttcagttaataaaagaacagaaaccgatgtgactgtatacagctgcatttctgttctattggggtatttattgctagttaacatgagagaagaatatacaattaaattaattcacatttccagactgtccatgggcccaaaagagttaaatctaacattttttataatagggaaaacatgaagtcatttttaaaatctcttaatatagaatgctaaagacattgaatgacaaggacttcagcataaacctacttcacatttttcccctttaccaaaaatatctgcgactatggtgtgtgagcccaagaaagttttcttatcttgattcaagtgagtacaaatactagtgagttaaaactagctcctgctagttttacatactagaaggtatgttgtcactggtcaactttatgaatgtttttgagagaaatttgtgttcctttccacttgtatatcaaaggggatcaggtgcaatattgttgaatctaaattttttttaaagtaggtaggtaacgtgtcagtcattgatttgttcagtatattatcctagcaaacaagtttcaaaccctgtcccttagaaattccataattgaagaaaaacattgagattattagaaaaatgatagcacttatcgtagaaaatcagtaatatgcccagtgatgttaatttaagattaactaaaatgtgcttgattttcctagaaaaccagtgatatgcccagtaatgttaatttaagattaatttaaatgggcttagaaggaatttttctcacagttgaaaaccagtaatgttcacctgtgtttgttacacagtaagagcagcagttggttttaaaatgctttgtatgaaaactagaattcatttttcttactgttgttagaaaagaaatttcattttattttccctggaaaataaacatgtctctggaagtttttggaaagagatattggtccttttacttaggaaactgctgaaaatataaacacatatttatcccttttacagaatttcaagttgtatttttaacaggctaattaggtaaaaagaatcttccgtggagatggcttgtatgtgcctgagtcagtctttgtacttcagacgttttgctttataatacctgtggtttcagttcttgtggtatttttactggaactatctaaatattttccccctcaggcttgaaattaccattaaaaactctagtagcagattggagtttatggcagaatttgccattttatgtaatatgaaaatactgaaagcattgagatatttatcaaatctgtcatttgttgaaatattcttagatattagggaattattgaattagactatcattttaatatttatctagatttttaggttattttctttgggattacgttgtttaaattttgattaccgaaggaacaaggaaagtgagaaggcctaagtttcagaaatttttaaatgttaccatttaggttactgatatatgctttttttttttttttttttttttttttttttaagacggagtcttgcactgtcgcccagactggagtgcagtggcaatggtgtgatctcagctcactgcaagctccgcctcccaggttcacatcattctcctgcctcagcctcctgactagctgagactacaggcgcccgccaccatgcccggctaattttttttattattatttttagtagagatggggtttcactgtgttatccaggatggtctcgacctcctgacctcatgatccacccgcctcggcctcccaaagtgctgggattacaggcgtgagccactgcgcccagccaaggatatatgctttttatctgaggatgtatataagatcagtattaatacaaaataacagatcagaatgatctgaaaatgatcagaaaaatatataggaaatggtttttaggaaatgtctttaattttctctgatatcttcctagcactctaatacaaatgggtatagttattaaagcaaaattttatttactcttcttaaaagagcctctttttactaaattccaatcccataaaattgagaaagagacatgggttgtatatattgctacgtgtggaacttgcgtagattaatcaatttatttatttattcattttttttttcttttattatactttaagttttagggtacatgtgcacaatgtgcaggttagttacatatgtatacatgtgccatgtttggtgtgctgcacccattaacttgtcatttaacattaggtatatctcctaatgctatccctcccccctccccccagattaatcaatttaaattaaattaataatttaaacactaaaaatcttaaaattacctagttttttgaatgctgactcttaaatgtacatatgcttaaaattataggcctagagtcttaattacagttttttaatatagggtttgacctgggttgggatattcttttattaatatttcattgacctagactttttttttttttctcaaggttttaggtacttagctagatcttgtaaagtttttattgtttaatactaaatataattatataagataccagataaagtggatgttcctgaatataatatcatattttcattttaaaattatgatggcagggcaagttagccaaataattttgttatgttttgttactttggtaaattgatgtaaattatgctgaatataatttctgttattggcacagacctttcacatatttgaggcccacattagcgtgtgttaaagtgtttaatgatactgaacatatgggaacttaaagagaactgctattcaaaccatcttgacaaaagatctaacagaagcccaaacatagtgaaatcttggtaattagttctgtgttggaccatgttcagaaaagtaggtagccttctccatacttctttattccaaattaggtgaaggtgttctcaaaatgtttcagaatgtaggctgactttggttttcttaggccttgaagcacataagaattctagaatatgtttcaaaataatttatacaatcttaaactgccggataagaaggatctaaatctgccttgttcagtatagtaagcagtagccacaagcagtatttaaataaaataaaataaaatttaaaattcagtttctcaattgcactatccacatttcaagtgttcagtagtcatgtgactgatagctactgtattgtacagcatagatacggaacatttccatcatcacagaaacctattggacaatactcatataaagcattcttcttattttctgtggaagggtatctcaattaggatatatagctattgtcacatactaaagaaaattcccatctcttcatcccttggtaccttaaaaagtatcagccaccacacaggctgtagatctgatttttaaagtatggataatcacaccatgctttaactttgtcttatctgaatgtgactagataaaaagaaaaactatcttctttagcaaaacctctgcttctttgcattttttctcaataacagaaagtcattacgcctccctgcctcacaagaatgtttccagtgttaattacaggaaagatgtattgaaatcgagagcacagtgcacagctccagcctctagagctgaacagagtgtatgccttgaatttggggttatccatatgactaaactgaatcatctgagcaggaaaaaagggatctgtctttgccagtttgactcaaatttgttgtatgaactaaaacattttaaggataattatgtaatcactgtgaagagtaactgtaaatattcatcccaaagtatactatccctttttaaaagttgctttacggtgagtgtgatgaggacatgcaagatatgatttatgtgattgcgttgttttcaacagacttaatagtgaaggggaggtatctgttagattttctattttattcttccaagttagaactgtctgttcaccacacattcaaaatttttcttaacaccattcttagaggggaaagtataagtgcttgggaaaagagttggtcccatggtagctactgtgagcttggcattctgaaaaggaggatagaattctaaagaaaatatctaccacattttaatagaacatcttaaattacttaattttaccctttttctattctctttaaaatagtttgactcctggtagattttaattatcttaaagcatatatattcctttctcttaattttaagatcgactgtcatgatacaaaatcatccttcagatttaaaccaatgattagatcattaactaggggaaaaaaactggcatctatgttcaggtgatcagatgacataagcagtctgattttaatttgtggccagtactgattgtaaccaagagagacttgctctttttgtggaattggctgactatttccctacatctggagttaataaagcctttgagaccacatcagttgtgctttgccgcaagaagtctttgatctgaaaaatcaagactggcacaactgctgcttcataacattgcatctatgtttttgcaagctatagttaagataccaaaagtaaagttatttagcttatttagcctgtgttagaaatgctggtaaatgtacctctttgaaagccatatatttcaaaacattcttatgatgaaaattttgaactcgtgttaatacaaaaatgatatagtaggatttttttttgccattttcatttataaggtctgtcctttaaaagtccattgttttcaaaatctgtttgaaagaaatagcattaaaaacaaactttacctctaaaatgtgccattttctccatacaacttcaaaatttttgcgtaagggaaggcaagtctctttctgtgctttgtgtggtttatcttagttttcttgctctccatgacaaccgtgaataaaccattttctgatcagcatattctcttttatttagcagcgatttgtaaatcaggaaagtttatcctttgacttccttctgtaattgtaaccattttcaaaatttaaaaatgtaagtatattagtgtgtgaaatacagcgaattgaatgggaataaggataaagaaatataaattgataaattatgtaaaaatttaaactgacaaattatgtccatttttgtgtgaaatgacacatcaaaactggagtgttttcataattatcaagtatgagagactgacttactgtttcagtctataacctggataaaattagagaattttatatttcatacttacatatcaaggatgatgtgtatagtaagtgcacatttgtgataaaaagcatgtgttcgggtgctgtcttctaaatttgattcacattgtactttctggctaggtctgtggatttattctgtttttttgttgttcatggtttagcttggcttgaggaaatctatatagaaaggggacagagaacttctagctagggctaagtttagaagatgaaacttgattaaaagaaaatagtccaaagttcctttcctgaaaaccttatctgcctatcagcctgtacaatacattgcagacacattggtatatagtcagttattttatttcaacacaatcatttgtgaaatacctttaaaccagaaaagtatgcttatgaggaacaaaccattttatctgccatattccccaaactaggggatccttctagatgattcttgggaatatactgtatcttttctaagacttctcaggtaccacagatgtgtgtttttacctctgggatgtgaaaggtaggaaacaaacctgaatgccagtccatttaaaaaaaaaaaagtcacctgtgctagtattatcaggactagcacgaagagtaaaaattgactttttaaccttttatttagaataaactgtatatataactaagctcatgttagacgaaaactgtaatgaacagcatttgagtagtgaacaggtaatatttagcaacataactacttctgttagaatgaaaggtgatactgttagctataacttattgcctgcatacttcgtacaaggcactgtgctaaacattttatatataatttcatctgatctgcccatcagtctcctcatgcaagtagtgttaacaccattttacaaaagagggaattgaatcttgggaagattagggtaatttgcaaggggtctttacagttaatacctccaagaaagaataaattaatataattgacagtttatgtaaataaaaagttgggatcccattttaatctgggtgcgcttccttaactctttttctattattagtctatagaaatatatgcttggggtaaaatatcaaattatgtagaagaacataaagtaaaagtcttccttcccaattcgaagtccaaagaggtaaccattattgagtttcttgtgtgtaattctagaaattttctatgcttatgcaaacaaattaatacatgatttttaaaatacatgcttccataatgttaatgttattctgtttcagtcaacacttaaaatttttattttgttgaattttttgtatcatttcaaactaaaacaaaataatttgtttgtttcatacactgctcataatagcttacctttctcttcttcctgacttctggtttacttctatagactgtgcatcactttagatattatttgttttccacctttgtttcaatagttatgagaatagtgtgatcacattttgatcattaaggttatttggctgcccatttagttttccagaggaatgcaaatgttggccatttgctaattcaaaatgtttatagtttgcttatctaaagcaagggtttatcaaaggaaattaatactgctctaacaaattaaatgagatttttcttaaagctttgccagacttgaaagtgtactggaaatgtgtttttaatttatttgctaactctaccaagttaaggaagttcctgaacaattgtgttgtgcctttgatagttaccccttaatagtaacaaagatagcaatgtttaatcaaactcatgttgattttatttggtgaatcttgtaacactgaaaagaatgaattttatgaacccagattttatgttatgctatattgaaaggacatttgtttgctcgatcagattttgaatcctgagcctatgtgaggtttgtgtttggtaagccagctcaatgcttattcagtcacttggtgtaactgtcataccaagatgcattacagagatatttagagtagtagttttccctaataaccagcttaaaaaaaaaaaacatgtggatggtaattaagtttgacattatttatgtggatttaggcagtattcttttcatttgtggtagccctttataaaaattagataggcctttttaagccccttacagaatatagaactcattttacataagtaatatgatagtcatttacattttaattaaatgtgctgtttaattttaaggtatatgcaccatccccaaattcagatgatttcaaccgtgaatctcctagttatccatctcctaagccaccaaccagtatgttcgctagcactttctttatgcaaggtaagtactaccaaacaattgccaaatactactgcagtcatctgtatatcagccagtattttaaagtattaggaaagagaatacctatattcaggccttatttaggcattttttttggctaaattaaaatttagctttataattttccagtggtgtttattgctgactgcaatttaattgaattatctagcaaaccattggagtgctggtccagtattgattgaatttataaaggtcttaaattgagaaaaattaatagagctgttcttgctcattttagaattgaaatgtatgaaaactgttaactctagtttcttgtttaatttatggattcatatcatgcctagaattaccaatataaagaaagagtgaatatcatagaacagagtaagacttgttaagagagaaaaagtgttgcatttcctttaattcatgtctagcaaatcatttttatttggtctcctgtggttttggactatgggaaacaaatatatgggagcaataaattattacataaatggttccttgactttatattgttgagtggagtcattgctgacacatttcatttgaaagctaactataatatggtaattatcaattacttagttttactattagaaaaacttctttgttccacagtttcaaaatgtttgatataatgcacattgcgtgttatgcattaataactttctgtgtatgtataagtataccacttaactaaaaataaatctagcctattcccaaatttggaatttttactatcttccttgatatgaattgagatcttctgaagatttttataatggcctgcctattacagcttagattacttttttccctaactaaaatgttaatttcttctttttaaatagtaattttacagtttagagggaagaacagtgggtagaagactaggttggaaaagggaggaaaaatatctggagggtaccccttgaatttttataagcaacatcaaaatacaagaaaatttttagctaaggaaaattttatatttctctttttgtcttagatgggacccacaattcttctgacctttggagttcatcaaatgggatgagccagcctggttttggtggaattctggggacctccacttcccacatgtctcaatccagtagttatggcaaccttcattcacatgaccgcttggtaggctataacacgtgactagggtacagcaacactttgtcctcacttgtgtttctttttggattagaagtgtaaaatctaagtctgccaaaacttctgaagtttgaagtacttcaaggcttaccgcgtttaccatgcctttctaaaaaataaatgacaataagtagtgctctttagctgtaacttgtaaatgctctttttgacctgttatcatagttgtccattttatgtgaatattattcagaaaatatatttaatagatcatatctctttccatctagagttatcctccacactcagtttcaccaacagacataaacacgagtcttccaccaatgtccagctttcatcgcggcagtaccagcagttcaccttacgttgctgcctcacacactcctcccatcaatggatcagacagcattctaggtgagctttttgagttggcaaaacttcctaaaagtttgtggactttcagtgaccccgatatctttatatatatatatgtatgttttatatatataaatgttatatatatgtatatatgttatatatgtatatgtgtgttatatgtatatatgtgttatatatgtatatatgtgtgtatatatgttatatatgtatatgtgttatatatgtatatgtgtgttttttatatatgtatatataggtatatatgtatatatgtttgtgtatatatgtatatatgtatatatatgtgtatatatgtgtgtgtatatatatgtatgttgtttgtttgtttgagacagagtctctctctctcacccaggctggagtgcagtggcacagtcatggctcactgcagcctcaacctccaaggttgaggaggtgatcctcctgcctcagcctccccagtagctgggactacaggcatgtaccaccatactcagctaatttttttttactttttgttgagacagggtctcattatgtggccggggctggtctgaaactcctggcctctagtgatccttccacctcggcctcccaaaatgctagcattatagacatgacccagcacacgtggcctctttttttatttttattcatttatgtatttatttttgagacagggtctcactctctcagctctctcactctgtggctacaacctccgcctccaggctcaggtgataccccagcttcagcttcccaagtagctgggactacaggcacacaccaccatacccagctaattttccatttttagcagagatggggtttgtccacatttctcagactggccttgaactcgtgggctcaagagatctgcctgcctcagcctcccaaattgctgggattacaggcatgagccaccgcgcctggccttggcccctctttcgatatattttttagtgttgaatttaaaagtgaaagacaggaagacaagaagcttttttattatcatcaatatagacactggtaaagacctcatctttagtttattaataagtacaacacatgtagagtatttcctagtttactgtaacagatgtgagatgatgatagagaacacccttggaataatggcagagtgctaaaatataatacttgcttgtaaaattcttgatttatttctctatgaaatatccaggaaccagagggaatgctgctggaagctcacagacaggtgatgcacttggaaaggctttggcatctgtgagtattgattttacacattctactgaatgaattttacactactgaatacagtgattagattttgtaggtgataagtatctaaagagtatagatgtaacaagatcaatttcattacacatttagagttattctcggtttgtattgatatatgcccttaaatgctatgcctgtggtacagcaaatgctgggaagaggaaaaagaagtcatctaaagcaccaactgccaagattaatcattaaatctatttcttctaaatacatagttagtaagtggtccattaaaataagtcaagtggaaccacgaaagataactcagtattctgatccagagaatgaagtacctttataagaaacttttccaagatcaaaagcattttatgtactgtatttttttttaaagtcaactgcacctgatttactcaaggaataggaaatgagagccttctccccaaaaaagccagattcattgaagaatcatgttaaaatgagtaaaagtgatttgaaggaatccgatagtattttcttgagcaactagttcacatacatcacttcagaacattaatgacaaagcagtgattatattttaatatctgattcttaaaacattaaaatctcctctttcggaatgccaaaactagaagggagagcagttttcagtaaatctacaacagtttcaaatctaattatttaaaaggggcacttgtgctttgcgcttcctaaaatttcactttagatgattttttttcttcttgttttctgagtagtatgcctcttagaattcccacagaattgtcttttattttctatgaagtgcaattaactgtcagatacatttgttgccattcatggagaaggcagagcacgttaatacctgagtggtaggaagcaactgttgagcatttaaggagataaacctctttgtatattgttggtgtaaataaatttttctctacagctgaataccagcttcttggaaaatgaagccaagtcagactcatttactacatagtagagatggagcacacacaaaatgcagctcagtgaatgtttgttgaattctgtcttggatcatataataataatagtaatgacaataacaaaacccacaaaatatttcagctataatttgaatgcgcacctatactgagcatttacatgccctgtttcatttaatcctcaagaaagccctgtaaggttggcattgttatccccacattacagatgaggaactaaggtttaaaaggtgaagtaacttgagctcagaaagattaagcagctcgccctaggggaatcataagctagcatggataaagcccatatatattagaaccctgatcagaccagcttcagactctgctcctaaccactgctgcatacatccagaaagtgcggtgctgtggtaattatcttacaaggtattgatgagaatgaaagaaaattgtctcacccttttttcgacttactgtcacctgatgaaaatgacctatttaggaagacagttttattctatactaaacctgtaaggtctccaggtatttgattggcttgccatattccttctcctgattctggaagagtccagtaactgatattttacatgtaacaggacaaataacatttgaactttcagtgctagataattttttaaaatttaacctgcattttgggggctttttttctcaaaggtcatttgtttgttttattaaagaaaacttctatcagggaaccttggcctacaggcaggcaagaatttgtgatgttctcagtggcccttcaagttcattttgttacccttcacatccttgagtatcttcccctgttataaacagcatactagccaaaccaaaatggcatttggaaaagaaaacccaaattcaccgtgaatggaatccagtgaagaaatgtttaatctagttagtgggtgggctttggttgtcatggaaactcagctctgtcatcctgtgttgttactaggcaggagcagccaggtcattccataaatcatttctgtcatagctgacggtgatgcattccatctgctccatcactgcatgccatagtctgcacatttcaaatcccttccttcaatccatctgcttccccacttcccagccggacacctccccaaatacattctttttccaactttccttacagactcgcattcactttaatatatgtttagtgcactcaaaacgtactgaaaaagaaaaacattacattatctggggataggaaggattagaagagatgaggagaaggaaattaatgaggattacttttgagagtctgacatgcatatcataattttatgtcaggtattatagatattttgaaatggtgactgactcttttgaaattttaagttctttagaatgtgacgcttttaatatagcctctggttttagatggagaaacactatgctattgtcattaaaaattaattctatttccccaattgtctaatatatgtcttaaaagatctttcatattgtgaaacatcagagggtacaacctttgttcttcagtttaggtattaaagagcacacagaatactgtgtgattaaacatgtaaggccagataatgcatttgcaaaggttcctttattttaggtttaagcctgcataattgtggtcttaatctcaggatagcaagaaagagaattgtacatgaaagtatttacacaaagttcccaaagccctgtggattatgcattagtttagataaaaaaaaagaaaaaaaaaaaacctagggtagatagaaggaaaggaaaatctgggtattcgtgccatttctaatgtgtttccctgaacatttgccagacaataaccctttaagattgtgcccgtggagagttatatagaggaagaaacatctggtttctttcggtgcctaataccatatcaaaacacttggtctttaatttagaggagatcaaacaagaagactgtttaactttgttgattatatcagacttctttgtgataatttatgttttgatttctacctcagagcaagggaaaaagagagagagagagtgtgtgtgtgtgtgtgtgtgtgtatatgtatgtgtgtattaatctggataaatggtcagtagtctctaacaaaagaaaagaaaattcagggaagttgatgtttaaaagtaattcatgaaataactttctttgttccttagactcaataacattagcataataaagattaactgaaatgtgcactgtagtgtttaaaaaattgggctcacagttccggggttgggcttgggagcagtccattgtttcttttttgtctaaagcccttttcattagcctctggcttattggcaccctgctgattggaatagaccatgactgataggaggaggagtctcatttgttggagtaaaatgaggcatattaccgtttaagcctggcagaaggcattgggagttattcattattggtcatttaacagtatgaggaccatggactgcatgcagaatgagtgcttactttgtttatgctctagactctaaatcactctttacccccatttttttaagtaactgattttgttcttctttttattcttaccttcaaacatcaatgtaggagttcttttaagtccagaaagtatgaaaagaaacatattcctgatttagaataaagccaaataaagcctgtgtttagaagttaaagtagcacaatttttatagaataagtatgatttgtttgcgatttggtaataaaataaacactcagagataaagcttagtgaaatgacctgtgatccaaaaggctgtgttatcatgcttttcaaatgttgtattgctcctcctctcccaccatacacattctttttatgaaagtaaaagtgattttttaaaaagtcctgtaacttacagggctatctgtaaatttaggaaaagtattgataacaattctgtctgtcatcactttaactggcaaagtagaaccagtgactgtgatggatgagtggaaaaattggcttttattgtacaaatggagaagctgcttttggaaaaaataccagaaatgatatatttttatacttgatatgtttttggtgctgtttctcccgtttagacagtgatttttttttttaagtttacaccagttttacatatagcattggggcatttcaccaagtcatttaaagatagtgctcttatatgactctaaactattacctcttccttccttgatataaaggagctttcaccagttgttgacatggttagggattgtttaagtgtaaggacagagttttcagggaaaatcgggattggtagtccatttctaccctcaaaagcccatgcctacctaacagtgtgatatggacagcttagtacatcaacactaattcccagaaatagtgaaacctcaccatatgattattctcaaagcttatgccataaaactgatttgaaattaagtcatatttataacaagctcttttgcccttggtatttctgttgctgacccacattgtataaataccaagataaatactaccatttattgagtcctgctttttatcagttagtattatagcaaatttcaattgtagtttaatcactcaagttaaaaatatatatattgggcacctacttttacaagatactggcatacaataatggattcaatgttgaccagtataagtttcctgtcttcaaagagcttgtagtcaaggagagaagacagatatacaaataatgataatgtataacacagtgtgaagtaaaagagcagagagaagttcagactattttctaagagtataaggaaggtgaaaatgtataaatggggaagtgacattggaactgagctttgataagtagaattccatctgggagaggttaagaaacaagcgttctgaaaggaggacaagctgtgtttagaaaatgaaaaaaatattttgtttgcataatagggtatgtaggttaaaagtagactataagggctaggcaacaccacgcctgtaatcccagcactttaggaggctgaggcagtgggatcacctgggtcgggagttcgagaccagcctgaccaacacggagaaaccccgtctctactaaaaatacaaaattagcctggcatggtggtgcatgcctgtaatcccagctagtcgggaggctggggcaggagaatcgcttgaacccaggaagcagaggttgtggtgagctgagattgcaccactgcactccagcctaggcaacaagagcgaaagtccatctcaaaaaaacaaagaggaagaaaaattagccgggtatggtggtacacgcctatgtaatcccagctgcttgggaggctgaggcagtagaatcacttaaacctggttgcagtgagccgagatcgtgccactgcacttcagcctgggcaacagagcaagactccatctcaaaaaaaaaaaaaaaaagtttttgaggacagtagttcagggcaattatgtataggatggaaagagaggggagtaactagaaatataaacacttaagtagtccagccgcaagtttgagtaaagatttaaagtggtgtcatggcagtgattatgacatgtgcctgtcccagaaacattagagaattgtggatatcggtgtctccagagggaagggtagagtggcagaggaaaagaggagagagtacttatggtaaccataagcatggtgctactaacctaaatagaagagtagagatgggaaggatgggaagcttggggtggtgataaaaaatttgggtttggacataactgcgcttgagatgaaaagagatcctgtccagatagaaaagtctagcaaccagtgtgacaagagagataccaatttaggagtcatacctggatgtgatagttgatatttgacaaagaatactattaccaagagataaagcacagggaaatgaaagaatactgagactagaactctggggaaacctacattaagggaaatggaagagtaaaatagagatggaccctagggactttatcaaatacaaagactgaaaagaatcacttaaatggaaattcctggcaaggattatgcttttcattcttaatgacaactgtatatctgtacattgaaccctcaccatttatctgcactgttgtggaatctgaggctacattaataagacaaattcctcattcttctggggcttatattttaccatgggaaaggataaaaaaacaggtaacagacaaatgtagatgattagaaatacagtgtaagcactatgaagaatacgaaagaaggagtatgtaacagaaaatgctgcttcatgagttgggctagttgacagttttgcatagaactgacgatttctcactcatccatccaccatcagtgttatcagcctttccctcccttgccaatattgtagtcaagacatatttcataaagatgagcatcaattgctcataaatggtataattatttgaattatgaacataagaaatggtggttttcagtggtaaagaggtatgttgagggccgggttcaatggctcacgcctgtaatcccagcactttgggaggccaaagcaggcagatcacttcagcctaggagttcaagaccagcctgggcaacatagcggaaccccatctctacaaaaaatacaaaaatgttgggtgtggtggtgagggcttgtagtcccagctccttgggaagtcaaggtggaaggattgcttgagcccaggaagttgaggctgcagtgagccatgattgcaccactgcattccagcctgggtgacagagcaagaccctgtctcaaaaaaaaaaaaaaaaaaaaaagaaagggaaaaggtatgttgaaacatgttttgtttctgttgaagtttgatgaccttccctaatttacttatgtggttgaaataaatcaatgtatgtgtgcaaagccactaagaacaaaaatgtactttcccaagctaattttcccatgtgtccaatgaatgttttaaaaggtaacaacttaaaaaccaataatattgattttttttttttcatacactgtcttactctgtcacccaagctggagtgcagtggctcgatctcggctcactgaaacctccacctcccagattcaagcgattctcctgcctcagaccccgcgagtagctgggattacagtcgcccaccacgcccgactaatttttgtatgtctagtagagacggggtttcagcatgttggccaggctggtctcgaactcctgacctcaggtgatccacctgcctcggcctcccaaagtgctgggattataggcgtgagctaccgcacccggcctattattgatcttatactacctctctgttactagatcctcccaaagtgttttgaactcttttccatagctttacttttccaaaatagctttttaaatagagtatacagtgtctagatcctgaaaatagagtatacagtgtctagatcctgactgtttgagatagttgatgtataaaggcatttacaattataagttactaatgtcatacaaattggcgtattttgtttgaagtgcatatatccatttgtagtcaaaggaaggtagactttgggctgcttacaatttgaaagcctgttacctttttaaaaaatgaaatctggtgggccgtggtggctcacacctgtaatcccagcactttgggaggccaaggtgggagggtcatctgaggtcaggagttcaagaccagcctgtccaacatagcgaaatcttttctctactaaaaatacaaaaattagccaggcttggtggcacgcggctgtagtgctaactactgggaggctgagcggggaaaatcacttgaaccttgtaggtggaggttgcagtgagccaagatcatgtcactgcactccagcctgggtaacagagtaagactccatctcagggaaaaaaaaaatgaaattcgtaaattgtgacttgtatagttttgttgtatatgaacctgtcccaataatctggctttgtcaaatcttgaaagaacatttttatgctttctttaaaaacaatgttgaaattccttgtatgctgtaaattgggtctctttaaattcattagagctcttaagtttattcaaagcaaggtcatttctactggatgactttttgcactcacaagtagttttcctttttaaaatatttgaccacaatttatccatataagttggtttgtctgccctgagtgctgagatacgaaaatgattattatgcatattaaaagaataggattgtccaagaagagatcttagggatgggcctttggtgcctggattaaggggacttttaaagtgtttactgttgttgccaggcaccatggctcacacctgtaatcccagcactttgggaggccaaagcgggtggatcacctgaggtcaacctgaccaacatgacaaaaacccatcctaaaaaaaagttagctcggcatggtggcatgcactcgtagtctgagctactagggaagctgagacaagagaatcgcttgaacctggcggggtggaggttgcagtaagctgagattgcgccgttgcactccagcctgggtgacagagtgagacttcatctcaaaaaaagtgttcactcttgaattagatgtacttgaattaatctctgtcaccatttatttttggcaatatgaaatatatataaagtattgcaataaaagtttgagccagaatacctaaatttatgcatccgataatttatccttttcaaagtagacctattaggatttgaagtccacaaatcatcttggaaacagtttttgaagcataacaggattttttcactttcttcaaggatgacagagtatcttctgagaataagtttaatgttttacaacactcaatcatttggagctaaaattggcaaaaatgtggttgatcaaactgagtaactttttaaatgagagataaggggtaactattaaaaagattattttctttgtccagcctttaaactgtccataaagaccattctaaaagatagtattaatagctttctgaggtgattatttttaaagataccacttagttagataacatattctagaaagattgtcagatttgttaactttgtagatacttctcctttttctgttctaacagaaactttaagttattttcacctagaataataaatacatgtgatctattttattcctctcgtattagactatatatactttttaatcctgttttttaaactgaggcttctgtatgatgaaacagtctaaaacttgacaagaaattttttcactctgaagtcttaggggtgacaactagattataaaaataactccatgtgaacggatttgtgtatgtgctgttgtcacatgttgatacatgtatatttcttgttttctggttagatttattctcctgaccataccagcagtagttttccgtcaaatccatcaacaccagttggatcaccttcacctctcacaggtaggcttctgttttatctacttctaactggtgggactacttggaaatatttctagttcatttatttctcaacaaactttaataaaaatttgtgaaaaatcatttagattttgactataagaaagtgtgtaaagagagccttcctcttgaattcattttggagaatattgaaatatttgctagttttgagttatttattaatatcttccctgattcttaatgtaatttgtgatcatttctaagaacagtagttacaacaggataaaaataagaccaggcaattggaatgaagataaaatatggagaaagaatgaaatcaaaagtttttctaaagttattttttttagagacagggtcttactctgttgccctggctggagtatagtggtatggtcttggcccactgcagcctccaactcctgggctcaaatgatccttccacctcagcctcctgagtaactgggaatacaggtgtatgccaccgtgccaagctaatttttttactttttgtagagactgggtctcattatgttgcccagcctagtcttgaacacctgagctcaagcaatcctcccaccttggccccccaaaatgctgggattacaggtgtcagccgccatacctaccccccaaaaaatggtttttataagatagcatgtaaaataaacaagattaatctatttaaaagtacatgtaacttcctccttgttctccacacttgtcatgtactacgggtaagattcaaagatgaataactatttctgctagatagtctgtttttatttttaggtcaactaagttatttcccatagataaaaaaattcttgggaatgatgtggtttttctgccgaggaaaaaaactctctgtgaaggtggatgaatattgttagtggagataagtggttcacatttgtttttgttttgtttgagatggagtctcactctgttgcccaggctggagtgcagtggcataatctcggcttactgccacctccacctcctgggctcaagggattctcctgcctcagcttcccgagtagctgggattacaggcgtctgccaccacacccggctaatttttgtatttttttgtagagatggagtttcaccatgttggccaggcatgtcttgaactcgtgacttcaagtgatccacctgcttcatccttctcccaaagtgctgggattacaggcgtgacccactgcgcccggcccacatgttttttttttcttaatattttttatgttagtttagacaagttctaaatactatcctacagtataaatttgtggagacatgattgatgttattgtaaacgggattttttttatttcttaggaataaatataagtatataaaaatgtttaatatcttttaagctataattttaaaactcgaactatatttttctgagcagtgtttggagaaaagccttgctgaagaaaaaatatgttagattgttttgaggaaaaggcatttggcaactgggtaaagttaccatattcctccaacaacagttggggaaataattctgttttcctaatcaagccattagttaagtccatgcagttttgtgttttgttgttgttgttaagcctttttgcactgtggccctggccatcacctatgctttgtgtattagccttgtggctctactaagaagcattccggtttggggatgatgaactgctggcagctgctttcagctattagcaggttctgccactctctcagacaccagggcttcagctgtctagtaaaagttaaacagctgttccccacatagacaagactatgaaagacccattgacttaaagatgttgtttagcagagctgaaattacaggaagaatgatgtaactctaaccctactcaccctctttgcacagttctactaaaattatcaatgtcatttttgctacagcttgtttcactttctcatccgaggtttccatatcagcattcccactacctcgccttgtctgtgtagtaagatagctgccaaagtatcctttggttttaatgaacactgagtaggaaggcaggccatggcagagctcagcatctatgaagggtcatcaatgaaatgcagaatccaagatttagacattttccaaaaaactagtggtcacaagtaaaatcttacatttcctccttcatctttatttgatatttaatgggcgatgctgtctttttctctttaattcaggttgttaatgaaaatctgggctgttgaattatgtaatgaagccttctttttaattcagcagtcataatcaaagaaaaatactttcacatacttgtgttgaaacagcaaatcaaagactgattttaggcaggtgcatctctcctggctcctgtgtcttggttcttatctacacacacacacccttacccacccatagcagggcagagatgagatagaaagaagaaaggaaagcactgtgtgataaaatattcactgtcaaagggaaaaaaaaaggaaaagaacagagcaaaccagagctcctatataaatatgtggacattattttgcatcttgtgtggcaatggcctgttatctagagtaaaaaaattctacccactctgtgagtagaattgtccacacttgccctattccttatgtttttgagcatcagttagacttagcacaggtcttttaaagatagatacacaggtgcagagccacataagcagcttctaaggccatcattctttaaatccccagtgttttccttgggaacttttcaggtcaagagcatacatttctacatagagagtgcttagaaggaaggttctgagatattgtatcagttaggatgctttaggctaaaatgaggagaaactcttgtctcagctagtctgaacagtaagaggatttattatcttgtgttgtgaggtcctggccccctatgtcagggctcctgctctactttgcagttcttcctcaggctggtagcaagacagcagttcagggtactacatgcagacatatctccagtagatgaaaaaagaccgtctctctttttttttttaaagttaaaaattccctatttttttattcccagtaccactaccacagtttacagggcaatatacctgatgtagtgaaaagaaaaagacgaagctacaacagatgaaagacctcaggaatatacatcttactgacactacattgcattagtcagtagctgcactttttgcaaactggctctgacagtcctgaacaagaatggtttcctgtttcagctgcagtaacttttctgactatggatcattgttccttctgtggcagatttttacagttcctctaatgcctttcggacaactgtctcaaagtaacctacagctttcctgacaactcctcgttctctctcctgctaagaactgtagcccttttctgctgtttttagaaccttctgctaccatatccaccactttcaccaccatggggaatgcctgagcttcttccaccaaaagtgccccctttcatgggttcatagtttgattgctgttgttcactataatttccgaactcattatagttcccaccaccaccgtagttaccaccgccaaaatttcctccttcactccaccgtcactccaccaccaccaccatatccttggtccatcaccatcatagccccctctactactgtaaccaggactaccaccatagttgccaccatcacctccaaaaccattatatccgccatcacctcctccataactacctctgctgccaccaccttcaccaccatagcctcctcttccatcagagtttccaccacagccaaaactacctctaccacctccaaagtttcctccataataaaattgccagatctacctctgtgacctctgtcatccagcagactacatctcttgtttagaaagggccttttttacttcacagttatgcccattaatagtgtggcatttctgaacaacaattttatcaactgtatcatgatcatcaaaagttataaaagcaaatcctgtcttttttccactctgcctgtcttccataacttctgcggtttcaatcttgccatacttttcaaagtagtctcttaaattatattcttctgtttcttctttaataccaccaacaaaaattttcctcactgttagatgggcaccagactttacagaatcctctatagaaagagctctctttggttccactacacacctgtcagccttgtgtggtctagcacaccttgctgcctccacctcttcaacacaagagtaagtcacaaaaccaaagcccctggaacgtgttttttggggtctcattaccacacaatctgtgagtgtgccccatttctcaaaatgtctcttaaactatcatctgtagtttcaaagctcagaccaccagtaaaaagtttttgcaaaagctctggttcctttgaatcatggcccttctcccccaccaccccacccccacagtggtggcaacggctgcagttgggcagcggttttacctccattttgagaccagacaactggactcatgtcttccaactcaagttcagtatcccatctctttcttttgagagtcttttaaaaattattttaaggatccttttccagaagcctcttaaacagatttccccttacgtcttattggccagcactgggcctaatgcagttgcttgcaagagaaatggtgccaccatgtttatcttagcatctggatttgtccctggggctaagaatagaattgctctctcctggttcctattaggaaaggacagacccacctcccacaccccttgtgaacaaaatcagtgctctggccacaagatagaagagaggaatggctttgtttactacagttgttatttaggaaaagatgagcatttgcagtaagagaataagtttactaagggagcttggaaggcaaacaagcaaagtcatcctttgcctttcattacctccttctggaatataaatgaataaaagttcaataattgtagtactcagtagtaatcttcagagctttcacagaaaaaaataataaggagagaaagagaaattctcagtttcagctaatcaatgagctacttatttttattacctgtcagattgcctggtgttaagtcagttacctgacttcagcatgctttaacaaagtgcgttacactggaacgggccagtctgtaatacaaacaaaataagtttaagtgtatgtatatttttttccagtttaatgaattacacattgaagatagacctttgtacagtttttttaatagcaccaaaaattatgtagatgattacccaggtaattcagtgtgcacatcttgattcctcaatattaagctaatgaacaatctcaaaaacagcctgttttgcaaaagcagatgcatgctgacaattctgaggcatttgaacgtaaaacgtgttaatattgcacacaaagtcagtaatttgatgatcaggcttctgttacgggggggcttacagaaggagtagaaaaaatgattgaaaagtaaaatattaccaacattaagataaattcttttttaataattaaaggtatttttcaaaatcgattatgattaacctggtcacctaaaattcataattctgcatcagtgcttagaaagcagtaatgcactgaaatcagcagtaaggtgttggctagttgtttttatatatttttcatatagtcagttattgagattttctggttgattaattctgccttttaattataaaattagcccacaagcttttgtttcaatgagcaattttagattgtccataatttgtagttgatttatgattacatttgtatgtctagcaggaagcctttaatggtccttaaaataatttgtttataatttgctcataagtaaaaaaaaaaaaattaactgaagtgcatattttttctcacaattttagtatttaaagtatatttatgtaattataacagtatgcatataattgtgaaatctaatcaggttatgaagaatctgtatccaacttttcaacttgcaaaatgtgtataattgatgaatacacttactacattgtttcataattaaatagtcttgttcagctaaaatgaactataatagttctaatttacctcaagtttttctaagatagcaaataaattgtagtgtcacattagcttcctaagtaaggcaaattgacctgcaataaaaggttctagtgtgagacaaattaaaccttcaacttccaacttcgatttctaatataattcaaattgtcactgaagcttttattaagaataaaaatatatttagtctttattattttctgtaaatgacttattttcagatgcacaatcgtgaaataatgaagattttgatcagttgtttttgtctttttcctttgaaaggtattttcgcaagaccattaaaacattgccttctctctaacatatggatgaattatttttttatgcttcttttttttcattctttatactctgaacttgtatcttttctttttctatctttattttttaaattagatttatacctttctaacatcaaaggctaaacaacatctaacaagtttttataacattttcctaattaatgtatttggtataaactattttgggaaattttttaatagatgaccccaagatcatttacagtcatgggaaattcattcatctgtgtattgctaaaggcactgtcagttactattaccccttagtaaggcaatttgtccttacgttaatatatttataccctttgattcagaaatgctacttatcctcaaaacatccttccccctgggggaaaaaaactcaagagtaatgtttactatatcactgttcataatagccgagtggtaacaaccaaaatgtctagcagtgaaataatagtggctaagcaaattaggtgtagaagccaggcaaaatggctggcacctgtaattccaccactttgtgaggctgaggcgggtggatcacttaaggtcaggagttcgagaccagcctggccaacgtagtgaaacgttgtctctactgcaaatacaaaaattagcttggcgtggtggtgtgtgcctgtaatcccagctacttgggaggctgaggcaggagaatcgcttgaacctgggaggtagaggttgcagtgagtcaagattgtaccagtgcactccagcccaggtaacagagcaagatgccatctcaaaaaaaaaagaaaaaaaattagccaacgtggtggcacacacttgtgatcccagctactcgggaggcagaggcaggagaatcgcttgaactcaggaggtggaggttgcagtgagccaagatcgtgccactgcgctccagcctgggcgacagtgagactccatctcaaaaaaaaaaaagaaaaagaagaaacaaaaccaaaaaaacagactaggtgtagagaataagggaaataataatgtagtcattaatagtattatcaaaatttctgtacaatgctataggaagggggacagaattttaaaagtgtgtacgttataagtgcattttctcaagatacataggcatgtggactaagtctaaagaatgtgcaaacataaaggtagctgtatttaaaattacagggttttttttctgttttctcagcaccccattttttttattaataatgaaagattttttaaaatgtgttgggcttataagtagccaatactatgctgaaggccaaacaaaaatattcatgtaaatttatttagttattgagtatctttaccctttccttcacaacattatcaagatcactgagttaacccaggtgtgtggctacttttgggttttaacaggtaccagtcagtggccaagacctggagggcaagcaccttcatccccaagctatgaaaactcactccactccctggtaagagcctcttatacatcagttttatctgatagcttagagtttgtttgtttttggtcaatctggcataacaataaagaaacagtaggctagcattgcacatgaattctttgctaacaaatggctgattcatttgaacaatataagacacattgggtatgccttttgccatctgttctttgggacatcaggcttctggtgtcaggacagctgatgttaaaattgtgttatgagggtttttgtttctttgacaaatctagggcttaatctttctatgcttctatgtctacatataaagggaaactttttttaaaaagacaagtaaaagcaagaaaatttaatccagcaatgcaaaattttacccttttgtattttacactttctcataatactgtgtgtggtttattacatttccattaaaaattttaagtgaataccagtgttttttgtcatgaaagtattatttcccatgttttcttatggaaaaaaaagtatattgtgcaaattatacaagcaaaacattatttaacaaggcagtaaaggaaccttctagatatttgagcgtgaagaatttgtgggagaatgttgactactgttgcttttgtatacttatatttgtaacccagaattacacggtataataaaaacacaataaagatgatttgatggaatgctaagtcatgctcttattcgtaattccaggttgcaaagagaaacattctttttctgtgactaacaaaacattttaaattgaaggaacgtttgcttctcatatattttgcaagcaattataagcaatgtgtgctgtttagatgctaaccttgtaacttccctgttgaatcccagccttttcatatcttaataaaatagatctcgcaagtcttggcgttaactttactaacatgttatgctgacatgcatatcagctatttcctcatctcttttggagttaatcttaacctgtgctttgcctcctgttctgtcttgactttgccagaaaaatcgagttgagcagcaacttcacgagcatttgcaagatgcaatgtccttcttaaaggatgtctgtgaggtactatttcttttagatggtgccttttttgtgtttcaattaattatacttcccactattcatttaaaatctttaagctgtacagactcccatctttaaaaatcaaacagttgactgtttcagtttttatcacagtatataggaataattttgtctcttatgttgttgaaagtgatcctttttaaaacagctctactggcatgtgcttttgatttttttaattctaatatgtttgtgtatggggcatgtgtgtatccacagacagacaataccatttatttagttttgtcaaagaacatatctggatatgttcaccatataagttacatgtgctttatatacttaagacaaaattaaaacttaaacttactggatttgaggtcccttccccaaattgccatcattcaaagatcagtattaaagtataggttgtactttttttttttttttttttttggcagctcttattgagaaatgacatagtatccttcattttttgtagaagctaaaagaaataacctcatggtagtttggtaaattcgttttataaagcagtgatttgtttctgaagctttgaaaatttagcataatctacatacatacagcctttttttgttgttgatttatagttcaggtggttgcttttgaagctacttgatactgcatttcacttgctatcttccacatatcacatagtaggaaacgtagcagttaatgaatctaacagatgccagcaataaccaccatgttttttttttaatccatacagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggtaaaatcatgctcatcttttttgtagtaaaccctaaagattcttgtcctaaatgtctttaatgaaatctttgggaagaggatctttctgaaaggaaggcaaagactgacttttcagaattttctttactgtctttggcagtaaagtattggctaagtattagtccataaaatcttcttgtgaccttgtgcaaaaagcataagctttctacagagatcatttttagctaaaacttggatttttttccagatgtgtaataattggcacagcagtttttgccttgaaatagtgcataagaaatctgaatagcaagagttctgatctagaaaagttgtttattgtaatttagaaccagccttcagtggtagaaagaatgtgaaactgtaatttatacagatccaaatttaaactttattcccgaactgcgggggaggtagttttaagaatggctgtaatttcagtaataaataaaggaaacaattttagattaatccacaaagagaatttttaagaactcagtccatcttttaaaaaagtatgataatttttaaagggggtgttcgttctacagccatacacatcaaaaattctgtgtttaccatcttacattattttttatccaaattatcttttaaagaaatgaagttctttttgaacctgctattttaaacttataccatgtgttggcatgtttatggcatggtttttaaggttcattgcatgctgtgaaatgttcttctacgaagcagatttttagctataagccatgtgatgaaggctaaaaacttacctatcatcaaaataattaattgccctaaatgctgaaggcttgtattctgtaagatagggttggttccagattttcacactcacatatcttacacatacatacactcatttttgagcctctgaagtaaacgtcacacaaggctgcttgttttctgagaactgtattttcagcagcatgggtaacattagatacctgttttgtgtttgtttttttaatgtcaggaaatcttgaaaatcagtctccttttaaagtactttttattgctattgataagctaataagtgtcaaaacatatgtaagttattaaactagtaaaatggggaagtgtcagatggctcacacctgtaatctcagcactttgggaggccaaggcgggaggattggttggagttccaagactagtctgggcaacaaagtgagaccctcatctctacaaaaaataaaaaaaaattagtctggcacagtggcatgcgcctgtggtcccagctacatggaaggtttaggtgggaggatctcttgatcccaggaggtcaaggctgcagtgagccatgttcatgctactgcactccagcctaggccatagagcatgaccctgtctcaaaaaaaaaaaaaaaaaaaagaaagaaagaaaaaaatatgagagggtattgttatcactgctggtaatagtaatgaaataattttaatggtataataaaaggaatttgttacaaatgtgaatgcagaataacttaataatttgttgaaatactatttatccttatttagaagcatgacttaaaaatcaatattcttgaattttaagttagtctcagcagcaacatttgcagttcttattccttacctcttaatgattttttaattcttcacttttactagcttactgctcctattccaacttatcagctacagtatttattatatatctggctcctcccagttggagtttgcataaaatggaacttctgtcttgagaaagttgtttttttaccaatttcagatattccataatagaaagggagacttatcaaaatgtagtcctccaaagccacctagaaacctagtgcattttagaagactgttagagggaaaaactctttcattggatggcaccctaaaacttataactaagaaagtagctcctactatatgctgaaggaatgcactgcccacttcagaacaacaacagaaggtctgccagaggtatttttttgttgttgttttttgttttgttttgcttttagagatggagtctcactctgtggcccaggctggagtgcagtgccgtgatctcggctcactgcaatctctgcctcccagatttaagcaattctcctgcctcagcctcccgaatagctgggattataggcacccgccaccacgtccggctaatttttctgtttttagtagagatggggtttcaccatattggccaggctggtctcaaactcctgaccttgtgatccgcccacctcggcctcccaaagtgctgggattacaggtgtgagccactgcacccggccagagatattcgtaaaaagaaaaaaaaaatctcaaattagtctagaaaaaatggtcttctgagacatgaagtgagtctggcttagtctgagctgcaacattagtgccacagcaactagcccaagctgttgttcagtgtgtctgtcacagccttctcttcagtccttatcaccttctcagcgggtacagagctgtggaaaatctgccagaaatcatctgctatcttcatctcatccagacacaatcactagtacttttagtagtggagataagatgtatctggcaggcttagcctcaaaatataaagttactagctgacaaaatctgacactgttaggtgagtcagtattcatctcctgtccttctgaagtaagccttttagctgttgagtcctcagttctcagcttcagcaaaaagaccaaaggatggaatgaaatgaagattagtctgccactgactatccccgcagagtcttaggcatgttattgaggaagactgtcttatcgtggtggttcttttccgtgtctgagggcttccattagtactgctgggatcactttatttacatgctcagcacccacctatatggaatcaactcttcatattctttcagagtgtgtgattttgggggcatgtttttgtaactcttgccaactggctccaagagttaatctccagcttttattgtccccttgtcacaacaatacatcctcctaactaatcatgactaagaaataatgtggttttacattctggaatcgattccccacccccacccccaccccgccccaccttgtttttggtctcttataactttccagaagtttgtcgattttttccggaattaacataagttagtatttgttttgggctcctaataatggaggctatatggccagacttacaaagtgatcacagaaatacttgttgatcagcaatttggtaccaccatatagaattcatgaggtcagcttctttcaaagacatttgcctttcattattccatttgtttattgcagagaatagaagtattctgataaacgtagatattttcaggacctccacagagcattcagatgacatttttgttataatggaactttatcctaatgggcagcatcctaattgtagggtttaaatatatcactcttcctcctagcatttagaaaagggtttgatatgctttttctataaagggccagagagtaaatattttcagctttgtaggctgtatagtctctgtcacaactacttaactctgacaatgtaatgtgaaagcagctatagataatatgaaaacagatgggcacggctgtattccaataaaactttatttacaaaaacaagctcctttatttacaaaaacataggtcaagatttggctacaggccagaccttgggaattcctgcttataaattggcacctaagcagatataatggggttagcatgtttttctttttcttggagcctataacgtttggcttatgttaatgagtagtttgagagttttattgaagtaattggaatacttgaggcaagccaggatccactggtagtggaagagtaagagttgatggcaggataaaagtggtacaggccaggcatggtgtttcacacctgtaatctcagcactttgggaggccattctcgatggattgctagaagcaggagtttgaaaccaacctggacaacaaagtaagaacctgtatctacaaaaaaaaaatttttaattaactgggcatggtggcatacaccagtggtcccagctactcaggaggctgaggcaggaggattgctggagctcagaagtttgaggctgcagtgagccatgatcatgccactgcagttgagcctggacaacagagtgagaccctgtctcttaaaaaaaaaaaaaagtgtatatatatatatatatatatatagtggtacagacaggtcagctcccagcctgcagtacggacaagtcagtgatcaaggttactagcagtgtaaggtctacacggacacagtaaccatttggctgagcatttccttgttctcattagtatttgatactgatatatcatttaaattttaaagcgcgaaatcaagagtttttagaactattgaaatgtcagcatttggctttagttttgttcccatttatttagcgtaaggctaaacttttagaataaactgctgagaagaaggaaaattttttagtagaaaactgaaaataaaaggaatcatgaattttagcaatgtatggtggcttacacctgtaatcccagcactttgggaggctaaggtgggactactgcttgagcctaggagttcaagaccagcctgggcaacatagggagacctcatcttagccacatgtggtggcgcatgcctgtaatcccaggtacttgtgagaaagaggtgagaggatcacttgagccaggagttcaaggctccagtgagccgtgatcacaccaccatacttcaccctgagtgacaaagtgagaccctgtatcaatttaaaaaaaaggggaatcgtgaatttcattggagcaataaaaagagctctctgcaatataaagttagcgacatcccattgatttatggccgtaatacctaagtacctaggcccaacaaggtaactccatcaaaacacctttctctttaatgaaaagtacggttattcctcagtcagacagtaacttcaacttcaaaccaaaactaaatgaaattcgaagcattttgtactaatggaagcttgatgcagatctaaacagtttcttattcatgacataggataaaatttcatttgtgagatcttttgattcattgttataagtcctgataaaatttaatacaggtatttctcttagttattttttggtattgcttgggttttttgttgttaaggggtggttgaagaagtgacatattcttgtatgagagcgtagtaactaatgttaaattgtaaagtgtaaggctaccctatataatgatttaaaaatataaatcatgtctgttttctaaattttaaagcaattagagaaactatatttttcttagttacaggagactttaagtaaagactgacaggcaaatagggtaatattttattcaaaattatcttggcatttttgtcatttatcaaaataaatttgaaatcattttaatcttccatttggacagtatttaattttagtaatggggtttgtaatacggtagaaattatgtgtctatgtttcaactgaatagaaagattttacttttaaccacttttttgctttctgcaagtaattttttcctaaatgggcaattttttaaatttttatttttattaagacgacattatagtgcttttttaagggttttggtaacattttaaaatataaaattgttcaaaatggcaacttttttaaaatttgaaagccatagaggttatatacatttatggaaatatgtaaaaggaactgtaacaaatgtaatactaccaagtttctagtaaaacctctcttcagataaatcaaaatcttggagtagacagtatgtaaagatcctttaagcaatctgtgtattaatagtgattaatttaaatcattagtattcagtgaatggtacaaattattagaatacgattcaaaatcaagaggaattcatgctgttttccagtttgtccctcaattcacaagacctctcttattcatcaactaattagatttaacatttttccattgtgaatgctaaagccatcggccaaattaaatgaaaacaagtcccttgttgggtgcttccagaaaagtaaggccatacatagattgtgaagattgagtatgcaggatggtgtcatttaatggcatgggccttttattctgaaatggagctcttcataatcattgaaacgtggagggtagcaggccttggggtttgccttgccctgctactcccctaacagcggcagcctgtcagctgtatgctaacgaggtgaacaattaaaccgagtcctatctggctggccccacaggctctaggctcagacaaagaactgtttatacacctgttgtatgtgtagacagagccatttgaatgtggagctgcggattaaagggaagacatgggagcccaggagagcaagggttaaagagaactataagaactgtgaaagtcaaattctccagaaaatatatgagggccatttgcaaggagaatcaagttacaaagaaaaagttcctgctaacttcattgacatgaaaaactccagacttcaagccttcgtctagtctgaggccatttttttaaaggcttatatttttgctatgtgtgccagttaaattttttcttttgtaagctaattatgtttaagttcgtgtgagaaaatacttagtttgtattgttctatagtgtaaaaatatttcctggtgtttctgttgcaaaacaaatctagcacccattctgattttccttaagggaaaagtaaaatttctaagatttattatttaggtaatgatcagacactttttaatagttgagctttaaaaaaatcaaataattatttatactgatgaagtaaaaggaaatcagaattcagcagatgaatcatcacttagataagtgaaaattcaatttgttactgttcagtagtattgtcttacatagctataaaatgtttcacatgtataacatacactaagtatacatatgtttaaaatttaaattttagaaggctgttttttaaattacttggtgtgatagttcaaaatgttatgtaaaacagaattagtatatattgccaggggtcatagaagttttaagtccacattattataaatacaaatacacctcagcttttactttaacttacaattatttccccagcccgtcaaaattctcctagatttatttaatctttagagtaggcctaatcttccaaggttccaaagaatttgcagccgtatattatgtttgcccatatctatttttataaaatgggattttgaacttcctttcctcttagatcactgagtacttcatagtaagaaagcaccctcattcgttaagaataaacaagaccaggatacccttgaaacagaatttcatgaaacattttaaaaataatttgttctcttgaatacaattttcacagtccatttctttactgattgttaggttgagtacttcagattcttctcaagtttttttaggggaacaaccaaatactaaaactttctgaaagtgggaagtaggatggaagtctgccatagtttctgtggtcccttcccagctttaaggttttgtgattctaatacatcgtgaaattgtgtggtttagagaaagggtgtagtggaggcatgattattacccaagggagtagtgacacaaataatgctcagcaatgaccaatcctaaaatcattttaaaagtaactattaaattaaattttaaaatccactaaatggctatgtttcttaaaaataaagatgagaataagtgtaaaagacaaacatttcatggaaagtgtggtggaagaacgaatctattctaattagatctactaccaaatgacctgcattgcctaaaattttgctttggttccttttgtttagttcacagaaaaaccaaaggataaacttgcataggggtatttattcctcttagggtaaaatcatgcaaagtcatggaagataaaagctatattaattactcaagagggattcaaagcttggcagtttactaggattgaaggatttattgaaaaacagtggttctcatgtataactccagccaataaacctatttaattaaaagcttaatcttctagttgacacgtctgctactattctaataaaaacttcatccgtaacaagtttttttatgtaagttaatactgcaatagctgactgtttgatggtgtttgcattgcttggaatgtagcagtattttgttaaatgccagttcatgcatactttaatgtatttaggtattatatgaaatagattttcagattgatttataatacgtagtgcgttgtggcttatagaatgctttgtcagctcatttgcttctcacaaacaccctctgtgggatttaaaatttacaaattagaagtttcattttttaaaaaaggtatgttttggtttgatttaaaagcagtactgctatgaagtattaatattttgaaattctccccaaaaaccagaataatggcatccagaaaaagttgctgaaatcagatgagtgacactgttttctctattaaacctagtaaaataatttggacagttattgcctctgaactatcttaatctttttttatttttgggttttccttaactttaggttggaactcatcgggaagactctgtcagtctcaatggcaatcattcagtcctgtctagtacagtcactacttcaagcacagacctgaaccataaaacacaagaaaattatagaggtaactatattgttggttttcagaaataatgcagacagagatatcatttggaacactgtcacctttctcacagctggattgacatctgtgaatcaaaagtcattgaggtgagggaattccaaatagcgtggagagcagatatttagggttccaactggcccacctaggttgacaattacagatacttattgatgaatagagccacgtacagaccattgttcagtatttaccagttatcttttacctcttcctgttctgtcatgtccctcttcctcagacattttccctcatgagtgtatcttcatggtctttagaggcattgacagagatatttctgattatactgagagctccgaatgatggaagctgttgttttagagattatcatttgattgaagagacatgcaattttgataaaaagcaaacttgatcactgttccaatagagcttacaagtaagtgtgaagatagagcacttgaaagtgcaaataagatcaccaaaataaagttctcccagttacatttaaccatgatgcctgttttactgtttatccaggaagatgttaagcttatgtcctttacctctgcaacatcttagaagttagtttctaaaatacatagtttctcatccttgttcatttgttaaatagtgcctgaaagtgagcattaaattggtcatgggggtcagacttgttcttctaaatacaaatgctgttaaaaagcacaaggatgtggatatattcttttcagctctaaatagtatactttcctacatcttcaaacctccatcataaccctgtaactgctaaggatattcaccagctagaaagctttttattgtcttagctgtaattcatatatgagtctcgtcttttattttatctttcctttgcctctttgttaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaaggtatttgttagcatccaggttttaaattttattcattttccataggtaaacatacttgagaagctgggtgtcatgcatttattaactgtcagctatgttctagatattgtgttaggatttttgtgtatgttgtctcatttaatcaccacatcatctctataaaagagaagtatatgaaggtttgatttcaaaattatgttttccttcatactataccatttgagggactatatataaaatataattatatctcttcactcaagttgcttagtctgttagataagtagaaggtaaaatagctaaaagaagttaaatcatgtggtacggacatttagatagatttgatcaataaatatttgaatatggtcaggtgtcacttaacaatggtatatattctaagaaatgcattgctaggcaatttcatcattgtgcaaacatacagtatactttcacaaacctagcctgttgttcctaggctgtatacctgtataccatgttactgaactgagtgctgtaggcaattgtaacacaatggtaagaatttgtgtatctaaacacctaaaaggcacagtaaaaataaaagataaaaaatggtacccgtataggccacttatcatgaatagagcttgcaggactcgaaattgctctgggtgattcaatgagcaggtggtgagtgaatgtgaaggcctaggacatttctgtacactattgtagactttacagacactgtacatttaggctatatttcatttattaaaaaatatttttcttcaatagtaaattaaccttagcttactgtatgtcatttactttataaacttaaattatttttaactttctgactcttgtaataatagcttaaaacacaaacacattatatagctatacaaaaatatattttctttaagttcttttgtaagctttttttttttttttttttttttgaggtggagtcttactctctcgcccaggctggaatgcagtggcatcatctcggctcactgcaacctccgcctcccaggttcaagtgattctcctgcctcagcctcccaagtagctgggattacaggcaccccccaccactccaggctaatttttgtagttttagtggagacggggtttcaccatgttggccaggcaggtctggaactcctgacctcaagtgatctgcccacctcatcctcccaaaatgctgggattacaggcatgagccaccgcacccggcctttgtaagctttttcctatttttaaaattttgtggttttttgtttgtttgtttacttttcaaacttttttgttaaaaactaagacacaaacacacatgttagcctaggcctacacaaggtcaagatcattaatatcactgtcttccacctccacatcttgtcccactgaatgtcttcacaggcagtaacatgcaggaagctgtctctcctaaggtaacaaagccttcttctggaatacctcctaaaggacctgccttgaggtcttgtcgcccaggctggggtgcagtggcacaatcttggctcattgcaacctctgcctcccgggttcaagcagttctcttgcctcagcctccagagtagctgggactacaggtgcctgccaccatgcccggcgaatttttgtattgttagtagagatgggatttcgccatgttggccaggctggtctcgaactcctgacctccagtgatctgcccacctcggccttccaaagtgctgggattacaagcgtgagccaccacacccggccaacttttttttttaagttagaagtatactctaatgataaatagtatagtatagtatagtatagtatagtatagtatagtatagtatagtatagtatagtatagtataaatacataaaccaataacataattagttattattattatcaagtacagcaggtcctcaaagaacatcattttgtgaaatgatgagaaaaaaaattgattcctagctagagcctctttgtttgtggagtttgcacattcttcccatgtctcctcatgtgggttttctctaagtactccggtttcttccttcaccccaaaaatgtgcgtattaggttgagtaatgtgtctgaattgtcccagtatgagagagtgtgggtgtatgtgtgagtgtgccctgcaatgaaatggcatcccgtccaggattgtttctaccttgctccctgagctgctgggataggctgcagcctcccccgaccctgaactggaataattgggtaaataataatcttacttatttttatgagtctttcttaaatgtatgcatagttcacatttatttcattgtttaatattagaagtgtattttggtttttatttagaagtttgatgatattttgtcaccagaaatgtactgtagggacttaactcttatttatatcaattaacctatgataaaactggttttattatgtgtcattttccttaaagttgcagtttccaagaactgatcaatgacattgaggacttactgtagtgtgtactgtacttaattgcatgcttttatacaactggcagcacagtaggtttgtttataacaaacaaagagttaacgtgactaatgtgttgtgctgcagccttaccacagctacattactatataatagacattttttagctccagtataataagaccactgtcatgtatgtagtccctcattgactgaaatgttatgggctcataactgtatattaatataagggctaaatatatggtaagactctgatttaaacaagcaaattatggcccatgggcctacccagctcactgcctatttttgtttttgtttttattatttatttatttatttatttatttatttatttatttatttaaagacagggtctcgctgtcacccaggctggaatgccatggggtgatcttggctcactgcagcctcagcctcccaagtagctgggattacaggcagatgccaccatgcctggctaatttttgtatttttaatagagacaaggtttcaccatgttttccaggctggttttaaactcctggcctcaagtgatctgctcacctcatcctcccaaagtgctgggattacaggcgtgagccactgcgcctggctgctgcctatttttatgttttattagaacatcaccatgccacattcatttatccattgtctgtggttgttttcatactgcattgccagactagaatagttgccacagagactatatggcccatcagagctgaaaatatttaccatctggtccttcagaaaaaatgtttctttttaacaaacaattaaatagtaatttgagaaaagtatgaaaaaggaaatattctaggcagaatgatgttgtcgtggagttttctagaaaatggacttgactttgctttgaagtatgaatatagacacatagtacattagtttcaagtgatttctggatttttccttcaaatttttcttccagttctacattaaaattagatgagttaggccaggcacagtggctcatgcctgtaatcccagcactttgggtggctaaggcaggaggatctcttgaggccagaagttcaagaccagcctgggctacatagctagattctgtctctacaaaaaattagcggggcatggtggcaaacacccgtagtcccagctacttgggagggtaaggcaggaagattgcttgagttcagaagtttgaggctatagtgagccatgatcatgccactgcattctagcctggctaacagagagatgctgtctctaaaaaaagacttttttctaatgaaaatttaaaagttagatcatttagtatatttgtggtacaccctatttcttggcatacatattcatttatcaatgatatgtgtatatatcttatacagatttaaaacattgttctttgtgttgaattatggtgcaatgaggatggtagataaaactaaaagaagcagaatgttcctttctgtcattcacaacttaaaaggtgtccttttgctcttttgacattctcactgttttcaacacctaaacatttatcttgggaaaaaggaaatcttaagatcttaatattattactttaatatgtattgtactcaactatcaggggcataaggaaggaaaaaactgtgtcaaggaattcagagaccactctttggaggcatcttaactcttacatagtttttattcaaatagaattttaagggaaacaatttacatctttcctccatattcatcttcttatagatcaggaatcagcaaactttctctgtaaagtcccaaatagtgactattattaggctttactggacatacagtctctgtcacagctacttaccactgccattagaggacaaaagtagccaaagtcaaatgggtatcgctgttccaataaaattttacttacaaaaaaggatgaccagctcatagatcagtttgctgacccatattataggtcatcagaaattaggaggcagtgtaataggttagtaatagtccataataatgaataggttaataacatgacctttggacaaaataagggtttgaattgtggttccattacatacttgccgagtgactttgggcaagtctttgagctcagtttcttcttctctaaaaggagactttctgttacaggattcttgtaggaataacctgaaaatgatgcatgtaaaaccctttgcacacggtctagcacacagtaagcactcaataaagatactatatctactgttacagtggtagtgttatggtggtaattttaagtgtatggtgtaggcttgcttccatggagcactgagctgacatctcatcatcatactgccaccagttagctctgtgatcctaggtcttgaagtggttctcaaccctgctgcccagaccctggaacattttagaaatacaggtgcctgggccccaacccaaactcactaaattagtgagtctagcatctctggtagtgagacctggaaagctgtatttttcaagtgctcttggagattctaatgagtggctatctgtggacaccactgggctcgatgatctttaaaggactttttgaagtcaaagaaccagtgattttcttttgtcaaaagaatgcatttatatgattcttaatgattagcaggttaaatattgcatactttttagggacagagtctctgtttgtcacccaggctggagtgcagtggacaataacctcaagctgctggactcaggcaattctcccatgcccgcctcagcttcccaaaccacttaggttacaagcacgagccaccatgcctggcctgtgtacttgttcttttattagaatactcagggtattaaagaagaggtaaaaatgtctaatatttttgtacattatttcaaggttctgagaagctgtggtcagtaatttatatctgaatcataaatagaactttctataagctgttacagagcatctccctcatatgtttttttttctgattatgtagtctattttcattacagaaatgtagaaaatacagaaaagtatgcacaaaaatcacaagaaacaccactattcagaattaaccactgtttacttcttttttttttttcctgagaagttctaatttgatttcactgtggtctgagagacgttttgttgtgatttgtgttattttacatttgctgaggagtgttttgcttccaattatgtggtcaattttagaataataagtgcagtgtggtgctgagaagagtgtatattctgttgatttggggtggagagttctgtagatgactgttaagtccgcttggtccagagctgagttcaagtcctggatatccttgttaattttctgtctcgttgatctgtctaatattgacagtggggtgttaaagtctcccattattattgtatgggagtctaagtctttttgtaggtctgtaagaacttgctttatgaatctgggtgctcgtgtattgggtgtgtatatatttgggatagttaggtcttcttgttgcattgatccctttaccattatgtaatggccttctttgtctcttttgatctttgttggttgaaagtctgttttatcagagaccaggattgcaaccgcacaacccctgctttttttttttttttttttttttttttttttggctttccatttgtttggtagatcttcctccatccctttattttgagcctatgtgtatctttgcgcatgaagtgggtctcctgaatacagcacactgatgggtcttcactctttatccaatttgtcagtctctgtcttttaattggggcacttagctcatttacatttaaggttaatattgttatgtgtgaaattgatcctgtcattatgatgctactggttatttcacccattaattgatgcagtttcttcatagcatcgatggtctttacaatttggcatgtttttgcagtggctggtaccggttgttgcttaccatgtttagcgcttccttcatgagctcttgtaaggcaggcctagtggtgacgaaatctctcagcatttgcttgtctgtaaaggattttatttctccttcatttatgaaacttagtttggctggatatgaaattctgggttgaaaattcttttctttaagaatgttgaaatattggccccgactctcttctggcttgtagggtttctgcagagagatccactgttagtctgatgggctcccctttgtgggtaatccaacctttatttctggcagcccttaacattttttccttcatttcaaccttggtgaatctgacagttatgtgtcttggagttgctcatcttgaggagtatctttgtggtgttctctgtatttcctgaatttgaatgttgacctgccttgctaggttggggaagttctcctggataatatcctgaagagtgttttctaacttggttccattctccccatcactttcaggtacaccaatcaaatgtagatttggtcttttaatgtagtcccatatttcttggaggctttgttcatttgttttcactcttttttctctaagcttgtcttctcgcattatttcattaatttgatcttcaatcactgatatcctttcctctgcttgatcgcatcagctattgaagcttgtgtatgcttcacgaagttgtcgtattgtggttttcagctccatcaggtcatttaaggtcttctctatgctggatattctatttagccattcgtctaacctttttccaaggttttttacttcctcgcagtgggttagaacatgcttctttagcttggagaacagctttcttattaccgacctcctgaagcctacttctgtcaactcatcaaactcattctccatccagttttgttcccttgttgatgaggagttgtgttcctttggaggagaagaggcgttctggcttttggtattttcagcctttctgctctggtttctccccagctttgtggttttatctacctttggtctttgatgttggtgacctacgaatgggattttggtgtggatgtcctttttgttgatgttgatgctattcctttctgtctgttagttttccttctaacagaccggcccctcagctgcacatctgttggagtttgctggaggtccactccagaccctctttgcctgggtatcaccagcggaggctgcagaacagcaaatattgctgcctgatccttcctctggaagcttcgtcccagaggggcacccacctgtatgaggtgtctgttggcctctactgggaggtgtctcccagtcaggctacacgggggtcagggacccacttgaggaggcagtctctccattatcagagctcgaatgccatgctgggagaaccactgttctcttcagggctgtcaggcagggatatttaagtctggagaaactgtctgctgccttttgttcagatacgccctgccctcagaggtggaatctagagaggcagtaggccttgctaggctgcggtgggctccgcccagttcgagcttccctgccacttcgttcacacagtgaacataaaaccacctactcaagcctcagtaatggtggatgcccctccccctgccaaagttaggcatcccaggtcgatctcagactgctgcgctagcagcaagcaaggctccgtgggcctgggacccaccaggccaggcacgggagggaatctcctggtctgctggttgcgaagactgtgggaaaagcgcagtatttgggcaggagtatactgctcctccaggtacagtcactcatggcttcccttggctaggaaagggtaatcccccaaccccttgcacttcccacgtgaggcaatgccccaccctgattcagctcaccctccgtgggctgcacccactgttcaaccagtcccaattagatgaaccaggtacctcagttggaaatgcagaaatcacccatcttcttcttcgatctcactgggagctgtagaccagagctgttcctatttggccatcttggaagcaacccacctcggcaatgtattttttttaagtattttgtttttgttttggatcagctttattgaggcttaatacacatgtaataataaaattcactaattttaaatatacagtctttattatgtatgttaaaatgtatatattttgtcattttgacaagtgtaaaagttatttaacagccaccttattcataatgtagaatccacctcaaaaaatgtccttattccccttggtagtgagtccctttcctccatcccgtggtccttggcaaccattgatctgctttctgctaccatagttttgtgttttctagaagttcatgtaaatggaattgtagagtatgtatgtgatctttcatgactggctttttttacttagcataatctgcaacttgattttagatacaacataatgggccattgtctgaatgtactatgatttattgaacccatttgctattattaaatcccaatatgttgctaatgtaaataattctgtgatcatctccctttacataaatttctatgtacatctctaattatatccttaggatgaatttccaaagttggaattgctgatcaagaggtaataaacattaaggctctggattcgttttgccaatttgcccttcaaaaaattgtgtcatttctcccatgttttataattatcaccactgatgataatttatctctagaacaaaaaaatagccgttttctgggatacttctctcaatctatatcttaagctttccttctttcttttcgccaggtaaccgccagagtatatttaagagcataggctaagcaaattatacattcatgtactaggggggcttttaaactgtaatgtgtatatcagtcatctgggaaacatgttaaaatgcagcttctaattcagtaagatgggagcagaacctgagagattctactccagtgtttttaacaagctcccagtaatgctgatgctgctgatttgtggatcacattttgtgtagcaaggtgctaaaatattatgtagttgttgatcttatatttatgaagagtttctggagaaatctttatgctataatgtgcaatgaaaaatgcacttaagagtgtatgtagtatatttcaactgtatgactgtatatgtgcattgaagaaaaatttgaaaggaatatacagtcatgttaactgcacctattacaactgtttacaagatttataggtggttttcatttccatctttacgctttataattgtgcacaatcagcatatcttactttataggaaacctaatagaccttgttgttactttattttctagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagaggtaagtaggttcagccgagatgtataactgttctgcttcagatgggcagacatttctgtttacagttgctcttctgcttggagaagttgtttgttatttctcccagtacttcttctactgtatcatcagggtcgtttttcctgtaattctcacttctgtctcactgtatcacccaatatctgtgggctgagtgttctccaccaatagagagtaattctgtgaagcaaagcagataacaaacagcctctgcctgctgctcagcaatagtgctttgtgtctctttgctctggttgcttctgatctctcaaccattaaatttccctgcctggacctgccctcctccctgctctttatgtctttcctacttctctgtattcattttcttgcctgctctactttggagtatctaccgtgccctgctggttaataggatgccttgttatcatcccttctgcctttgccagatacctttacacccatgtcaataaggtctcagggcttctttgttgaccccagaccaggaacaccaagaactttttgggctaacatacatcggcatgcctctgtgtccttaagggcaaaagagctcacccagtgctgactcagtttcatttttcaggaagtttgttgcagttttgaagaaactttgaaacttcatttgttcaacatgtatttattgcatacctcctctgttccaaccagctgtgtcctaggccctgggttatcaaataatagaagcttcttatctttaagaggttttaccatcaagcttgagtttctccatatacttatatattgtcttaaaatatcctaagcctttttgcaaggaattcatagatgtggccctaggttccagatctgaccactagtctctctcagagcaattctttcgattttgtgtgaagacggttcaaaaaagaatagggtgggcagatgcttgaaaactacagccatggagcctcagcattagattacagaatgagtactctttcttaggaaaaccagagttagagaacttgaacaaactttcagaaatatatacagtagtagttaattcatccacttccctccaatatatttaatgaataagaatgagggatagatcattttgtgtataatcaacctaatgttaaaaatggatacttgctcctcttctcccaaggtccttgaaatatctgtggagtataaatgttaatgaaacctaatcttcaagtaattatagactcccttgtgatatccataaggaggcagattgttacccactcgcctgtggcagaagcagtggttccttgaactactgatacctcctgtcactttaccaatggttttttttcttgaattgtgtctgacaccctttgtctcgctctgaaggcagcaaggcacctatgttcagtggttcaagtacactcatcctcctcttcttcagcccaggatatcttctatcctgacttcacccagccatttattgttaaagccactgcctccatctcagctgtaaaagtcttactgtctggtcaacaggagtaccagaatttattctagtacacagcaccttttcctcccatagtgcattagaatcagaatgcagtcatttgtgtttttaaaaactttttttttaagcacagagatacctacttcagatctaagccattaaaatgagaaatacttctgtgatggaaaaacacaaacataaataaataaaacataaattctaccatgcctagatggaccttattcatttgtaacattggaatttccagtggttccatgcgggcacctagaacagaaaatatgagtctgagagaagatctgtcatctaggctttcttactactgactttctggtctgttatgggtactgactgtttcatacagttctgtaaagctctgtctaaggactctttgactgatgagagtttgaacagatttcaaatacactgaactgtaacttcgttagggattgctttgatattcagaaaagcctacttctccccggccttcagactgggcttgaagccttatcttaggactttacataaaagcccagggatctttgtaaggtaggggtgtgtgtgtgtgtgtgtgtgtgtgtgtgtgtgtgtacgtatgtagagatggtctcactgtgttgcccaggctggtcttgaaatcctggcctcaagcgtctataggcctgagccaccatgcctgggctcagactccttgaaggacactcttatggctgtcagatagggtttagaacccttcatacaggccacaatacctgtgccttgtctttggcaacaccttcagagttttgtatagccactgtcttttcctcgatttacctacagttttgagttattttggtgacttgatcacttttgagagcctcttcatcctgtacagagaccctccttagcagtccctgatccaacactttctataaaaacagcttttgtttacatgacctatttgggcatcctctgcactctggctccccttctgatttgggatgatgctgcaagactgtatctgattgtgacccaacctgtcacaatcactggatgcttatttttaccaggaggcaagcagacccaggtctagcagttcatcccagagaagagtggcttctcttctaagcctcagattttgccagagcattttttgtgccttgttgccccacctgtcaaaccctaagtccccactgccagtttaagcttttccattatcatgactacaacgttatttgtacctttgccatttttattccccagcagataaaacaaatgaccttcaagtttgtactctcagcgttactcaagactcagtggttaaacatttcctcctctcaagctctttcacaggtcagcttagtcaggtcactgttcttttgataatttagtgatgagagaactattagattttcagtttcctgttctacaagtgagtttgaacataaatggtgttggacagtggttttgaaatctggctggtcccagaatcacctgaagcttttctttcctcaaacatttccaaaccttaccccaggagattctggtgcaatgagatggttaaatgtggtagacttagcatatgcagtgataatactgcaatctttcctacatccccactaaaataaataaaaatgatattcattttaacccacaaggacagatgagagaggagaccatagcagatgaaatagcgaaagctgcatgtaggatagaaagtcgatggaatagtggtacttatttgtttctaagtactgaagaatacatgtttcaagagtggtaagatctaatcttgtgctgaatacagtgatttcttaaatgccccgaagttaaaatacataatcatgaaatttcagagcattcgggtaaaaaaaatattctaaagcttctggagataaaatataaatagcttatagataaagaaacaagaatcaaaatatcatcagcgttctggacagtagtactggattccaggagatagtggagcagcaccttcaaatttctgaggaaaataatttcaacctagaattcttttttttttcttttttttttccttttttttttttttgaggccgagtctcgccctgtcacccaggctggagtgtagtggtgtgagcttggctcactgcaacctctgcctcctgagttcaagcgattctcctgcctctgcctcctccatagctgggattacaggcacgcatcaccatgcccagttaattttttgtatttttagtagagacagagtttcaccatgttgaacagactggtctgaaactcctgacctcaggtgatccgcctacctcagcctctcaaagtgctgagatcacagacgtgagccaccgcacctggccagtttcaacctagaattctataccttgccagacaattaatcaaaagatggatatagaatgaagatattccacataagctgggcatggtgtgtgcctatagtcccagctacttgggatgttgagtcaagagaatcacttaatcccaggaatttgaggctgaagcgagctgtgatcatgctactacactccagcctgggtgacagtgccaagtccaccctgtctctaaataaaaattaagttggcagccgggtgcagtggctcacacctgtaatcccagcactttgggaggctgaagcaggcagatcatgaggtcaagagatcgagaccatccttggcaacatggtgaaaccccatctctactaaaaatacaaaaattagctgggtggggtggcgtgcgcaagtagtcccagctacttgggaggctgaggcaggagaatcgcttgaacccaggaggcagaggttgcaatgagccgagattgtgccactgcactccagcctggcgacagagtgagactccatctcaaaaaaaaaaaaaaaaaaaattaagttggctgggcacagtggcttatgcctgtaatcccagcacagtgggaggccaaggcaggaggatcccttgagcccaggagatgacttgagaccagcctgagcaacagttaggccgcatctctaaaaaaaatttaaaaattagctggatgtcttggctcatacctgaagtaccagctacttgggaggctgaggtgggaggatcacttgagccctagaagattgaggctgcagtgagctatggttgtagcaccacactccagtctgggcagcagagtgagaacctgtctcaaagaaaaaaaaaaagatatatcagatatgcaaatcctttaaaaatttaccttccatatacatccttttaaaaaatagagacagggtttcactgtattgcccagggtggtctcaaactcctagcacaaacgatcctcccacctcagcctcccaggtagctggaactgcaggcattagccaccacacctggctcgtgtatattttttcagaaagcatctggaacatatgctttaaccaaataagtgcataatcaacaaagacaaatgttatagaatccaggaaacaaaggatttaacatagaaaaacagcaaaaataaatcccatgacaagagctactgggcctagagagcaactagtccattgaaaattgaatactattagctgcagaagaaaggtttccaaggaaagaaaatggaattaattgatgatgtgttcaagattttaggaaaatatattgataggcatttgttagatctcttggagcattcagtggtggggttagggagacggaatttgcattactaacaaatgaaaaaacaagtagctattaactataggaaaaataaacagttatatgagcaagggagcaatcactgtaaaaaaaaaaattttttttcttttccaagttgaggtcagatgggtaatgtgctgaggtcataacaaggttggagggtggcacatctcacacacactcgtgaacacccaatcatcatgctcatgaactacaaaaggatcaaacctttcctccctctccctctctctccctccctccctccctctccctccctcccctctctctccctccctccctctctctccctctctctccctacctctctctccctccctctctctctccgtccctgtctctccttttctttttctttctttctctttctctctttcctccttttttctttgtttttctttctttctttttgtcttattctttatttctgtctttgtttcttttttgttctttcctcctgtcttccttccttccttttttttttttctcctttcctttcttttcttgtcttgtattttcttttctttcctttccttttctttcttcctcagggttttgctctgttgcctaggttggagtgcagtggcacaatcatggctcactgcagtctcagcctcccaggctcaagtgatcctcctacctcagccccctcagtagctgggactacaggtgggtaccagcacacctggctaatttttaaatttttgtagagacagggtctcactttgttgcccaggctactgtaaaattcttaacctcagcagctatctccatatagtcataataacataaatattttcctagtcataataatgtaagaagtgactagtgagttagccaaaaattttgctataaacatgttgcaaagttgatgttataagagagtcaagtcctcaactacataagaagtcaatagatagaattcccctaattgaaatatgggaagacatacttctcatgccctgcaggtaatgagaagtaccagatctttctggctacttagcacacatttgccgtggtctgtgtcacacaccaagaggtatgaaagagtagccttagtcttttttgaatcaaagttgtgtatttatttcacatttcctagagtctgccatagtattgttcttcctgccagaagtgttctttgtctgaatataggaacctgaaagatcttgcctaatttactgagtttttggtgctgatccttccaagcatttctcatcatgtctcctagatcctggtgtgatagagtcatagttggctaagagcaattttccattataaagagaaatgtgagccttttttcagttggaaaattttcacatctcacattctcctctttaagttttacatgctaatccatgccatcttctcagtctctcgggtcattatatgagactttaacctccacagtctcacttttttttttttttttttttttggagacagagttttgctcttcttgtcgcccaggctggagtgcagtggcgcgatttcggctcactgcagactccgtctccccagttcaagtgattctcctgtctcagcctcccgagtagctgagattataggcacccgccaccacgcctggctcactttttgtatttttagtagagatcgggtttcaccatgcaggctagtctcaaactcttgacctcaggtgatccgcctgtttcggcctcccaaagtgctgggattataggcatgagccaccacgcccagcccacagtctcttataaaaaacaaactgatgaaggacgaactcttatttgttagaggtgcacaactacttattaagaaagcagctcttaatattttttgcataatgatgaacatactattttttcctgctagttaccctaataaattaactaagagtgtatctttcttccttcattcatcctccttatagttgtataggctctatgtctttctaaatacaggggcttagaaaattagaactctaaaatgaaattttattagtatgcatcactgatagtcaggagtcagctaagtttaccataatgaagatttttgtttactttttaaaaacttggatgtgaactgtaaatgtgtattgaaatttatacatccagatacacttttacctactttaaaggggaatccggcacagtggcacttgctggtagtcccagctttttgacaggctgaggtgggaggatcctttcagcccaggagttcaaggcaagtctgggcaacgtagtgagaccccatctctgaaaaaatggttgggggtggggtggggacatggaaaaaggggagctgtactaatggtatatcggctatgccctcatttcaagaaaatctgacataaaatattacaacttctaaaaaatactattttcattctagactaattacaaatgatccctttatattatattcattagggcatttttaatccatttataaaaatatgtggaacaactgttaacctatactatatgttataatcaaatgaaaagctatatcagaagctatggatatcttgggcttaaaactcattttttaaaaaatccaacaggaatagtaagtagtgtgtaagtagattttgatccagtgggtttttgatctgatggatattctttccctttatttctcacagtagcaccctattctttttttttttttttttgagacagggtcttgctctgtcatccaggctagagtgcagtggcacgatcactgcagccttgacaactcttgggctcaagcgatccttgtacctctcagcttattctttaacctcttttgaaaatgcccgtgtcacagatcccacgcagtcttgtttgctatcttttataagaagcagcagaggtttttaccacccttttaataacacctccagcaatagaaagaccaactcattcatcttgtttcacatacatatcaaagtagaaaagtaagatgtgctccacctatctatccttctccctcgaattggcacatttcctatagaagaggggtccccaacccctgggccacggaccagtaccagtggcctgttacgaacgaacgggctggctgcaccgcaggaggtgagcagagagcaatccagcaaagcttcatctgtatttaccgacactccccatcatttgcatctccacatcctgtcagatcagcggcagcattagattctcataggagcatgaaccctattgtgaactacatatgcaagggatctgggatctaggttgcttgctccttatgagaatctaatgcctgatgtgtcattctgtcccatcacccccagatgggaccatctagtttcatgaaaacaggctcagggctcccactgacttaatggtgagttgtataattatttcattttatagtacaatgtaataataatagaaatacagtgcacaataaatgtaatgtgctgaaatcatcctgaaaccatccctgcccccttccccccagccccccgcacccagttcatggaaaaattgtcttccacgaaaccagtccctggtgccaaaaaggttggggaccactgctttagaggaatagctgaggatatctcttactttatccttttctgaactggtaacattttagataaagcacaggtgtctctctctaagtacaagatgtcagcattcatgtcaattcagtgtaccgtgtcttagtaggacattgaagagacttggtagcctaataacaacagcatttgccaaaatgtttgagtgaagagtagcattttgatttaaatcaaatcaaaccctagaaaactaaatcataagcaaaaaatgaagaaaacacaagatggtcacttagaagtataaatctggaggctcagttcaatgctgaggttttatgtgagcacattgtttcttctatgtgatggtacttagtatgggaatgaagttacacaaaacaacagcaatttgttcagcttgagacctaattcataacttaaaaccatagtgataaaaattctttccccctgttttagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccaggtaagtacgggtttgaaaagaaacagcaaggaaataaccttaagattcatcttaaactgggttagaatctttgaacagaattctctagtgagcagtggccattgtaaaggtcacatgtaatttgaaatataacagtttgtctttctgttacattatcagacttagagagccagtgtcattttatagcaaattgccattttcttcaaagtgtggcagtatcttgtgactttggttcttctgttcggagtcatcatgtgtactctcttacatgagtatcttcctgatccaagaagaaatagtacaatgactcaaccgtcagaaaacgctcttgttaccactcatgttcttcatttctttattcagaaatgctgactatatcatcaaccagttttctgccaattatctagctttttgtcatgaagcctttatacatgaaaaagttatcacttgtatttggatcaataatgcaagtttatgatatgatgcttcttccccacttgcaagcacatcagttaacaccctctagaatctattaatgaatgggaagttattatatatgttagagccagaatgcccttctctctggtggaattttacttgttcaaagactgttctttatatcttccttttcatggactaaacataattcagttccttgtgattttttttttttttcctcaagacagagtctcgctctgttgcccaggctggagtgcagtggcacgatctcagctaactgcagtctctgcttcccaggttccagcaattctcctgcctcagcctcccgagtagactagctgggattacaggtgtgcaccaccatgcccggctaatttttgtatttttagtagagatgggatttcacgatgttggccaggctggtctcgaactcctaacctcaggtgatccacccgcctcagcctcccaaagtgctaggattacaggcatgagccacctcgcccagctggtaacttcatttttataatctgctttcagcagtatgtagtttttttcccaattttatcaacagattaaaggtagtaagtaaaggcagatgagtgcggggtgtggaacagaaaaaaatatcaagtgcagtttcatttggtcagtttcgtggctgtctcattttgaactgaaagtctggaatttgatagattgtttgatagataaactacaaatattagtaactcaccttttcctgagggttttagttcctaccgccactacatatatagggtcaaatgagactacatatagggtcaaatgagactacatatagggtcaaaccagaccacaaagaagatttcatttagggtaaaagaaaagaagagttaaggcagttatttcgtaagtcagttataactgtaacattagcacactggagaaaacctcaaactacctcccccacaaaaagtatccagcaatctaacagattgtacatgtcagggactttaggcaagagctagtttacagatcctctaaaacctagatcattgtttcatactctgtagaaaatatagactactatgaaacagtaagtatttttgcttcaaaaataaactttgaagtttttttgtttgttctgggatttttttgttgttgttgttgtttgtttgtttgttttgagatggagtttgactctgtcgcctgagctggagtgcaatggtgtgatcatctcggctcactccaactcccgcctcctgggtttgagcaattcttccacctcagcctcctgagtagctgggattacagacatacaccaccacgcccagctaatttttttgtatttttagtagagacagcgtttcgccaggctgcccagcctggtctcaaactcctgacctcaagcgatccgaccacctcggcttccccaagtgctggcgttacaggcgtgagccgctgagcccggccaaaaaattaactttgaagttttaaaataaaaccatgccactatttctcagtgcaaaagagactttctaaactgatagattatttcaaagaagagtgatgggagaggtaacttatgctcaggtcccagataaccaccaagctgtgaaaaagagcactaggcattctgccctaacacttctcttggagcctgtgtcttatttttcttgtctcgctctagttagttctacccatttcctcttgttttcttctcagtctctcttactcgttcaactttgtcttcttattctcatctcgtttccttctgtttacttcctgtgcttttactacttctctatttcatactgctctcatagctctacctttatctctttataatgtggaaattttcccacttaggttaaaattaaactttgggcattcccacctatcaaaaaaggatcaagaattcttttaagtttaaaaaggcatcaagatatgagacatgtagtgaatgcactttgttccatagattgtataggctagtgtttgtcatcttagaatatgtgttaaggttgctaatttcataaagatagttatctggtttcataaattggatagcagattaaaagtagcaagagacagggcagcaggaacaatgctactagaatcaaaatggctaagacatgaccacagaatgactggttataaacgtacaaaaatttgccatcctgtaatgtaggccaagtagctttgaatatcttagttttccgtccctaagagcattgctgtgtacctaaacaatactgtggttattgtttaataaggaagtaaaagttatgattctatctaaaactattttattaaaaatttaaagtagaaaatttcagagttactgctatatatattatattgggaacataagtatgtatagaatttgtactaatagagtaaaatattcttaataaatagcaaacatttgttgaggacctactgtggaccaggaactgggaccaatatgaaaatgaatgcaaggtagcctctgacctcaggtgctctcagtttagatgaaataaatgtaaactattaacactgtggttgagtggaggcagcagcaaattgagggctttaccattgtctcactactgaggaatgaatgagtagcacctcagagctcagttattgccaacttgagtgttattaaaatgaaggtttgcatcattgcggcagctgttttatacgcctatagtttgtgattctgtaatcgcatgatctcctttaaaaatcttaccatatagccgggtgtggtggtgcacacctgtagtcccagctactcaaagactgaggtgggaggattgcttgagcccaggagttgaaggctgcgttgagccatgatcatgccactgcgctccagcgagggtgatagagcaagacactgtctgaaaagaaacaaacaaaaaaccttaccatacacatcaagtaaaaccatttcagtataccttaaaaggaaaaagttcattaagtcacttagcagactacaaatttagtgcagacctggatatagatgaggaataccagcatttttttgttggtgggagggggaaggtgttttatttttaacaattatgtactaactggtattgtcctctcccttggctgtccctgccacagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatcttttttttaacacagtaaaatagtgagttttttacatttctctttctcaaataataatgtattttgttttattttctccatctcattcgtcccagaaacactcacactgcttttcctaactgcattaccgacattatctgggaaacccttcaggacagaatcaggcttgtggagctaagttggcaatctggtctagagcttctctagcttgtgcttttctcctcttgccctcactactgacggtggccttttaaccttttcctaaagattgaccaaacagcaactagtagttatagaaaatctactcatttgtagatacagagaaaaatgaagaagatggaaaaagactcaaaagaggctttttaagttattcttcaaagcacttttcacatttccccataccctttctcacaaaaaaagtgtcataattaagtaatggtattgtttactgtttaaaagttaaaagatcaaaaatttgcttttatcccagtttttaaccacaaaaaaaagcgtagggattatccatgaggacttcatgccaagcaagaacctcaaacaaactagacaaactttttttttgacagtgaatgactttttgtaggacctgtgcgtgcgaaacccatggcaattgtcacatcctcttggtatgctggcagattgcttctcttggtgaattatgaaatccactgttcacattgggtgcctaacagaacattttgcttcttgtgggatttagtgaaaactattaaacttgttaagttgattttatacaaaacgataaataaaaagctctaagaagaaaatgtataatcttagagctgaaataaaatatagagaccatctagtaaatgacctcattaatatatctgtgaaaactgagactcagattgtatgtctctaagaacacataattagtaacagatcaagacacttaaaactttccctacaaaacctccctgccttgactttctctttctctttgcagatttctaggccgcttctgctcagtgtcttcattttcttccatatttgttttatttcatttttcttttctatagttcatgttttctttttccttggaaactcaaaatttaaacacacgtcgtgtgtgtgtgtgtgtgtgtgtctgtgtgtgtgtgacttaaagaatcttaagctttggcattaaatagtcctcgattcaaatctaagctcaacatctgattaacttcattttcctatctgaaaaatggagataacattagaattgtgtaagtattgaatgaaacaatgtatggaaagctcttatggttcttgtcacctaagaagtacttaataaatgataaatatttttaaataaataatattataaccaactcccaggatgattcctcttcagccatcctgtcagaggtaaatggtaaaataaacccccagaagatgtcaacccatctttgtaggagtctacattcttttgcagccatccaatgaaacactgcatttcttttcagtgccctcccatggctgcattttaagaggattttttttttttttttagaccttcacatttcaaaagagtgagtctggctgggcgtggtggctcacgcctgtaatctcagcactttgggaggccaatgcgagcgatacacaaggtcatgagttcatgaccagcctggccaacatggtaaaaccccgtgtctactaaaagtacaaaaattagccagctatggtggcaggtgcctgtaatccaagctacttggaaggctgaggcaggagaatcacttgaacccgggaggtggaggtttcagtgagctgaggtcacgccattgcattccagccaggggaacaagagcaaaactgtctcaaaaaaaaaaaaaaaaaaaagagtgagccagtaggctttgcccagtcacactgtgtgggtggacagctgtatcagtttgggttcttaagacagatgccaagaggaagttagaagggtaaaggatttattaggagatgtacctgtgaaaaacaaaagggcaaggaatcaaaagtagacagggatggtcttcacaccatgctgcaggtttgacattaaaagaagggcaagtaaggaaggaggattaggtagggagagcctcaggctgcctgcagttctgaagaaggcccaagcagcccagtgagggtgttctggcacaaagattgccggtgaaggaggcttgtgttgggcaggaatggcaaagtatcagtgtccctgttttggtcagttattgactgggagttacatggggagactgaggcctcagtttgaacactgcaacaaaagtgctgcagctggaagccaacagctaaccactctttcccaacaggttgtctttgaagggagacctcaggtgcacctcatggcttccacagcacctcatcttcctacaaaagagcaaaataaaaccaaagggtcttctgaagtcactgagacaatagctgatctcattgggccaatgagtcttctaaaaattgcagttccttctcccttggcattccacagtcaagtaaacttacacgtattgtctggaagaatgaatcccattcctcctccatcttctttggctctggtgtgggcttatgtaatctggatacaatcccataaagttgctgtgtttagtaatgtcatttctccgtgtctgttggggactggtttcacgatcccctaaggatagcaaaatctctggatgctcatggcctttatataaaagggcacgatatttgcatacaatctacacatccccccacatactttcaatcatctctactcataatactgaatacaatgtaaatcctatgtaaatcgttattatgctgtattggttttttcgtctgtgatattttcagtattgcattgttttgttgtgaaaacagggtcttgctctgtcacccaggctgaagtgcagtggtatgatcctagctcagtgtaacctcaaactcctgggctcaagtgatcctcctgccttgacctcccagagttctgggattacaggcatgagccaccatgcccagcctgtaatggttttttgttgttgttgtttgagacagggtggtacattattgccaaagctggagtacagtggcaaatacatggctcactgcagcctcaacttccttggttcaaacaatcctcctgcctcagcctttagagtagctgggagcataagagtgcacccctatgcctagctaattttttttattttttgtagagttggaatctccacatttgccaggctgatcttaaacttatgggctcaacctatcctcccaccttggcctcctaaagtgctgggattatagatgactgcgcctggccccttgttaatttatcattagttttttttccccccaatatttttgatccatggttgcttgaatatggatatgggacctgcatgcagattagaaaggccaactgtattctggtgttcttcacaggacaagtgacactccctgcttgctgggtcagtggattgtccacgcgtctttgtggtcacctggcttaggaagctcacaaggtcctcatcatttggaggtgtttccctgtgagtgccctcagccctaggctttcttacgtgtgcctatactggaggatgtatatgggagtagagatatctttcctatgtttgttatctttctctctttagttattgccaaaagacaacctggagaggttttctgttctctttgacgcagaccttcaatcccttccccaaactgtcatgtggtacctctgctgtcttctgccagggtctcctttctcactcttgagggtcagtgttccactacgctgggtccccagggtctctgagccattttgtctttgggcttggtgagcaccatgtgcaagatttccaagtctttcaaagcttgtgaaaatgtttgcaatctgaaaaaatattacagtgccaaaagaaaaaaaatgcaaaatgaaattaatttcaaatacaattacaaaagtcatacaaaattgttatagcaaaactaaattgctgtttaatgtggaacttgagcatattttaatgtatttgatcttattaaatttggtatagaaggaatgtaccttaacacaataaagaagcatctatgacaaacccatagctaacatcctaactcactggtgaaaagttggaagcttttcctctaagatcagaaacaagacaaggatgcccactctagccacttctgttcaacatggtaatcctagccggagcaattatgcaagagaaagaaaagacagccaaactggaagaagtttaactgtccctgtttgcagataagataatgttataatacagaaaaccttactgattctaccaaaaaagttagaactaacaaatgaattcagttaagttgcaggatacaaaattcaacatacaaaaattcatagcatttctatacactaacagtgaactatctgaaaaaaaatcaagaaaacaatcccattcagaaaagttaaaaaaattaaatacttaggaataaattaaaccaaagaggtgaaaaactgatacactaaaaactataaaacataaattgaagaagatgccaataaatggaaagataaaccatgttcatgaattagaagaattaatgttgttcaaatgtccatactacccaaagtgatctacaaacttaatgcaacccatatcaaaatttcaatgacttttttcacagaaatagaaaatatcctgaaatttgaatagaaccacaaaagaccctaaatagccaaagcaaccttgagcaaaaaacaaaactggaggcatcacactacctgacttcaaaatatactaagaagttatagtaatcaaaacagtacagtactgacaacaaagaagacacatagacaatggaacagaataaagtgcccagaagtctgtgtatttacagaaaattgatttttgacaatggtatcaagaacacacatgaggaaaggacagtctcttcgataaatagtgttgggaaaattgtctacatgcgaaagaatggaattagacctttatctcataccatatacaaaaatcaattcacagtggattaaagacttaagacctgaaaatataaaattgctagaagaaaacaagatttaaaaaaagaaaataaaagaaaagaaaacaagataaaagctccatgacattggtctgggcaatggttttttaaatatgatccccaaaagcacagacaacaaaagcaaaaatagacaaataatattatatcaaactaaaaagcttcacagcaaaggaaacaacagtgaagagacaacctggaaaaaatatttgcaagccacacattctgataagggtttaatatccaaaatatacaagtcaatagcaagaaaaccaagaacccaattaaaagctaggcaaaggacctgaatagacttttctcaaaaaaaagacatacaaatggtcaacatgtatatgaaaaagtgctcgacattattaaccatcagggaaatgaaagttaaaacctcaatgagatattacctcacacatggcagaatggctattatcaaagatggcagggcacagtggctgatgcctgtaatcccaacactttcggaggcctaagcagaaggatcgcttgaacccaggagttcgaaaccatcctgggcaacagagtgagtctccacaaaaaataaaaattaaccaggtatggtggcgtgcacctgtagacccagtgacttgggaggctgaggcaggaagatcacttgagcccaggagtttgaggctgcagtgagctgtgattgcaccactgcactccagcctgggtgacaaagtgaaaccatgtctcaaaaaaaaaaaaaaaatgcacaaaagttaaggtgttggcaaggaagtggagaagagggtacccttgcacactgttggtgggaatgtaaattactattatagaaaacattataaaatcatacattgtacattatagaaaacagccattatagaaaacattacggaggtgctcagaaaaatagaaatagaactaccatatgctccagcaaccccactactgggtatatatccaaaggaaataaaatcagtatgttaaggaaataatctgcactcctgtgtttgttcattacagcattattcacaatagccaagatacagaatcaacctaagtgtccgtcagtgaataaatggataaagaaagcatttacacaattaaatactgttcagccttagaaggaaatgctgtcatatatgacaacatggatgagcccagaggacattatattaagtgaaatagcccaggcaaatactacatgatctcatttatatctggaatgtaaaaaaaaaaaaaaaaaaaaaaaaaattgaggccaggcgcggtggctcacgtctgtaatctcagcactttaggaggccaaggcaggcagatcacgaggtcaggagtttgagaccagcctggccagcatggtgaaaccccatctctactaaaaatacagaaattatccaggcgtggtggcacaaacctgtaatcccagctactcaagaggctaaggcatgagaattgcttgaacccaggaggtggaggttgcagtgagccaagatcacaccactgcactccagcctgggagacagagcgaaactctgtcttgggggaaaaaagaaaaattgaatgcatagacgcaaagagtagaatggtgggcctgggggtggcgagaggtggggcagtgagggagctggggagatgttggtcaaagggcacaaaatttcagtgagacaggagaaataagttcaagagatctgttgtacaacatggggactatagttagtgtatttgtgttctcaccacaaaaaaaattatgtgagataatgcatatgtcaattagctcagttgagccattcacaatgtatacgtatttcaaaacactacgttgtacacaataaatacatacaacattttttgtcaattaaaaaaacgtttaggccgagcaccccagcattttgggaggctgaggcagaagaatcacttgaggtcaggagttcgagaccagcgtggccaacctggtgaaaccctgtctctaataaaaaatacaaaaattagctgggtatagcagcgtgcacctgtaatgccagctacttgggaggctgagacatgagaatcacctggactccagaggcagaggttgcagtgaacctggtccacagagcaagactgcactccagcctggcctacagagtgagactcagtctcaaaaaataaaaaacaacaacaaaaaaaaaacttttaaatctatttgatacaacataggctgggacttccaaaattttaaaaaccatcctaagttccttcagtcctagagttctttttcagttatcactgtttttggttctctggcttcttgatagtctccttggaagaaaaacaactgcatctttccctctaaaggcaagggccatctctatatctctgaagatctaaccttctgccacagttcgaatatgttggaaacgtaatcccccatgcaacagtgttgaggggggttgcctaataagaggtcatgagggctctcctcccaggctgttttgccctgccgccttccaccacggatgatgtagcacaagggccctcaacagatgccagcccctccgtcttgcactttccagcctctagaattataagaaataaatttctgttattcttttttaattactcagtctcaggtattctgtcatagcatcagaatacacactaagatacctgcctaggccatgaggaccccaagacacagcacaaattttgtacaaactctaaccagaccacctttttcctactcccagggtgaggtccttccttcccctgtcccttgcagccctatgggcttttttgctttctctcattctccgggccttctgcagctctatttcctgcaagattgcatcttttctcctggatatttggtcgtcgctgggctgaggtggcagcctagtgttgggagcaggcttctggctggcctctgatcagtaagccagaggggtcaccttgtcctgaaatacaacccagccattggccatgttttccaccatcttatgagtattcccagtgaccaacctcagcagttcaagacaagttgggttacacaacaaggcagcacaataatgaagctcccacccctggcttgggcctgggcgttagaaagccctgcctgcggggggccctctcacatgcagaaggcaatgggtagtagcttcaccagacgatcctctgcctacctgctccaggtctccccctggggccatcccacctcttcctcattaaagcctgtgctgaaaggagcggggttgtttttcaaattctttcagcagtgagttattgatcaacactgatagtgcgagcagcttgatctcaccctgaactggcagagattaattagcttgattcccaagcataattcctaattaggcacaggaagaaaggaaagaaaacacaaaggaactattcttctccaggaaccaccgaccttctgtccaggggtggaggaggaagaaacaggtaagcatgtcccagcaccagagtgcttcctgcccattccaaagctgggcagccagcccgtcagcacaaacaacaccgaggacggtgccagtgccatcctgcaagggtttcagaagaaaatgtgcatttaatttgtttgctttactctctgcctaatgatgggcagggaaggcacaattaagcaggaggctttgaagtacctgctctaggcttgcttagccaccagaggctgaggatgcaagcaggggagagttcagctccaataggctggggaagaaaggttggatggggagggtgtagtggccctgagacttgagcagaaatagtgaaaggaaccacttcctgcagctgagaggcaggagccatcatgttctgttgtgggcattttctagaatgttccagccaggaccagcagctcaaatggctcttccctggtggtgggtagggcaataggagataggagggaccttcaatgtggcaactgtgaggtttggccaatcaacttacccatgctgagcttcggtttctcttcagtgaaatggggataattaatgatcgtatcagcttacatgacggttgtgagaattaactgaagaattcagagatgcatggcacataggaggcacttcctaacccacctaaagaaagcaaacccacagggcagcaaatcagaaatggatgagggctgacctcctctttattcagtagcacatgtctaatagacccgactgtgtctcgcacatgctgcccctgaggaagacttattatagggagctacaaacagtgtcacctgggaaagacagtgaactcagttatagaacaagaacacctgcccgggctgactgggggccaggatgcagggaaggctgcctggaggaagtgacatacccctgagtctcaattggccagggaaacaactgagcaatgatttgtgaaaatgagttcagtagaggttaataaaaattgggagtcctggccagtggctcacgcctgtaatcccagcacttcgggagcccaaggcaggcggatcacaaggtcaggagttcgagaccagcctgatcaacatgatgaaaccctgtctctactaaaaatacaaaaattagccaggcatggtggtgcctgcctgtaatcccagctactcaggaggctgaggcaggagaatcgcttgaacccaggaggcggaggttgcagtgagctgagatcatgccgctgcactccagcctgggcaacagagcaagactccgtctaaaaaaaaaaaaaaaaagggaatccctgctgtctgcagtaggccaatcaagtgtccaagaattgtgagaatgtgcttccccatcaccaccaccagcccacacccacaccaaaatgtgtcacccttcaatcccttcaagtctgtctgctcagcatcctgatccaaacaagccactttaaaaagtgcagttatgaaacaattcgaacactgactggactactgtttatatttttagatgtgatactgtggttatgtttctctaaaagtccttgtctgttagagatacacactgaagtgtttacagagagaatgatacaatcgctgtctggaatccgcttcaataccatccattgttggagggtgggtagtggggttagggggttttgaggaaacaagattggcccggtctatcagcattgatgctgggtgagataggtaaatgggggttcattatacactttacttttgaaaatgaagtttttcgtaataaaaagttgaaagaaagaaggaagggagatgggaaggcagggaaaggagaaagggaaggagagaaggaaaagattctgctcaaatgtccctttggaaaccttccttgacccccgcgttggtgtggggccgggggaatggggaggctgttttctgctcagccagagcaacaaggcccatgaggagacaggagggatgtctggggagcagtcccaagccacagagtccttctggggaccagccacaccatgaagagagagcagaacagggagcatagcacagacctatgacatagcactgtgccatgacatcagctggcaaaggcccatgggaccaggagggaggcattagaagggcgaacactagcagctgttgagtaggaagaaatgtgagccgacttctctacctaaggaagcggtggcaaggccgtggaggttcgggatggggacgggttccaggattagagtgcttttttttttctttctttcttttgaaggaggagaggctatgggagcctcaggtaccgagcatctggtgtctggagagatgcag

SEQ ID NO: 574 - DNA, 28522 bp, Homo sapiens
tttctcgagaacctactgtgtgcatatcccgggcttagtgaagtcctaggcgggctctggcaccaccaggtgcccaagacacagctccttcccgcacctaacagggacttcccatctctctctgtgcccttagcctgctgtgcccacccaccccactgaccccgcgagcgtgctcgggcttgggagggcacgtctgtgggggtgagagacggagccacagcatttggtgactagggggaagccaggtaagtgtctacacttggttctcccgtagcttggggacgcgagggagggagtccagccgctcctgtcaggctgcccgcccctttctccctcccccggagagctctgatgttccccgcggtggtggaagagggtgtgtgggtgtcaaggactcacagaccaggctctgctgtcagctggaaatggatgagggctccacactctgcttctgaagagggtgaattaggagctggggttgggggcggtaggtgaagggcagaaagaggaaaaagagatgcgggtgaggggttaccgagccaggaccgaccttgctggaaaggaaaggagacgtggcaggcagggaagtcggaaagatgaggcaagggcgggaggggcttctcagcagtcggggcccttttgcaggagtctggggccctttctgcaggaaaggggggttgttctcgcttgattttcggctggtcttcctgaagctttgccctgggggcagcagcctccggcgaggatggggtgttcctcggcccgcagttttctccagcgcgtgctggggaggatttgggggaaaggggatgcggaggggtgatggccagggcggggggagataagatttttccgggggggctagcagctgggagattggggtcgagtcaccgtgggatacgggctcaggttctgaagacgaagagaaaaatccaagaagccggcaaagaaaatcaccccttgccaccacccttggcacggcacccctcccccaaggccccaccactccccgcaccgcctcccccggccgcctcgtgctgccccctgcgttgggacgaccgacccacggttctgattggtcagagaccgggagggggagccgagggccggattggctggcggagccagcgcagggcggggcggctgattggcggagctggccgaggggcgcgctgctgattggctggggacgaggaagcaggaaggagggcggcggaggctccgctctcggggagtttgtgggggaaccgcgagcggcgtagcggatcccggagcccggcccccgccgcccgcccgtccggctgcctgccccgcccgtccggcccccgccgtccgcccgccccggccaggcgcgcccgccccccccgacggccccgcccggccgcggtccccgctccgcccgcccggccccggcccccaggaggaggcgctgacgcagcagcgtggagcccgggaattgagcgcccccggggggttccagccgccggattccagcccggccggggcctgcgggcgcccagagccgcgccgtccgcgccgcccgttctggtgagtcaggggccggggtcgaggagggggaaggggcgagctggagggagggagcgagcgaggtaggcagaagagcgaagggggagagcaccggccgcccgtcagcgcgccccaccgagcgcgccgcgccaccgcccccgccagcccgggaagggacggacggacggacgacgcgaagcaggtgcggccgcccgcccgctcgcgccacctccctcccctgggtccggcaccacggtcccgccatcggggaacgcggcgcgcctcgaggtgacagcccccgggggccgcccgccttgcaggccgggggcggggtgggtggcggccgcagggtggcagctcggccgggcggcggcggcgcgggcgtcccgagctgcggagggcgggaggacgccggtctttcctcgccgcggcggagccggctcgcctccgagtgcgcgggcggcgaggcccccgccgcgccccctcccccatcgcggtccccgaggcaaggggccgcggccgggggcggcgccgcgggatcgcccgctcagggtggggggcgccctcccgcgctgggagctgaccggttattgctggatggggggcaggggatgagggccgcgccgggccgggggcggcaggggggagtagtgtagacccgactcgatcgggctgagaggaagggaggcgccgaagacggaaggggaccggttcgaaaagcgagtgtgggccgcgggaggccctgcggggaccttgcggggcggcggccgagtccgaggtgtggcggggggaatcgaagttgtcagaccgcctccaagtgacagcgggaccctgtgctcgcggcccggcctggtcttgccctgctcgctccgccgcctctcttctggggctgggggccgggtcaggtcgggcccgaggggctcgcttggcggtgaagcgccggacaaaggcggcgccggagcgggcgcaggtggtggcgtcggggaggggagcgggtccgaggcacccactccgaggggcgggcgacggggccggactctgccccggggactgcgggggccggggcgcccgccgggaggagctgcggcactggcttgccgctctagccgctcgctgttggcctcgaggctctgggaagtggggtctacttgccgggggccgaggggccggggtgggggtgtatgctcatgatgtgccttggctggtggcgacggggttgctactcaccgaggcgacagacccagtgagccgctgtagagcctgtcaagaatgaggggtttttcaacaagcagagtctgcctacaggcagaagtctaaccccacctgggacatctcctagtcgcccattgtcgacagtgttagaagtgcagaagactagtttgattaggacaagagacaccccaccccgtgggctcccgccagccctccgcagctgcctccagcacttttccttagccacaaaggtacccacttagaaaaatgagaagctgagtttataaatccaggcaggaatttaataatgaaataaaaagctttccagtccttttactttgtgccacctgagactttcctccctactctcttcacctcgctgtcttccacaaaaaaaaagaaaaagggcccagagggaccacatgtcttggaggggcaccactgtccttggccagcttggaggatgcttaggaaccactggcttaagctgtgagtgcctccatctcccccggtgaccagctgtgagctggatgttgtttacctgcttggaaaaactcattcagagctcccatgccctccatgtgaaccccacacccaaaagaagagttgggatcataaggacagggaaactcaggctgtttcagaatgtggattttgctgagaatctgagttcgagtcccacctcaggtagggctggttagaagccgctctcaactgtggttggctgtaatcccacctgggaaagctgcttgtctgccacttcagagggtagcatgggcatgggagtttattcatggccaccccccatggacctccctggaatgatctagaccccagcctggatggagctgaggcttgtgagaaaggtaggtattacctcactcaggaggctaaagtttgttctgagataatttaattgcatgtctaaaatccagagagtgatgatgaatctcaaggcctttgtgccttctgtgaggctacacggcatgtgatttcttttggtggcagtcagaaggggatgacgtggtctggccactggaatatgaaggggagttgcccaaatagcatttccctctttggtagggctcttacctggcaggagactcatgccagtcggatctggtgttaaggagggtttgctccggagagtttagccagtgattaggttctttttgatatctccctctctttcttcctttctgttgtcctgctgtccccgtgtcaggcctgtgttgttgttatagcctccctttccctcctgcttcctttggcccttctgatccagtctgtatgcagctaccaggtcattcttcctaaaacaccccttcccggtgtcactccctttctcacagacttgcaatggctccccgttccctgcagtctgaccctagacagtgtcccctccagctcttccctagccataccatgcacattttttcttcctgcatcttcactgctgccgctccccttcctttactcccacttgaatcccacttgtccttagtctggttgttgctcagaccactccaggccaacatagtcatccccgcctgagctcatgactctggattttctaacgtggtatcctcttgagtggttttgtaggttggaaatttcttaaggacaggaacaatatgagtgttaaacctctgtgtgtgtgtgtgtgtgtgtgaatattctggtatttcttgtacagtgctgtgcacatcatttttgttgagtgaataaatgtggttggttgctgagttaggcaggaacaagggggagaccttcctttcagcttctccagaaatgctcatattggagtccttggagatttccagccctttctgtcaaaggcatatggatagggcatgtttggggtgctgtaaatgggaaatttaactgctgtttctaatatttctgctggtgaagagtcctatggattgcttatgtgataccatatagacattggaaaagggctgtaatcctgttttcctcctacctcaccggaccaccattctttctacccagctttgctgctcttatgcagttttccttgttgttcatgctaaatgaatccatgttttatctcttctcaaaccgggtgcaaatgagggagaaaacacaattctgagcacagaaaagaaaaatactcctgggtctggcccatagatgggacttttggggctggtttggaagaggtgtttatgggggcatcaccaacataagaggcacaatcagccccacattggacccctcataaaggaaagctacaatccctgctctctcaggcttctgttttggttcaccatcaaccctggaccatgggggaaacgggaaagaggactggtgactggttagaggccagatagtgaaaaaatatattctgcatccatcccctttcccccaaacctcccttttgtgccccagtttgatgattaatggaccagcatttcccttctacgcgggaaggccacccctcacagttgccatggcaatgcagaccgctcccccgtcaattaaaaaaaaaatccctactacttctctcctccttctactgtagcaggagaaaagctacctcagaatgcatctcctgggctctcttctcagctcctttagctgtgtttgctgtgtgtcctagaacacagtccttcctctctttctggggattgcctgagtttcttcactctgagcaaattgtgccccttctggagccagcagcccctggaacacttatatcaagaaacagagaaaatttctgtttatttattcatccccggtgcaaattaaaaactagagagagctccttttgggtaaaaaaaaaaaaaaaaaaaacaaccctttcacaccttctctggttagaggtataagttggggcacatttgacatccagaaaggaagttttagtaaacctggaaggaattcagcctcctagcatacatacttcaaattggagttctatggggaattctcaaaattattttcattcctcctcacctctctgttccagcatccaggaggacttgtgtgttttcattttatctgttcttattcctcttggccttgctccggcaacatctggcctcagcaccctgtcgcaaggtgagtcattaaggagaataaaaaccttaaggaaaaaaagtctctggagttgagaagtagcctgtgttgaactaaggctgccaggcgaagctgccgagtttatggagcattatacgaacagccccgacattaaagggcctcctttttatgaatgggttgtgaagaatgtaaataaagcagcatctctcaatggggaagcattttacataagcagtactaccccgacccaagtatttatgggaatttgctagcacagtctggcaaggctcacttcctttgtgaacttgccattgtgctggggactttggagggacaaggagagtgtgcttcggttctgagggcagccccagcactcccactctgcaggtttcctggcgttgacttgatgggccagctcatggctggaaatgcctgttaaccctgaagtgacagaaaataccatgcgcagtcaagagctcatgataattagagatagaggctcctgatcctggggtctggagatggtgtagctcctgacccctcaggctgcttagacctccacaggacagaggacagggagttcttggatgatgaaatcttgcccggttttatgggaggcacctaagtggtgtaaaatgggctggtttgaatttcagctcctttatgttcccctgcccacctcctggtactgccactaatgatcagtaaaatggctaaaaaggaggaggagaaagagcaccagcagcagtgaggctgcacgtggtctgctcagggccagacggcctgacaagcaccctcactgaacaccggcccagccctggggttccaacaggggtgttggtgtcctgccccaggtgacttggtaagcaggccctggagtacagtcacatccaggactttgtgttgtgtccctgtgggtgggagtggggtcatcagatttcatttttcccagtgggaaacacctgcaaggatggttattcacttgactcagtgtccccccaacacaaaaaaataacattgtcttttaagatcctctgcaggcccaatccaccaggagaaaaaaaggggtttgtctctcagcctcgctgatttgaattgggaacttatttctaagcactatgaccaagttagctgaatgaaaaaaaacaggtgatttcttagtcttgttaccaatgtcaggcaggaacttgggtctcaatattttttcttgcatgtgttccttttccagtgggtttggggaaaagaggtgctttgacctcctgtctttgggtaaggaggatgggacctgtctttctgccgttctcttgaccccagggatctcacctggagtgctgttgatggctcctacttttattccatctccaatgccttttggggactcctagcctccatcagtgcagctttttcagcttcctgcgtgcagtggagaggggcagcccacacagacccttttccaactctggttacctgtccacaatgtttaggaataattgttaatcacattctcatgtggccaggtggtttaaaggtgaattactgttttttagaggacctatgtagaaatcgtgggaaaggtattattagggtgccgcttgatgccaggagatcctaacaagtatgccagaaggaggggtgaagtcacgtttccaccatagtcagggccagcagggccttcctcagtagtgaggggtgtctcctgctttgtgcctggaggggtttccacattggctagaatgtaaaaaagaattataaaaatgattgaggccaggtgccgtggctcacacctttaatcccagcactttgggaggctgaggcgggtggatcacttgaggtcaggagttcaagaccaccctggccaacatgctgaaaccccgtctctactaaaaatacaaaaatgagccgggtctggtagcatacacctgtaattccagctactcaggaggctgagacaggagaattgtttgaacccaggagacagaggttgcagatcgcgccagtgcactccagtctgggcgacagagcaagactctgtctccagaataaataaataaataaataaataaataaataaataaataaataaataaataaaaataaaaatgattgaataactgagagatgatttccagagaaattgaaaggacttgaatttatttggcccagagggaggtagacaaggggcagttaatatgtctttgcatgttaagatgacagtttagagcatgatgaccagtttttagtcttcattgcagtctgggctggaggcagggaatttcacctgagacaagaggtattgggtagatgcatggttgggggttacctttttctggatttactataaaatcaggacaacgtatctttgaagctctctcatttattcatttatttatttagcccagacttcttagcatgtcacccttttctaggatataaaatgtttgtttcggccaggtgcggtggctcacgcctataatcccagcactttgggaggcaggcggatcacgaggtcaggagatcgagaccatcctggccaacatggtgaaaccctgtctctactaaaaatacaaaaattagccgggcatggtggtatgcgcctgtagtcccagcaactcaggaggctgaggcaggagaatcgcttgaacctgggaggtggaggttgcagtgagccgagattgcgccactgcactctagcctggatgacagagcaagactccatctcaaaaaaaaaaaaaagtttctttcaaaaaaaatttttttaattgtatttacgttctagcccatagatgccatttaattggagtacatcttcagttcctctgtggtgggaaaactaataatgtgtggtaatgccaataattaaagcacagaaaaataaaactgaacgtgcaagttatcttgcatcttggtctgtgatccagcagccatcctgtgatgccctaagtagaggcagtgtgttgcagtgcaggaagtgtgggccttggtgtagatgccaggatggctcacctctgtcctcaatcctagcaactttttattttttaagagccagctctgtcaccgagtccagagtacaatggcatgatcatggttcattacagcttccacctaccgggctcaagtgatcctcccacctcagcctcctaagtagctgggactacaggcacacaccaccatgcccgactaattttttatttttgtagagacagggtctcactgtattgcccaggctggtcttttaactcctggcctcccacagcacaggaattctaggttacaggtgtgagccaccacgcccacccagcatctccttttaactctttttttttttttttttgagacggaggttcactcttgttgcccaggctggagtgcagtggtgtgatctcggctcatcgcaacctctgccttccaggtagctgggattacaggtatgtgccaccacgcccagctaatttttgtatttttagtagagacggctaatttttgtattttctccatgttggtcaggctggccttgaactcccaacctcaggtgatccacccacctcggcctcccaaagtgctgggattacaggcgtgagccaccgcgcccagccttccttttaactctttgtacctgttttttttccttgttaggatgaaatggtaacaactagctcataaggctgttgggaagataaatgagatagtgaatgtagtgtgcttaggaccttgccaggtgcatagtgagtgcttgacaaacattgaccatccttttacagtagtcacctctgcagtgaatcagaaatttccaaccctgcacacttagggtgtctggggactgataatgctaactttagttctttgctcctgatttcacctatctgtgacattctttgtcttgatacaagtgtctgtagtactacattcacttgcttaatggtttaggggcagccacagccagtggaatgctttccagaggtagctgggcaacttgggagagagaaggaggaggatgaggccaggcatggtgactcatgcctgtaatcccagcactttgggatgctgaaatgggaggatcacttgaggctaggactttgagaccagcctgggcaacatagtgagaccttgtctctacaaaaataaaaataaatttaaaaattagccaggcatggtggtgtaggcctgtagtcccaactactcgggaggctgaggtaggaggattgtttgagcccaggaattcgaggctacagtgagctataattgtgccactgccctactactgcagcctgggtgacagagcaagaccctgtctcaaaaaaaaaaaaaaaaaagaaaatgaaaattgatggtaatgaaggagggttgtgccatgaaaatacaagagatttcctattgtaaccttgttgcactgtggattaaattgaagatgcacagtggactcctggggatggaggagagtttggaggtcagagggctcttgtcttgagctccaagtggtgctctaagtctaggataaagattttacacagggtggggcaggtggacagccagatcttcatttattcttaccaagctcttattaagtcatgtgggtgggatttactgttaaggaaggcagagcctacctgtccccatagggctggcatcctattggaggtggcactagccacttaactagttaagtgagtgatatttgggtagggtgcccataactctgatacgatctgccttgcgattctgctcctgctagtggagtgtgggggaggcctggtcttggatcttgttcctcacagctggttcattcaggaggttagtgctctgctgaggaggctggaggcagagctccatcttggcctggctggctagtttctgttcaggactagagctagcacctgtagtcttggcaagccattttagaaatctaagttgttggtccatgtaatgtcctggtggttgaaccaacactcgttctttgccattcctgggcaggtgcttggagaaggctggtgagctgttcatgttttttgaagaatggtgcatcagtagcacaaggttttccctggttctgctgaggcctgttgctgagctttggggtgccctgtcccctgttttattcctgttttatttctcccacattgttagctgctcagagcaaatgggttttgctgcaggtgtaggtttgcctctggctgatcctgggcagtatggcatctggatgggagggtctgagggagccttagcccagagttaaggggtgccccccaacccctgcctggagtcatcctacatggagctaataggggcgagtctgggaaaagttgcatttgtttcctgctttaagactttagcttttgggccgggctcagtggctcacatttgtaatcctaacactttgggaatccgaggcaggcagatcccttgaggtcaggagtttgagaccagcctggccaacatggtgaaaacccgtctctgctaaaaatacaaaaattagctgggcgtggtggtgggtgactgtaatcccagctactcgggatactcctgctgaggcaggagaatcacttgaacccaggaggcggaggttgcagtgagccgagatcacgccattgcactccagcctgggcaacaagagcataaactccatctcaaaaaaaaaaaaaaaaaaaaaaaaaaactttagcttttgtttgtcaccctttcctgcatccaaacatttatgaaatgaatttctcagagtgctgcccactccctactgggcttttgttcccacggtacacgtggcataaagtaggccctcagtaagtgtctaaatgcctggctcatatgtaccctctgagaagctgccttggggggacccctcagccaagctctgagcagtccattatagcccttgtcacactatcttgttctgtcttcctgctagcccatgctccaactcttagtcttttgcatttttttccagcacttagtctggtgcttgtaggggaaagagaaaacaaatgagcttgtattgagaacctgctgtattccaggaactctgctaggcactttacacacattcttctttaacttaatcctcacagcaaccttgctgtgtagacaaggaaaccaagactcagagttcaagccattgactaaggccacacaggattagcagtggcatgaagtggcttccagccccacatgggtctccctctgctgtgggggggccagcaaatgttggctgaatgggcaaaggtcacaagaggtgctgtgtgcctgagaatgaggggcaggcttagctgggctagcacctgtggatgcaggtctaccttatgcacacatgagttgtgtactgggaagaagctgggggaaggcacgttgcctaaagtagggacatgtgccttttaagaaagcctctaaagactagttttttattgcatgtgattaccttctaatttgtcaggttaaagttcgtaaggcagaacactggtatgattaaaacacaatgctctctgcccactctcctcactcagggatctgtgtgttgtatagcaacttctagatatgagaggtatactcttgtttctcttgtcctcagcccctgccaccagacccgagggcagtctaaaagcaagcctgtgtccagatggatcaggccaattcctttcagctgcacttcgtgcttcttgcccaggtgtttttaggctcccagtctggttacagaatgaattgagtgcccgcagcaagtgaggctgtatgggcactgaggaggcagggctggtggctgaggcccctgctctctctctctctttgaggacagtgctccttgcaactttgtgctgtggagctgagacttctgctctgcatgggtgcctccactgaagcctcattcaggtggcacagacaggcaggacgcacaccttctgacctcacgttgtgggtctagccctgccgttagcatctgaggaacttggcctttcactgtagagttgagtatttctcagagacacagagctgttgttcagggtctgttgggatagtttctgccccggccctcttgctcagttgtggcccacaactgagggccacttcctgtcccaggcagcctctgcttgtgggagtgatctgggctgtgacctgcccttccaggccctcacccttgtttccccagagcagtgccagcaccccgtgctcccctgggcctctgactctcccttgaaccttcagcccggcgtgaagcaccttggttgtgctctgctcgtgctggtggggttgctgtatggtgctgctgcagcttgagggccagagcagggcatctgtctgtccctttctgcttctatggagatgactacacccggccctcttgctgagttgtaaactgaaccccccacaactcaccccacactgggtcctgcaagggaaaaggagtgtcatcatcattatctttccttggggtgggcacttaggtgtttttagtggaatagtggcagagcaaagttcaggtgcaagcttgggttttcagatttctcactggggtaggaggaatctgtcccgggctcctgctgtggggaatggccagccagggccagctgccctcctctgtcgggttggaaggatgggggaggttggcctgcctgcctctgcttaccaccgctcctaaggaagactctttttggtatatccatcttagatgagggatctggagtttggaaaagctaaatacattgctcaggagggacagagcatttaaatctaggtctgactcaatgctttggttctttctgctgtaccagctctttaagagattcactaccagctgtgtctttacctggctttaccataagaatttcagcagcttcacctgtttctccataaagtaacagcaactaactttaagtgaaaaggagcctagttttgtgctcttgccacatttcttctctgatagaagattcaagaaattcagtgctcatgacaagtgttttattcctttcatggatgggaggggttattccaagagagaatgcagaggaggacaatgcttaactcagctccagttgtggttttagctgtaattggaaggaggtggcttctaatggggcagggtccttcccagccctcacccagatgacctgatctacccttatctaaggctcccctgaatccctccctctcattaaaaataaaccgggctaggtatggtggctcatgcctgtaatcccagcactgtgggaggccaaggtggaaggattacgtgagcctaggagtttgagaccagcctggacaacatagtgaggccctctacccccggccccccccaaccccctgcagcctgtctctaccaaattacctgggcatggtgtcacgcgcttatagtctcagttactggggaggctgaggtggaaggatcacttgagtctgggagttcgaggctaccatgatccatgattgcgccactgcactccagcctgagcaacaaagcaagaccctgtctcagacaaaaacaaaaaacaacaaaaaagaaaaaccaaagaagcctgaaaagcaaaatttaaagtgtagtcctgaaaccctcaggatggtgtgcggggtgcaacccagagctgggtgggtaaggggagagcagcaaccacaactgagggccacttcctgccccaggcagcctctgcttgtgggagtgatctgggctgtgacctgcccttccaggccctcacccttgtttccccagagcagtgccagcaccccgtgctcccctgggcctctgactctcccttgaaccttcagcccggcatgaagcaccttggttgtgctctgcttgtgctggtggggttgctgtatggtgctgctgcagcttgagggccagagcagggcatctgtctgtccctttctgcttctgtggagatgactacactcagaccctactatgacagtttagctgggcctgacctccccctcgattttgagatcctgatgcccctgaggtgaaggtggcctgtttactgtctttagagtacacttctgaggatttgggattcaacctgtggttctctgggtctttggcctggatgtccaccagccagccactatccttcctggcagctgtgtcagagctggagacaatcagactggttttctccagtgagagctttcttgacatcttttagtgtcaggaaagtgtcctgggaatccctcctagagaccttcccaagagggcatggaccacccgtgtctgggaggacagagcttcccagagaggaggggatagtgctgagagaacccagcgcaccttgtgccctagcagtggttgaaagtttctgggtggatagtgcgtaattgggaggggcagcaggaggattggtggggctgggagaggggaaccaagcctaccactttgctgggatcccctctccccaaccagccctgtagctgggccatcccttgtggtttggaggggccctggcaggcttgtagcccctccacccagccccaccccagggaaaaagttgcagccgagcttcttgtttcttcatctgacttcaaagcatgactcacacatgctctccccagaatggagtgcagcgagaggcaggcagcagagaccccagcctctccttaagatgccgagtggctggactttgcaccacaggaaagctaggagctattttgcgacgtgcttttgatggccttgggtgtttttagcgagtgacaggggatttggcagattttagggagtctagcaggaggctgttctgctggatttggaaatgtgactcgcaccctgtgattcagacgcttcctgggatcgtcagcaccctaccccccaggggagtagtgggtgtccctgagggactggaaagctgaatgagaggttaaagagcaagattagtccacagggaacagattctcaaaggttctgggctcagactcctgaaagtggaagctgtgtagtcaaggcactgactcccttcccacctctctctgcttgggacttctgtgtgttgagaggggaagactgagtggggacaactatccaaagatctgaggaccatctgcccatgcagccagtctcccagccagctggaggtcaggggtggccaatcatccccctgctaagaacgcttccagtagccaggcctgacagcacctccctgtgctgtctttcccagccgccttctccttactctgtactgtgtccttatcctcaaagacgacaagcccaggtgatctccaccttggctcccagccgttcccaggcctagcccctctggtaacttggggcctgttgaggggctttggcccgtgctcaaatgcatggtctgttcacttatccatcatctccaggccatttgggagttggggagggctggacctgggctccctaggagatactgatgtgcttctgctgcttctcgttgcatgctcctccacctccagcacaggggtgcctggatatgagagaagggcctgtgggttataagaaatgggatgatgttgttgttgttgttgttgttttgagatggagtctcactctgttgcccaggctggagtgcagtggcacgatcttggctcactgcaacctccacctcctgggttcaagtgattctcctgcttcagcctcccaagtagctgggactacgggctcatgccagcacgcctggctaaatttttttttttgtatttttattagagacagggtttcactgtattagccaggatggtcttgatctcctgacatcatgatccatccgcctgggcctctcaaagtgtggggattatgggcatgagccaccacgcccggcattgccaataagcctgctgagcagacagggacgggtggtcaccctgattagaagcaggaaagagacttacggagcctagcagatgcctgggattttttaggagctctccacctgtgcttcaggaatgaatgggtttgccttctgtgactctgtcttgcccggggcctggtctctgagcagtggcaagtccccgcacgtggccagagcaaagcctggcacgctgcctctcctttccagttttccgtgtcctttctcaggggtgaaggttgcccacaccaccctcagcctggttttctgagcactctttctcaattaatgcagcatatctctggagaggaggtgtccagtgaccccacccactggcccaaggccatgggagctaacagggaaagattcaggaatccctgggagccctcaggcttgagactttcagggttaaatcctggcacagcagggactgctctcagttcctctgtagaatgagtgtgaacagcaatagcagtggggaaattaagctgaaaaacctgggcccgctgggtggggatgggttgcaggagtacctggtgagggacagaacttgtctggcaccttacttgccagcccctgtgctttgggttgaatggtaggaagtgaacagctccgtagtctctgaccaccgccctctgcagttcttcattgtcttggccatgccagcttccagtgcacagccagctctggcctctcactcagaactggggcccaggctgccgcaggtgtatgttggagtgttttgccaagcaaagttaggggatgatgcctggtcatatgcattttctgtcaggggctctgggcttcccccacctccttgcatcctgcccctgcctacaaagagggagaaccgagcacgactaacaaggcagctcatttgtctcctgtgttagtgcttctctttgatactttcttttcccaactgtttgtggccttcaggggtttaaagctgtatggcaggtctacgcaccgtccctgggttttctctacccccaggaatatgctgatcctggccttactgttacccttgccctgggtactggcaccctttgggctgctcttgcctggaatttgaaccaaagttcaaatgagacttctccaccatgggcccctcaaagctgagacctctccaccatgggcccctcaaagctgagacctctccaccatgggcccctcaaagccaggccttcacccttgatagagcttttccagctagacccaggttgtggcagtcttgctttatatgccaggggaggagtcctcagagactgaactttgccttcatggcccagcaggcagggtccccatctcagctcttcactgtctgtcttcttgtcctcctgtggccaacctcagaagccctgcgtttggggaggggattgttaatgccttggttatacttttggaagaatagatggactcctggccgggggcagtggctcacgcctgtaatcccagcactgtgggaggccgaggcgggcagatcacgaggtcaggagatcgagaccaccctggctaacacggtgaaaccccctctctactaaaaatacaaaagaaaatttagcggggcgtggtggcgggcacctgtagtcccagctacccgagaggctgaggcaggagaatggcgtgaacctgggaggcggagcttgcagtgagccaagatctcaccaatgcactccagcgagactccgtctctcaaaaaaagaaaaaaagaagaaagaataaatggacttctaccacccagtcccccatcttgggaggctctgtcttcagagcctcttcctatcctgtgatgaatatctagtgagagaaggacagggggagagaacaaagagctttgccaccagctcctcctatcccctgtccctggggtctgccttgctccctaggctcttcaggggcttagttcagagataccctaggctaaaaggaaagaggaggaaccagtccttgcacagctgctggtagcttgattccactgccccttcacactctggaaagggagtcccaggaaaatccatactggagacagggtagttgtaggccaggatcactgcacctggggctgggtaggctgcagtgggagagaaagcaggcaggagcaggccagagagggcttctctcattgcccaccttctgtcctgcaggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcatcagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcaggtgaggcttcctgggcccaagatgtactggggagtctcggagacatggcatcccaggaggttgggctgttgatctgagcaggggtctcccttggggtctggctgctaactggaaggtagggggctttcagaagtgagaactcccgtagtctgtgccccaagccgaggagcattcccaagaacagggcccgtatagctctggacagccttgctctgcccaggctacctttggagattcttggcctggcagttaggtagcattgcagtggtacaggccacaggaaggcctctcttctctcctcattgggatacccgttcttagactctgaagagcaggttagatattggaattaggacttttaccaaattgttctcacggcccttctaccctccttgaggaaagctagaattccctagtttctagaaaccagtactctctgcatgctggccaagttcagcattcatgggaaaggtggtaggtaccaggctcagtaggtggtacctactgcacagggcagctttgccctggctatagaggcattgaaagagaagtgcccagactgagcatcactttgctgggtgtggatagagagggtgcaccatgagaacagacaagcagagttccctgacatggatggaatgcgatcagggcccacagctttggtgtctgcctgcctgacaagacccagacacctgagaggcccatgctccggctgttgagacactcccagaatcatttctcttccctaaactggcagaggtatcctcacctgcctcttcaggctccctgcctgcctcctgggtggaaatgagacatgctggccagcaggtctgccctgctgctggggaggtgagggctggaccttccagatctcccttcccctgacatcctttcttgtaggggtctataaaacaactttatagaccagttggccctggccagactggttgtttcaggttgtggcttgagttagagttcttatgacatgagaacaggctgctgcttggggttttccttctttttttgtgccattccccaagtctagacccttatcccctctccctaataataaggacaccagtaaacaccatgtaccaggcactgttctgagtgctttacatatgggaggctgcttggcatgtaattgagcacagactccgaagccagactgcctggagtgaaatgttctcccccactttcctagccatgtgactatgggcgagtcagtaactgctctgtgtctcagttttcttaactataaaatgggtgtaatgatacctatctcacagggtttttgtaaggatgaaatgagttaatgtgttcgtaagaaaaccagccagttgctctgaggggcagagtgacttgcctgaagtcacatggctagtaagtggcagaacccaggctgattctagaacccctattcccaagcattatgaaagccttagaaaattaatatcagggccaggcgcggtggctcatgcctgtaatcctagcactttgggaggctgaggcgggcagattgcctgagctcagtaggttgagaccagcctgtctaacatggtgaaaccctatctctactaaacatacaaaaaaattagctgggtgtggtgatgggcacctgtaatcccagctactcaggaggctgaggcaggagaaatgcttgaacccgagaggcggaggttgcagtgagccaagatagcaccactgcactctagcctgggcaacagagcgagactctgtctcaaaaaaaaaaaaagttcggagttaaaaaggatgttccaaccacctctctttcagactaaaaggggagatggccaatctccaagatcaggaaacacccctgtccccttagagagtcactctgacagtccaccataaaaaggcctctgatcccatcggccacctcagtggcctttggttgcacagttagaattaagacaggagcaggctctgaaagcagatgggtgatgggggtcactgcttgtcctgtcctgaccactctctccctttcctagaaggctgcagatccctgggccagttggaatttcctctcccggaagctggccacccagcctcacccgcccacccactcctggggtgccctgtacccagtgtgccacctgcagcagagcccgtcccccatcttcagacacccacctcggagccccagacagtagcccgtgcgtgccctcagagcgccaaacctcccagcggttctaagtcaggtctgcgcacaggctccagctgcaggcacactgcaaggagcaaggctgcccgcaggcctagccaccccaagcagccacgtgtccagcgcccacgccctcgccgccgccgtcgccgccgcactaatggctgggtacctgttggggctgcgtgtgagaaggctgtgtatgtcttggtaagtgctagctcttagctgatgacgagagggagggaggcagtggggacacatgacctgcagtgaggtaggtgctagaagcacctggttctagctactctgagagctgacaagggactccagtttacttgtaccccaggaaccagtcatgctggcccacccagcttgcttccctagccccctactgatcctgtaccagacaccccagggaggtcaggagacacacagtcatagctggtggctgccatctcggtgagtgtcttcccctcccctccctgctcactttgtcccttacaccctggattgtaaagtggaggactttcaatggagaacttttctggataagtctatatagggggcgttggaatgggcagagaaaattagtgacacagagaacatctcggatgatgaaaagaggccaagtgcggtggctcacatctgtaatcccagtactttaggtggtggaagtggtaagatcgcatgaggccaggagttcaagacgagcctgagcaatatagacctcatctctacaaagtaaaaacattagttagccaggcatggtggtgtgcaccaggaggctgaagtgggaggattgcttaggtccaggagttcaaggctgcagtgagctgattgcaccactgcactccagtctgggtgacagagagaccctggcttttaaaattaattaattaaaaacaaaaagaatattaactaaaatttattgaggctgggcaaggtggctcatgcatataatcccagagctttcagaggctgatgctagaggattgtttgagctcaggagttcaagaccaacctggtcgacatagcaagatcctgtctacagaaaaaaaatttttttaattagccaggcatggtagcatgcatctgtagtcccagctacttgagagtctgaggcaggaggatcacttgagtccaggaggttgaggctgcagtgaactatggttgcaccactgcattccagcctgggtgacagagtgagaccctgtctctaaaaataaataaatacataaatacataaaatttattgagcacttcttagatgccagaactgagctaagcattttgtaagtattatgccctttaatcctcaccactaccctatgtggtatatatcccatcttcctataattaatcccattttacagatgtggaagctgaggcttagcaatactttaaataatttgtcaaaggctgtgccccttataacagtggtttaagggttcagaccgagacttgttccattaggaagcatgagcacttacccagcactgggggtcttggagtgagagtcagctgtcgggtatggtggtcagagctcagccccagaagcttcaggccacttttccacccctattcccttttctcatcctttctccaaccatgagaattccccagccccatccaaaaaaggatagtggtttgacaaaaccaaggtagtggtttgactatcttgaggaaatcgtggaaaggatgtcattccctctctctgtccttactctgagtgtggctctgcaagcctatttgtgtcattggtttgttgcctaggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggtacctctccctctggctggggacccaaggggcagctgccttcagcagaactgtagtccccagattggcccctgcctggagtttgacctggcgtgagtctccccgtgttcctggcacagagtctgccttccactcggctggggtctctctgctgccgagggctgtgggtgaccttgtggcttgggttggatcagctcattaacctttccagccagcagagcctgggcacctgtccccccacctcacctgtcagtgccttctcccccttctccctccatgcctaacagcattccaggcctctgaatgcttggcctggggcaggggacatgggttgccggagcctgcaggattgaggttggatgaacctccagggcagccagccagcctctctgcctgtctaagtaactcaggttgccagttcaagccataaccactgtgttgtccttccaggagagctgatgatgagcctcctgtggtattacagacctgagcacttacagggaggccgcagtcccagcatgcacgaggtgagctgcctggcagatgggtcagggagggcaggagagacagagggaaaggttatggcactaagacgtggtagggggagggcagccatgggctgtagtcaaatccctgcgcttgtcactttggactccagagaacctgggaaagggcccaggatttattctcttttcccaacactgccccaattcatgtttcaaagggaataataacctttgtcttaaaaagaggaacagaaagggaacccttgaggtagcaggtgccaatgggagcaagtggatgtgttcccctggaaacaggaaaggtgaggtggagctgcatacctggtcacttttggtattttctgtagtaggggaggggaggggaggaaagactcctcctaacaccccataggctctccaccaagctgtgtgctaaaagaggtgactgccatctgtgtgtgccctgggctcaccttttatttcactttcccttgcagggactttccatctaactggaaagatgaagaacatttcccctctcctacgctaggcagggctggggtttgggaggtcagtgacaatcaggggctagagcagatacctggctattctggagaagggggggacctagaagggactcaggaggaatgcctggaggcagtaggtgaggcatacttaggctgaatttccagggaagcttgctggagtcatctcaggtcagcaggcccagcagaggggttaatgtctgccttgctctgggaatgaggtgctttccagccctggtaacaacctccacctgtctccctttgagcccttgcagaatgaagtgtttgcatcgcgacatcaggaccagaacagtgtggcctgcattgaggagaagtgctatgtgctgacttttgccgagtactgcaggtaggtggttccctgcaccctctggctggcctcttccctcaggctccccaggcatatttggggctgcttggaattccccgagaggatctcattctgctctctacctgatcttactcactgagcctaatctcccagaacttacttccctattgcttgcctctaccatctgatattttttggaagaaagaagaaaaattgtgttgccacactgaggtagaatggttggagcagagttggggggtaacattactgctcttggaaaaaatttaggcgaattggcaggcaaatggagagaggccctggcaagtgtggttctccagtgacagagaagatagcctggtggttggcagagcagacatcatccctgggatgggtggagacagtaccaccccttggggagctaggatagcctagctctctgggtcgggtagggtagggtagggaaggaattggtcttcctgcaaaagtggctggagtaaagacagtgaatggtatctctctacaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttagaaaaggatcgttt

SEQ ID NO: 575 - DNA, 39968 bp, Homo sapiens
gactgggtaggtggcaagcctgagtgatcggagagaagccgggacggatgcaaatgcagagcccgctggcagaggcgcagaggcaccgaccgaccgaccaaccggagcgaggaggcccccagagacagccgccgccctgtaaggttcccaatcccatgagccttagcagtccctgtgtctgtgcgttaacacactcccccacggagtcccatgagagggtttttgtgcccttcaatttagacattatagaattaatttatttttattttaaaatgatggctaatatttatatggttcacaaatcaaagccaaatgaaaaggaataccttaggaagtctcattcccactccagttcccagacatcctattctttagtcccccatgggtaaccacttttattcacttctggtcagtcttttccagcatttcttgatgcagatataagcaaataccaatatattttctctctctctctcttttttttttttttttgagacagagtcttgttctgtcacccaggctggagtgcagtggcacgatctcagctcactgcaacctccacctcccgggttcaagtgattctcctgcttcagcctcccgagtagctgggattacagggagatgcaaccacgcccagctaaaaccacgcttggctaatttttgtatttttagtagagacggggtttcaccatgttggccagactggtcttgaattcctaacctcaagtgatcctcctgcctcagcctcccaaagtggtgggattatagatgtgagccaccatgcccggccccaatatattttcttactctaccctccttgcccaaagggagcatttatttgtgttccttgaaaaagaagcatccattgtgccttgccttttttcacttagcaattctagagacctttccatatcatgaaatgatgtatttttgttttgtagagctagggtacggtcttgaacttctgccctcaagcaatcctttcacctgggcctcccaaagtgctgggaattagaggtgtgagccaccatgcctggctctgaaatgatgcattttaaattccactgaaattattatgtcctgggctcctgacaatagagataccataggctgaagagaaattttgttgggaatttcagtatttccaaaattccaaaagtcttcttttcctctccatggcaatgcttggaggtgtgcagtctagtctactgtaagtcacatgtgggagggagggagtggatgctctccaggagctgggagatgacagagagacatacaggagtgagaggagtgtgggcctgtgctcagacaagggtgaagagcagctgccagggggcttaccccgccttggggttgaaactctggagaaagagaagatcctacattgtataaaccctacataagcaaagtgggaacccaaagcaggagactgtctctctgggaacccttgagccaaaaggtcaattcactggaagccagctgaccccccaaagggtgagatgagccccagagacttcacgtaagacaaaagtgcagcagtatccagagctgcttctggtctgtctcctggtgggaagaactgagtagaggaagcttcaactggtgtctgcaggagtcaggagatgcctggcctagggcttggtcatggcagggataaaagcccatcactgttatcttctacaaggcctgctggcctaggcaactcctcagcttcccccaactcttcctgtgaagttcagaaatgagtttctcaaccagctcaagttgctcagcttatttttctctcacccagcaattgctccccgaccctgagttggcagctgtgaaaacataaacattgtcaaaacctcccttgcacctcccccgtctctccctgtccccagtactgctgggcccacctctgttccctgctcccaagggtcctccctcacccatggcctccatccgggcagtacccaggaatgtgggcccaggacaggcagcttccctttccctcggcccatccggggccatgggggaggcacagttcagctctctccctgggctctggtggacacacagcatctcaagtagccctatctggattcctagaccctggtacaatcactggcaattggtgatgtggggaagggatctctaccccctgcctctgtctccaacccaaacttcaggcttccctggcccctgggcagtgccctcactcccctgcctctacttgatccccagtgctcggtggatttgtgccccaccttggccattagggctccctgcgcctccctcttggaataacacttcctatctactcttttctccttcttccacatttctttttctttttcgagatggagtcttgctctgttgcccaggctggagtacagtggcacaatctcagctcactggaacctccgtgtcccaggttctcctgcctcaagcgattctcctgcctcagcctcccaagtagccaggattacaggcacccatcaccacgcccagagattttttttttttttttttgtatttttagtagagacagggtttcaccatgttggccaggctggtctcgaactcctgacctcaagtgatcagcccaccttggcctcaaggtgttgggattacaggcatgagccaacatgcttggctggtcacctcctcttttaagggatcccaaagtgcctttcttttctctcccttctcccctcaggttacagggccattcattaaagtcaggtggtctttctacagaagaatttttgctttagtaggcagttcaactgagatgctgttgaaagtgtctatatccctgcaaggagggatttttttttttttgaccgagtctcactctgtagcccaggctggaatgcagaaaaagtatttgatagaattcaacactcattcatggtttaaaaataaaaaacttcttagcaaacaagtaattcttaaaaataatcttacaaaggcattgtaaaagccctatagcaaacatcacattgagtggtgaaatattgaatgttttcttctgatattagaaataaatcaagaagacatgctatcgctacttccattcaacattgtgcttggattttaccagtgcaatagggcaggaaaaaaaataaaaatcttacgtcttatgtattggaaaaaaagaaataaagttgctattatgcataggcaacatgattatgtacataggattttttttttaatctacagataaagcctggcacagtggcatgtgcttgtagtcccaatgcttgggaggctgaggcaggaggattgcttgagcccaggagctcaaggttgcagtgcactacaatcatgcctgtgaatagtgtcctccagcctgggcaacatagtgagactccatctctaaaaaaaaatttttttaaatctacatacaaacccttaaaatcaataaaatttagcaaggttgctggataccctctctatatacaaaaaacagtagattctttttttttaatctttttttttttttttttttttttgagacggagtcttgctctgtcacccaggctggagtgcaatggcacaatctcagctcactgcaacctcctcctcctggattcaagagattctcctgcctcagcctcctgagtagttgggattacaggcgcccaccaccacacccagctaatttttgtattttcagtagagacagggtttcaccatgttggtcaggctcatcttgaactcctgacctcaggtgatccacccacctcggcctcccaaaatgctgggattacaggtgtgagccaccgtgcccagccaaaaacagtagtatttctactaatagctacaaacaattagaaagtgaaattctaaaaatgagaccatttacaataacatcaaagcaagacatatctagaaataaatctaataaaagatgtataaaactacatactacatcactgacagaaattaaagaagacctaaataaagggtgagagggatatatcacattcatggattggaggactcaagaatattcatagcagcgctactctaaatagcctgaaaactgcaaacaattggctgggcatggtggctcacgcctgtaatcccagcactttgggagaccgaggcggagtggatcacctgaggtcgggagttcgacaccagcctggccaacatggtgaaacccctgtctctactaaaaatacaaaattagctgggtgtggtggcacatgactataatcccagctactcaggaggctgaggcaggaggatcacttgaacccaggagatggaggtggcggtgaactgagatcgcaccattgcactccagcctgggcaacaagagcgaaactctgtctcaaaaaacaaacaaacaaacattgcaaataatccaaatgtccctcaactatagaataaacaaattcattgtgctataattatacaattgaatatgaatattcacaagaaatgaatacacttctgcttcatgcaacaacatacatgaatcccgtaaatatgatgtggagtgaaagatgctaaacacagaagatcatgactctttgtgattcatttatatgtaaaattttattcataaaaagttcaaaagcagataaaactgatctggtgttaggaatcaggatagtggtggttcttgctggggagtaacaacggcaagggcccaggagagaaggtttctggggtgctggccaccctctatttcttcatctgggtggtggtttcacaactgctctcgctttgtaacagtgaagccatgcatttatggtttgtgtacttttctgagtgtatgttttaattcagtaagaattttaattaaaaaaagtaggggccgggcgaggtggctcatgcctgtaatcccagcactttgggaggccgaggtcaggagatcgagaccatcctggctaacacggtgaaaccccgtctccactaaaaatacaaaaaattagcagggcatggtggcccacgcctgtagtcccagctacttgggaggctgaggcaggagaatcgcttgaacccgggaggcagaggtcgcagtgagctaagatggtgccactgcactccagcctgggtgacagagcaagactccgtctcaaaaaaaaaaaaaaaaagtaggaagtggcaaattgtgacgcaaaggacttctaaggcttctcaaactcagtgacctggctgccgtccgtgtcatgtgctgctgagcagtagagctgagtactttgtgtttgttttatcgtgtaatcctctcggattaaatgcactctgtgaaatcggtattattcttttttttttttttttttttttttgagacggagtctagctctgtcgcccaggctggactgcagtggcctgatctcggctcactgcaagctccgcctcccgggttcacgccattctcctccctcagcctccccagtagctgggactacaggcgcccgtcaccaccagccctgctaatttttttttttttttttttagtagagacagggtttcaccgtgttagccaggatggtgtcgatttcctgacctcgtgatccgcccgctgcggcctcccaaaatgctgggattacaggcgtgagccactgcgccctgccgaaatcggtattattcttatcaccacccccattttgaagaaaacacagcagtcctctcttatctgcagtcgcactttccatggtttcagaaactcacggtaaactatgggctgaaaatgttaattggaaaattccagaagtaaacaatacattttaaattttgcaccattcagagtagcatgattaaatctctcgccatcctgcccatgacatgaatcctccctttgtccagtgtaccctcgctgtatacaccactcacccattggtcactcagtagccctcttggtaattagatgaaaaacacagtagacatagggctccgtactgtccttggcttcaggcacccactggggagcttgcaacttacccctgaggataagggggactgctatactagcatatatatatatatatttatatatatatatttatatatataaatatatatatataaatatatatatatataaatatatatatataatgtgtgtgtgtatatgtatatatgtatatatacacgtatatacatgtatacacatacacatatatgtatatatgtatatatacacatatacacatacacatatatgtatatatgtatatatacacatatacacatacacatatatatgtatatatacacatacacatacacgtatatatgtatatatacacatacacatacacgtatatatgtatatatacacatacacatacacgtatatatgtatatatacacatacacatacacgtatatatgtatatatacacatacacatacacgtatatatgtatatatacacatacacgtatatatgtatatatacacatacacatatatgtatatatgtatatatacacatacacatatgtatatatgtatatatacacatacacatatatgtatatatgtatatatacacatacacatatatgtatatatgtatatatacacatacacatatatgtatatatgtatatatacacatacacatatatgtatatatgtatatatacacatacacatatatgtatatatgtatatatacacatacacatatatgtatatatgtatatatacacatacacatatatgtatatatgtatatatacacatacacatatatgtatatatgtatatatacacgtatatacgtatacacatatatgtatatgtgtgtatatatatacacacacacacacacatatataaatatatatatatattttttgagacagaggagtttcactcatgtcacccaggctggagtgcagtggcaccatctccactcactgcaacctccgcctcccaggttcaagtgattctcctgcctcagcctcccaagtagctgggattataggcatgcaccaccatgcctggctaattttttgtatttttagtagagacgggatttcaccatattagtcaggctggtcttgaactcctgacttcaggtgatccacccaccttggcctcccaaagtgctaggattacaggggtgagccactgtgcccattctatactagcaaatattattcctcattttacagatgaggaaactgaggcccagagagtttaaagtaacttggctaaggtcacctgaggagtaagaaccaagagtgaaatctcagcagttggtcccaggacccatgctctttgccaccgcactgactcagcctgtcagctgtgtctgttccactcctttcccagttcctggaaaagtgtttcccaagctacataattcatcctgcaattcatgcgacatctttgccatgtttgatgacacgaaaaacaataatgactcctattgtattccagcacttgccaataagagacagacttttaaagagcttgggacatggtgccaggaaaatagctgaaccaaaggtcttctgtattttgtcagtagaagtggagttgtgtggggtagcacaatatgcattttcactgccaagaaacttgcataatgattttctgcctctttaaaggcctgaatctattaaggctttttaattggtaaagagtaatacacgaagcaaatggaaggtattatccatccccagcatctctttgtgtcatcttttctctaggaactgttaaaatgtctcagttcactatgcataaaaattcggagtaatcagtgtattctataaaaatgcagagaaaagttttaaggaaatacaccagattattaataatagttatctctgggttgttcttgttgtagactcaaattttctataatggatatatgtcaactttgaatgcagaaagcacttttccaatcaggttaaaatatataaagttttataaaatcacataactacaattatattgaaacgtgtacatagtaaaagactgggagaaactgttcatagttttttgttttttgttttttgttttcctggatgtagagaaatgaatatttttctttcttctactttttggaattttccgatttttctataacaatcattgtattcgtcaggattcttgatgagaaattacagaaatagactccagctaccttgagcaggaaaggatttattgtaagaacattaggtagttccagcatccttcggaatgctggaagctgtggaaggtttagtaggagggatctcagccaaggtcaaaccacagggatggtgtggttaggcggctgctgccggcactgccaccccggcacacacagtcggcgctgctgccagactcaatgcctgcactgccaccgtaaatactctcttttactgtccctgtgtctttgcgtcactccctgaaggtccagatttctgggcaggatcatctgacttgccagtatctatcacatggccatgttctagctgcctgagtgcagggagaaagactgtcaggctccagtctgggtgcccccaaaattcatacaatggggatcttcccaaacaggcagggcgatccaatgcaggatagcgcaaaaaaagacaaatggccacaagcaggtattgttattattattattatttgcaatggcccaaatcatactacagagcagatttaagaaaggcacaaaccaggctgggcacggtggctcacgcctgtaatcctagcactttgggaggctgaggcgggcggatcacgaggtcaggagatcaagaccatcttggctaacacggtgaaaccccgtgtctactaaaaatacaaaaaattagccgggcatggtggcaggtgcctgtagtcccagctaatcgggaggctgaggcaggagaatggcgtgaacctgggaagcggagcttgcagtgagccaagatcgtgccactgcactccagcctgggcgagagagtgagactccgtctcaaaaaaaaaaaaaaaaaaaaaatggaaggcacaaaccaccacaagcaggcattgctttacaatggaaagaaaatgaataaaccttttcttttttggtaaaagatagactctttgtgtcatacaacatggatcagagtgaattttacttcacacagtacgggttgaagaacagagtttattagggcaagttacaggccaggggtcagtaagcgaagtcacaattgctccatcctcccatcatccccagacaggtgtgccactgtcagatgcagcaagacagagtgggtctgtgcttccttgggagggacttcatgccctcagttgctctcttagcaactttgtcagtggaggtaaaatcagacttcctgagcactgggcagtaggaatttggagttccaagagttacccaggaaggctaattttccagtaagaaggatcctctcggtgggtagaaggggtcagtgagggagactgtgggtcataatatccaagtcttggcccagggaaaaggatgggtggactattcatgaagctaaggaacacaggtagaggagaggcaggttgaggggaaattatgagttcagtttgggacctgccgggtctggcacacatataagttaaccccatacaaggttatggtatggtccctgttataaactctcacagcagcctgagggtctcctttgtattgcttatcccagttgcaattagataaataatttcataattagcgttgaatctccgctctggattgcaagctccctggggccatcacacacccaggtctaaccactatgttgctagaaccaccccccaccacgtggcatagggtcaggcacagagtaggtaaccaataaatgtgttgaatcaataaatgaatccacctggagcaacacagcaggcagtcggattcatggaaaggaaattgagagaaagacctgggctgaagctgtaggttcaggaaagtcctgcacgtggatagcaacggaatccagtgctctgggtgagctggcccaggttggttgagaaaatcaaaagacctaagccagaactctgggagacaccaacatccaatgggtgcaaggaacaggtgctgctgcaaaggcagacagtgaactaagagatgatggtgttatggaagctaaggaaaggcagagttctgagtacgaagaagtcaacggagccaaatatggttaggtctcggaaacagtaaactccggtgattacaaagcacctgtgtgccaggtacttttctgacagctatatgtatatgaatgcacttaattctcacagcaatcacatgataattagggaagtaatgtcatcatcattttctccctatgatggggatactgaggcacagagagaggacccagctaggctacctggtccccgagcctgtgctcttaaccatgatatatgccacctcagagaaggggtagcagataagtcactggtaacattgacaagagcgatatcggtggcactgtgggggtgatgccacatggcagtgagtcaaaaagtgaggccaggcacgatggctcacgcctgtaatcccaacactttgagaggccaaggcaggtggatcatgaggtcaggagttcaagaccagcctgaccaacatggtgaaaccccgtctctactaaaaatacaaaaattagccaggtgtggtggtggacacctgtaattccagctactcaggaggctgaagcaggagaatcgcttgaacctgggaggcggaggttgcagtgagcggagattgcaccactgcactccagcctgggcgacagagcgagactacatctcaacaacaaaaaaaagtgagtgggaagcaaaagagtcaagggcagaagtccagccccttgctacaaagaggggcccagctgcacccccaccacctggagtctgcatcctcaggtgatctgtgcgcaaggcaaagtctgagaagcactggatgagatgactcttttaggaactttggctaagagaagaaagaaaaagtaaaacatggtgtttaagtgagaggcttttctttttaggataggagaggcatgaccatgcttgtaaactcagaactgtggtttgcagccccaacagcatattcgaatcacctggtgtgtttttgaaaaacacctgattccctgaggctcgcccccagagaatctgatggagtttgtctgtgtggcccagatgattgtaatgtggggggggggggggtctgagacccactcaaggagaaggcacaagaaggacttgatgagaccttcacagggaaatgagaagggacacgatgaggatgaagaaatgcaaaggggatgttttggaaaaggaggaaaagcactcagagcaaagcagacagagaaatttacagagggcagaggcgtcaagaagatagatgttcaaagggaatcatgtttgagagcccatcatttttctttctttaactaggacctccatggtatggcaagaatggcacttgaaacacttagatggtgttactggtctgctcaaaggcttctgcctggcgtagtaggctgttggtgatccggcctcgctcacctccagcacactaggctctctgtgttccccttcctacagcacagtgatcatgttccggtctctgggcctttgtccttgctgctctcatctttgggctgttcccctcacctcccttgggtcccctccaatgttctctcctcagagaggactcctctcatcactctattcctttcctctgaattgtttcctaacactacctcatgtcatatacccacttgcccgtttgtttatggtctgcctcctctgcccgaacgaatgtaagccatggaaggaaggatacgtcttgctcacagtggaatatccaccaccgacaacagtgaggcccagaggggacacgcggcaagtttgatgagtgaataaatggctgttgctgctgcttggtgtaaatgcacaggatgctgagattaacaggtacttctgagagtgcctgggaaaggtgatgagtgggggagattgcatgagagcgagctgataaagaccagtaaatggaaatccttacgggcgcggtcaaggagggagtgcaggattataatggcaggaaagacagcaaacagaggcagtttattgtgtgactgatgatgtgttttttgcactagaccacttactatgtgtggctctgggcgaacttcttaacctttctaagcctcaattacccgatcagtaaaatgaggctgataaccatagtgccttccatccagggttgtggtgggggttaaatgaactaatggagcctggcaccgggtgagcacccaataattaattgctatgacggattcaagattgggggaagaatgtgaaatgttgcaatgcaaagagatgtttctgtaatcgttgcgaatcttggtccaaaacttactaccctggaatagaacttgttcccaaccactcacccacacaaacatgtctctgccttgctaacgccatcaccagccttttctcctctctgactcttctgaggtctagcccagcgcctggtacaataagtttctccataagtatttgttgtttttctttgcacttctcaccaacagtgctgccaagattttaacctggtcaggagaatctggtcaggcagagattagtgtctccaaccttcctaggggagaatgggctaggtagaaagatagcactcagagggctctgaatcatctataagggtggcatagtcataggaggagagtgggtttggtccaccagaacctccctagggagccatctgcgtccaagggcggccagaggccaagaaaaggcgctgaggccttggctcctttaagaggcgtggcctcactgcagcctccgcagaggcgattggctgaagctaccggccgcgtggggcgggactcggttgccagggagcggcgcgggagccctgaggggactgcggcggctgcgcggaggagcgaggcacttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctgggtgagcggggccgggcagagcgaggggccggcggcggggccgggcgaggccgcggcggaggcgcccgtgggggccgggcttgggcctgggcgggcgcgcgggggccgcgcgcgggccctcaggcggctgaggcgaggggagggccgggtgtgaggccgcttcgcgaggtccctgccggaccaagccgggagcctgggcgcggaggacagcgaggggaggccttcagggactccacggcctccagccggcgcctccgcgctcggcccacgcgggctggctccgtgccaggcgccccagtctcccccccccggagtcgccggctggacggagagcgcttattgcagactgtagcaggacgtcgggctcgaaataggatcttcgccagaggctcaggttccgcgctctttgtcggggcctcgcagacgagtggccgtcccgaggcgggcagatccgcggggacgctgcggagccggggcgggggttccacttaacgccctttgtgtgtggagaaccggctgactgtcaccagcccagaaaatgaagggtttcaactcgaggagccaaataatccattgaccaagaacatcggtctatttgttttggtcatgggggtgaccaaactgtgagattataactcttggttaaatatatgatggagatgtcacaagattttgaaagtgatgagttcactttcaataaaaggtggcttatgaatttttaaggggtacaccctctttgaaaggaatgtttatgtcatcttagtttgggtccttatctcatcagggacttttatagtaacctaagttgttcctatccgtctctccaccctccagcccatctggactttgcacccggataaatcttttaaaacgtttcctctatcacatcacttgatctgaaaataaggaaaacagaagcttcagcggtagaataaggttcaactccttcccctggtcttggagcagaagtcctcagtctggtcccaaatcaccttgcctctctgaacttgtcatttccttaaacacttgagtgccctggacagattgctctgtccacagtcgccagagcactccttgaacattccggttaaccatactgtgcctcttcctcctccccattcagctcctccctcccacgcatacgcacacctgttctggaaagaatcctttcctcctcccccgaccccccaacaagggataaaacttcatatcctgacagctgtctcataaaaggatggttatatgttaaaaagcacttgctacacacttgtattgccagagtccttcggggcgtttgtgtgtgaagagtcctaactgggaggtagtagctgttggcaaacacccaggcgacattggcatttccgtgatttcttcttttccaattagagcagtgtttcttatactttaatttgagttacaggcttatttatttattttattttattttttcagtttcttgagtttattgtgaagaatgaaatgcacatatagaaccagttccattagcaaaagtcgtatcagtcttctctttgtagatgtggcatgatttgtgaatctgaccattataagggcatcttttgctaatttaatacgtatctatatacctactgctacttatgcatccataacattttttattccataaagagaaatgtattctacaatgattaagtcattaattctcatagcatctcgttataaaccaggagtcagcaatctctggcccaagagcacaaaacggttagctacctgtttttctacaacctgagagcccagaataatatttacatttctaaatgactggaaaacaaatgaaaagaagaatactatttcttggcatgtagaaattatatgacgttctcctaccattcgacccagcaatcccactactgggtacatacccaaaggaatataaatcattctgttataaagacacttgcacgcatatattcactgcagcaccgttcacaatagcaaaaacatggaaccaacccaaatggccatcagtggtagactggacaaagaaaatgcggcacatatacaccatggaacaccacgcagccacaaaaaagaatgagatcatgtcctttacagggacatggatggagcaggaagccatcatcctcaacaaactgatgcaggaacagaaaaccaagcaccgtgtgttctcacttattttttatttatcttttttaagagttacaggcttttttaaaaggaaaaataattttcaggggtccccaaatgagaaacacgttgtcagctagtaagctacctaagaggtaaagatgtggctttgtactctttacagttccttgtgaatttatggccataactatttgattttgaagaatattaggtgaattctaggttattcaagctcagggactggaattgttcatgtaacaaaatattggaaatacagtaaccattttctttaaattagatttttatttactctaaaatatcagttctaagtgactcctctgaatctttggatattgtgtaaatatatgtactgttattccagtgaagaaagttattttgaacttcagtggtgcttttcatagcgggttattgccaagactgaagtggtaatgtttagtaaaaatatgctttatcttggttagtagggtagtaaagtttttgtgagctgtgataaggaagttaagcagatacgctgggggcaaatgtgtcacagtgcaatgtagctaatgaggaaacagcattaggtatgtctcccaagaaagtattagtttgtggactaactgtgggaatctgatgatgatgggtaatggcaactaacatttgagttactataccccaggcactgtgctaaacactttacatggcatatcctcacagctttcccatctagcagggaatattaggtacattttagaggagaacattaaggttgactgagccaaagtagcacacccaaggtgtgatacagcctgcgttcaaacccaggttgtcccatactctagagactgtgatgttaggacaaagtgtgatttcagaagatttgtaaagagaagaaagttgttagaatcacttctctaaagcatgctgattttgagattgctaaaattagaaactgtaccagaatttacatgacactttgtttggttttgaattaagtcattatgaggaagtacattaaaaaatgttaaaaggttcttcctgggaatttgtaatgcattcttcagttctaataaatgtattcttatatgctggcccctccctccttttaatgccttgagatgatgaataagtggaagaataaacatactctccatagagcttatcaaatgtttacctaggttcccttgggcaactgtaggcaataaaaactatgttgcattggctcttcactgtcagatggtaatggctgattgttaacaagggtcaaagtttaattgctttggcaagacctttaaactacactttcttatgtcttgatatcctgattctgctggcattttgttcattgaactgtgacatggagatagatatatacctgaaatactcaggctgtaaattatctgacagctaaaatcgttactgttgatttggtgtagatagtttggaacaatgctgtaataatgttactgtggaaaggcacaaaccaaaagcagaaacaatcatttctaaaatcctgaaatttgtcttaatggaaatagggaactcctgctatggttagaatgtttgtcctttataaaactcatgttgaaactgaatccccaatgtggccgtattgagagatggggcctttaagaggtgattgggtcatgagggctctaccctcatgaatggattaatccattcatggattaatggattaatgggttttcatgggaatgggactggtggctttataagaagaggcagagagacgtgagccagcatactcagccccctcaccacgtgtgatgtcctgggccacctcaggactttgcagaaggccctgaccagctacggccccttgaccttgaacttctcagcctccatgtatgtaaaaaaatttcttaaattacccagtttcaggtattctgttctaagcaacagaaaacagactaagacagtttctcaccaaattctagaatattaagatttgtagcttgaaagataatcttggacaagtgaaaggatgtacagcttggatcatcttggatctctgtttttatggaatgatgaggctttaaatataagtgtattcatgctggacccatgaggatttattgaagaaggttagaagtgttttaggtaaatgactaaattttaaaggctttttttttttttttttttttttttttttgagacgaagtcttactctgtcgcccaggctggagtgcagtggtgcgatcttggctgactgcagcctctgtctcccgggttcaagcgatcttcctgcctcagcctcccgagtagctgggactacaggcgtgcgccaccatgcccagctaattttcgtatttttttaacagagacagggtttcaccatattggccaggctggtctcgaactcctgacctcttgatccatctgccttggtctcccaaagtgctaggattacaggcgtgagccaccgcgcccagcaaaggctattgtattaaataggcattagcctattctgtaaactgcacctttgtaccaaggtcagacaggatttttagtttggtaagtcatttaatctgaccaaagagggctcgtctaaaacaagtttaaatcagtacttcctaccattaagtttttattccggtaaattaattgattatttaatcaagtcctatgttatacaaattacctttactttttttttaaaccctattagaaaaactaattggctaatacttattttgctcatatttatcttaggcattacagggactggaacagaaagctttgtccatgcttatagaatttataatcttaaatatctatttaggttgttgtttttcatctgagaggtgatagtataaaactgagacacctgtagagtgggggaagtaccgcaaaaaagtcaaacgccttttaaataaatgcctttagaaatagctttggaacgtggcaccttcactaaccatcattcattcatatgaaatacttcacacatataaattgtagttgaaagccatatgtaacctttaaaacttatcctgcctttaaaaataaaacttatcagccaggtgcggtggctcatgcctgtaatcccagcactttgggacgccaagggtggcagatcaccctcctgactaacacggtgaaaccccgtctctactaaaaatacaaaaaattagccagatgtggtggtgggcacttgtagtcccagctactcgggaggctgaggcaggagcatggcgtgaacccgggaggcggagcttgtagtgagcggcgatcgagccactgcactccagcctgggcgacagagcgagactccatctcaaaataaataaataaataaaacttatcacgcttatgtctgtgaatgtatataattaaggaaaatttgctttgttaaatataacactactatttgagcacctactttgtgcttatattgttgataaatgatgaaaagacagtgaaaaatccctattcttacagaacttactttccggtgaagcaagacacacaaaaataaacaagaaaaatgatcagagtgatgtgttatgcagagaattaaagggtgatgtgataaagtgattgggtcgtgctttatgttggcaaaaaaaatctggagtataagaagttgctgacttgggtgatttggaagagattgggagactggggggattcagaactgaaggaacaggctgtaggctgtaaggcaaaaatatacttgctatgttcaaattactaagaggtttataccgtcatgcttttgtttaaaaaataaaactttataatgaggtatttcaagtgtggttctcccttgtcacaaatcttgtacatactttgtgttttccagcacatcctacacattcgaggtggtaatatgatacttttaaaccggaacctgcatctgatatcctggaatttgtttctctacttcctgtatttctcctatcatgaatgactgctctgacaaagaatatgtcatgggacacaccttcagctaactttgctttttcatgcttgttttcaattcactagaagaaaatctaacttgtcaggaagcaagtacataataggaagtgtctgtcttagtttgtcttcaacagttaagaaaatgaatgtttccactcttactacattcttagtcacctgtccactgaccaagagccttgtggccctgagtaatcatttagaacttggaatcagcaggggcgctctctctagttgcagtttagggaatgggttattagctttctaggatatttatcatgctttgaaataatttaatgaattttattccataagatccaattcaggttaggcttgtttgattttttttttcagaaaatgtattccataaagtttgtacttagaccagacgggtgtactaagaatcattcatgagtaaatgtgtgttgaatatctacccttgacctttttttgagaaatagagtaaacacagtccctgtagtctgacagctaatggggagagagggtagacttttcatcgaattaaatttctacatgcacctttcccccagaaatcttactcatggctggtctcaagtaagtctttattgaaaaatattgacatatcttcttcctcttccttctcctcactgtcttccttttagtagttaggcagagttaataggtaagaaaaattatctgcatttatgtgtagtttgtaatctactaaaggggttctagaataaatgttgacattttgtaacttacattgttgttgctactgattaaacacataacccaagtgtggatgaactctagcattacaaagcttaagcacctcaggctcctatgatgttgtaatggactctttttacaattagagtagggtggggtaacagagggtctcaaagaaaatgcatatttaaatttcaggcttctcagataacctctggagccctactgtctggaaacagccagtttccatgctgttacaataatttggcaatggcaattggttaatctccagtttctttgccacctgaaattttgagttgttcagccagtagatattggattaaatagaacaactttgttaagctggtttaataatgattatgaaaaaccaaatagagaaaaggtgaaaataaggcagaattgaggagcatgacctttggcatatcatcagagtaatagcagtaaaaaggattaaaatatttctaatttaagaataatggcaataataatagtgatgttgatggcaaaagtggcttgtcagaactttaaactcttagccaggcttggtggcacatgcctgtaatcctagctacaagtaagactgagatgagaggatcccctgagggaaggagtctgaggccagcctgggcaacatagcaagaccctgtcttaaaaaaaaaaaatagaattttctcattagtatagtggtgagttaaaaaaacacacataaaactttacaccccaatttaagtaggactttaaaaaaaacttgtctccttgaaaagtaatatttatgagaaaaggaacataatgtacattgaaagaattgtgttagataatcagaaaacatgtacaggatgagtcaaagccacacagacctgagaaaagtggtaagtgggagagattggcagaggtgcctaaaatatttaggatggaagaggtgtctgtttttggttggttaaggacacatccaggaatgaattcattggtgagagaacattaaagcctcaatttcagacataattttaactattattctaattatgcaagtaatatattttaaagaagacactaaaagtattttaaaaagcaaactggtatcacccataattctaccacccagagacaaccaatatcaacattttggtttgtttccaatatgtgatatatgtgttttttcccctatcacaccacaagcatattattaaatgatgctttaagaaaatatttcagggctgaatgcagacacacctctgaataccagggctttttcattttcatttttgcagccacaatttcattacaacatctcgatgaattaccttttacacaaatctgtgtttctgactaactttctaaaggatagattcctggaagtggaataagtaggtataaaggcatcaatgctgaggcagatatgtattgccagattgtttccaaaaaaatgattctctattagtttgtgcttccgcccatctgagggcccttctctctgcaccctcacacatctttgaatactccttaactttattgctgatcagtttgttaggtagaaaatgatagtatttaatagcttcagaaattcttggtaagagtagctttaatttctgaaagaggatttggagtctttggaatggccttttttccttgagagttggtaggagagtaaatgatatattcaggtagtggacttacataagaagtagttgtgtttagtgacgtaaactgttctatcagattaagtcagaggtgaaagcatggttgaattagagaatatacattatggcaagtagaatgctaaacgatttaagatgattttaagacacttgtaatggcataagggtgaagtttggggaagctttcagaaatccactgtgtggaattaccaacgattcttcccaggagagaaaagaggtatatgaaaaataatatgacagtacaggaaactctggatttaatgttaaaaagatatatgcataagatggattcctgcctattttttccctctgcttttaaaacctgctttcttacaaagtctagagtacagcattttttgctcagtcttttacttcttgacttttttcctttctctcaacactccagtcacttctactttactaattgattctttggcaaaaatcactccgaagggagcagttcacacaggcaagcaagaatttgtcaggcactgtgcttttaggtgaataaagtccagatggtgccttgtctttacattgttttgattcttgccagttctagatgggaatcatcatcaatggctactacataccactgcaagaaaatcacttctattctttgcttcagcttcgcccaaaatgtcctgtgggatgctttcgcctttgtatttctaaatctccatgtaggtatacttttggcaacagagctactttatctccccacttgtagcaaatctgtttcatttttaatattgccacattccaatggcaggttacaccgtggttgatgaaaaggaatttaatagttttacagattttaacttttttttttttaattttttgagactgagttttgctcttgttgcccaggctggagtgcagtggcgcaatctcggctcactgcaacctctgccttccaggttcaagcgattctcctgcctcagcgtttctgagtagctgggattacaggcatgtgccaccacgcccggctaattttgtatttttagtagagacggggtttctgcatgttggtcaggccggtctcgaattcatgacctcagatgatctgccggccttggcctcccaaagtgctgggattactggtgtgagctactgcgcctggcccagattttaacattttatctacttgtctctttcatagaatatttgaaaattacccccccaaaaactagtttctaagctatggaaaaagcaatctcatataagaatgaaatctctttaagatatttcacatttgtgcatatgtagaggaagggtaaaagcataaaatgaagtatcatacttttggaactcatatacttgcaaaattttataacaagatggctttattttttagacagcttagtggaaaagcactggctctcctaaagttttaaaatgttgtgacttaatttagagtataggcttattaaaagataaagaataatggttttttaaaaattattctttctgtaatttcagacctcagccttttgcctaaatttcctttcacttctttgtaaaaaggatgaatatttttagtacactgtcctggcacaaatcctccttacaggctcagattttctcagtggtgactaaagcagttcagctgcttccaagttctacatttcatctccttttctgttgcacctccctcctccccagccccctcctttgcagctgctttattggcaaagctcagatcctttgatagatctcaatcccatcatggcccttcaaaagaagaatttaagctcaccttttatatagcttttctgatagccacaatttctgcattaaaaatctgagggatgacaaagtccctatgcatactagttaggaatttcttagaacctctcttccatttactatactgtttcccatgttcttttgggtgtttttcatattgatggttggatatcattacaacaattacttttggctgtttttaggtcttcagctgctactgggatacctcttctatattttcaaagtaaccagtgtcatttcataattgtttattatacagcttaagatataagcaccatatacagatttcagtaaaagcaaaatttgaagctgttttcaatttaggaaacacatcgtctatttataagcaatttgatgtgtatagtttcatatcagcaatccgtgcagttttctctttggtgtgtgcaactagtaagttcctttaactatatgttgccaaatagagctttgttatgttctcatcttgttgtgtgacttggatgttgactgcagcctgggaaaaaaaactgttgtagagtctatcagaaaagaagaggcagctttacaaatggcatctccccacagccctccattgcatttgttgtgcatctggttgtctctgttgctggtttttctgctttcttgtagtctcagtttcagatgagtgcctcttttaggggggagaggcagtggcagcagaggaaacatttcccttggcccacctccaagcagcactaagtgtgagtctcataggaacctctttagattgaaaactcatcaatttatatctaaaatgcaagtagttcttcagtgaactgtgcttcaggttgattgttaagtacatatggcctccagttttctcttattttcattcgaatttacataggctaaagctagtgaagtttcagtaggtgtaccgaaagctcagaaatggaattcattttaactcaagccttttaagaaataaatactgccttttagagtaaaaaaaacctacaacattaaaggatagagaaacgtctaataaaaacaaatgacaaaatttgattaatttgcacttcagattgcttctaatttagcgtgaggactgatactatttactttagcaaaatgtgtgtgtgtacatgtgtgtgaatatatatcacacaagtagtcaataaaaaggggtatttgggaagagtgttaagtagttgacatacttctgtaataaatgcacccaaattaaaattaagctatgtctggccaggcgcaatggctcacgcctgtaatcccagcactttgggaggccgaggcgggcggatcacgaggtcaggacatcgagaccatcctggctaacacggtgaaaccccgtctccactaaaaatacaaaaaattagccaggtgtagtggcgggcgcctgtaatcccagctactcgggaggctgaggcaggagaatggcgtgaacctgggagacggagcctgcagtgagctgagattgcgccactgcactccagcctgggcgactgagtgagactccgtctcaaaaaataaataaaataaaataaaattaagataaattaaactatttctcttctccactcccccccacttttgtgctcaccttcattctctagtaccatgccccaaaagcaaatatgtcagtgaactctgagaacctttgaacaggcagtttgctgtaagtacagtgtttatatttatgacatatttacgatatattaacatattccagatgtaatggccatcagaattcagcaagctggattcagttgccaaataattgaatagtgaactaaaagctataagcattgaactgaagagaaaccagatacaaaccaaatacaaatacaaaccaacgcaaatacaaaccaaagcttatgatagagttgggagggtgatttcaagggaaaggggtgagatgaggtgtactcaataaactttaactgatacctgctgtctgccaagtactgttctagatgatacaagggtgaaggacagatgggtacaattcgtgctctcaaggtgtgttgagacaggtatagctataattgcaaccgtttcgataaatattctgttagaaccatgcactgggagatgtttgtgtccaccaagggcagctaatccagcctgaaatggtcaagaatggcttccaaaaggaagaggtaacatttaagcttcatcttaatgagcgacaaggagttcccaggcatttgaagagagcattctagagagaacagcggaggcaaagaagtgagagaatatgtggtccatttgggtataacagttctatattgttcatagttcacaaggggtaatgagatctggggctgaaaaggaggaatagcttggttcatcggggactcacttgcctcatcctgattttaagtaaggctatggcttgatctggtttgtatttttaataaatataaccctggtagtataaagaatgtattaagatgcagggagagtcaataagtaagatttagggggataagataaggcccaaattaagacagaagcactgcagtggggttgaagaggagttgaggtattcgaataatgttttggaagtaaagttgaagttttgtgatttatgggttatagaggtggggcaaggaaagttaatcctcagatgtttgaccagaaaaattagatgtctggtaccttttgctatgataggaatgtaagggaagattagatgggctgggcaggaaggcagaaagggtttgagacaggttgaggatgacatgtctctggaacttgcagatggaaatgtgtagttctgagatgatagctcaggtagtgagctacaatgactaatgaagccatagctgctgtagcccacggagagcccagagaatgactaaagaataaggccgaagacagaatcctggagatcactaacatctcagagtccgtgaagagaatgaaaaagtgagcacctggggaagtaggaagaaaaccagcagtggggcctcttggaagccagaggaagagagttttaaaacaatgtttttaaaaattgccttcattattctagttgtcttctcactttaaaaagttcatgttacattttaaaaaatcaaattactttcccaaatttacataaatggagtctttttcttcctcatctgacagtgatcctaatggcctagtgtaaaaaaatatactgatgatccccaagcttactgaatttcataaacttaaatgatctgggttttcaggttcagagaagttaatgatatttccagtatcactgtggcagctgtttctagtttgaagatgatttatatgttaaattttaaaggatgatgaaatacttcttgtgaaagtttcaaagtactctacaaatgataactcattgttatccaagtgataaccaaatgttttaacacttactctgacactgcatttgcttgtttgtatatgagccagtggcattgggctgtcagcacagagctggtacccaaagatagcaaaattgacaatagcggagaaagtaagactctgcagctggagaatgatgcctggagcagcagctgaaataagacacacctatcacttgtctttgtgtgttcactttccctttaggtctttaataccttgttactcagagtgcgctccaagaagaagctgcaccagcatcacctgggaacttgttagaaatgcagactctcaggctcctcctcagacctcctgaatcaatctgcttgttattcagatcctcaggcaattcctattcacttcaaagtttgagaaccaccattctaaagaattgatagaggacttgcagtgttctttaatgactgagccctctagctttgccatttcactgtctctaggacagcaagatttttggaagtggggtgggtatcatgcttactagttggtgtattttcttttccttgaggtggggtagatagagattagaagtgtagattctggagtcagattgcctgagttcaaatccaagctctgtcatttctaccaaatttccccacttattgagggcaactgtagtgagcaaagatccccctaccaccatactgatccgtattggatgtggaattgagctacagtaagcctttagggatgtgtaggtgtgtgtcatcatcattgttattatttggttatggtttcttggtcctagctgaaccatcaattcgtgaaaagtaggtgaagtgtggataactttttaattttatctagtatagaaatgctcttaacaaggaatcatagaattttcagctttactgaaaaaagtctataacagttacggtaactctcattaaattataccatactaagcaataataggaaatttttaccagcagtgcttagagaccagtactgactttgttttctacagggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacggtaagatgtgttgtgagaacatgcaggagtatttagtctatgctactctccttgaacatgagactccttggctcttatagttggaacagagttaacatttaaacttctagcaattatctctgataactttttttaaatcaagagtgtatttaaagttattttttcatttgtatataattttaaaccatgttttcttacagtttgtcatcatcctgctcttggtttttgtcacagaagttgttgtagtggttttgggatatgtttacagagcaaaggtatgttgtctactgtaattcacataatgccttaaaaggtggtttaagtgtttcaagtaaaatagaacacattcattttatcagagtaaacattttcttttgccttacttgtttaatctgtatttcaaatatctaaagttaattggcaaatatttacatgtcaagactccttacctcatttaatatagcagagtgttatatatgtattgttcttgattataggtatttatagctgcaaatgaataattagctgagaagtttgttcagatttcctcagcacacagattgcctatatgaggggaggcataattttctgatttctgctttagaagaaccaaactcagaattgcgttttccattgtctctttaaaaaatgctttggtcctaaacatagaaaaaggtgttgtgagttgtgatcccaccttccacccctgtcctgaggaacaaggggtcctgccaacttagaacaccaaggcagctggtgccagcactcctttcttgcccttcattctttttaatcatttcaccgttccttcctttctattttgcctgattttgctgtctacctgtagtactacttaaggctaaacaggctgctttaaattaattaatatgggtataattttagaggcatggtaaagacataatagactcattctcattataacttaatggttttgagtcaagggcataatatgccaagttaattttcagatcattgatacgtaaggtactgtaaagctgtgctaaaaaaaaaatgcaatggattatgtccctacctatgatctggttatcaattttatggacttatgatattactgttgtaattaccagataagtccagtcctccgaggggtaaggaggatctggtacaagcaaactttactaagtgatacttgcttgccattttagtaattggcagcaataagctatgaagcttgtttcctgtctcctttttgcaatacattgaacagtagctttttcataaagtgccatttctaaggactgatttttttaaacctgccgattacttttgcacatttagccaactctaaacgttgaataaataaaatggaaataatgttggcatttgtcctaaaagtatcttacaggagcttcagagttactttgttttacctcctttaggaaaggaaaatgagtaacttatttgtaaaaggaaggcatccatttataatttaggacatctatcccaagcctcaacttttctcccttttgaatacattgttagcctgccattttgcacacaatcttctctttgaatgcttgaatgtatgtggtatatgtctgaatttttacctgtcacttttctccctcctgccttcatctatatctatatgaagatgaaggcaggaagggagaaaactttacaggaaattcatagatatctggcaacttgcaaacatttcatttaagtattttagtaggagccttgactaatgttacttttactagtatttttgagggactgaattctttgttctgattcaggtggaaaatgaggttgatcgcagcattcagaaagtgtataagacctacaatggaaccaaccctgatgctgctagccgggctattgattatgtacagagacaggtgagctttcttgaggcagatttgtttttgaggaccaatcacgattgggtcaacattaaactaactgctatttctgtgtaaattagccatgtttcttcacatacatggctatcctgatgtgaccaatatttttccccaaccttcacccttgaaaagtttatttcatcacctagccagatgagaaacatcttgaacttttttttatcatctgatttccccttccctgaccccagtctgtactctcccaaagtacttagccaaaggggtgatgacgcaagagagaggtatgtgtcacaggaaaggtgggagtccagattgactccaggggaggtgggaggtctatatatacctttagaaaacaagataagaaaaggcaacagaaaaactgtcaaaaaaaagttgttatggacagtctgatacacacaaaggtagaaagaatagtgtaatagatgtttgcaccccgaccttgcctcagtaatatcaacttttcgtcagtcttattgcccctacttactttttgcttcattatcttaaagcaaatctcaaaatttttaagaccaaatattttaaatactttgtcattggaaataatatttaacatggaaccagatatttaacatgtaagacatgaagattttccttagttagaaactaccgcttataggcaatgtacttttcttttctttttttttttttttttttttttttttttttttttttttttttgagatggcgaaatttcactcttgttgcccaggctggagtgcagtggcgcgatcttggctcactgcaacctccacctcccgggttcaagtgattctcctgcctcagcctttgtatttttagtagagacggggtttcaccatgttggtcaggctggtcttgaactcttgacctcaggtgactcgcccatctcggcctcccaaagtgctgggattacaggcgtgagccactgcacccggcctggcaatgtacttttcatatggagattctggagccactagccatgtctggctgtttacattaaaatttaaaatgcagttttctagtcacactagccacaatttaagtgctcagtagagcttcatgtggctagtggctgctatattggatcatgcagactttccattatagaaagttgtatcggacatcactggtctagagtagcttattttaaagctctgtagtacatggaacttcaggtatttggtttttgtgagaaataatacttattctcttctcctttagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggtgagtctcttggccacgacttgagtctagcttgattaacctgtttttcaccatgtcttatcaccatctgggacttcttttctgccaccttgcttgtctttaatgtcatatattgttttactgtaaattattataaaatgcatgtctttgttttaattacatgtctgtaaattataccaatcatggaatcttttttccactctttcagtttctgtcattttcctttctgtaagtgggtagtggcctgtgaatctgcagctttaacttttaaagaacacttctaacgaggatgactgtgtttgttacaggggtgtgaggctctagtagtgaagaagctacaagaaatcatgatgcatgtgatctgggccgcactggcatttgcagctattcaggtaagcacagcttgccaaggagttctatcggagtgagttggttctctgttgtcagccctgaatggttttaatccccatcacagtgaatctttgtgtatgtaggtaatgtggaagtgactgaggtactggcctccagtttcccatgttttccatttcttgtctatacacctagacccggaatggtctaaagaaaccagaaatctggatggggagggaccacgtgttgagggaactcctcgtcttactgtctttcttgattagtgagtgacctgttcaaaacataaacgaactgttgtcttagtgtattcttggaagatattttattagaatgtcacaaaatttttaaaaattgtacttctttctttcagtttgggaatacaaagctttattcagtttttttgtatgctagttctccctctagttcttgtttttctgtcctcacaggttttatatattcatatacgtaaatcaagaactggtactacagcactggtctcttgcactaaacacaacaacttttaaaaatagagacaaggtctcactctgtcacccaggcttgagtgcaatgacatgataatagctcactgtaactttgaactcctgggctcaagcgatcctcctgcttcagcctctccagtagctgggactacaagcacgggccaccacaccagactaatttttaattttttttttttttttccagaaatggggtctcattatgttgcccaggctggtctcaaactcctggcctcaagcaatcctctgtcttggcctcctaaagtgttgggatttacaggcgtgagccaccgcacccagcttatgctttcttttcttttcttttcttttttttttttttacgacagagttttgcttttgttgcccaggctagagtgcaatggtgtgatctcagctcactgcaacctctgcctcccaggttccagtgattcttctgcctcagcttcccaagtagctgggattacaggttcccgctaccatgcccagctaatttttgtatttttagtagagacaggtttttaccatgttggccaggttggtcttgaactcctgacctcaggtgatccacctgcctcggcctcccaaagtactgggattatagacgtgagccatcgcgcccagcctcagcttatgctttcttaagcctgaaacctatttcaagagctaaaagagccaggtgtgatgggttacacctgtaatcccagcactttgggagaccgaggagtaggatcccatgatgttaggagtttgagaccagcctgggcaataagactccatttctaccaaaaaaaaaattttttttaaaaaagaaaaatgtagataacttttatttgttaaataaaaccaatgtaattgctagtttaaatgtaagttgcttggattgcttgctctttgtatatttgaacagaagctagtgtatttaatgggaaaggccttttaaaatggcaaaaggatgattgtttactttgctgatattcagacagccctgaaatgattcattaaaaagcctacctctttatttgccatggtctttgcccttctaagcatttactctgtagctctgcatagcagtaatctgatgatcagcagggatttatttcatattttgattatttatgcaaacacattcatttagctaaaaataatgaaatatgaggaaggtctcttttcccaaatagaattctgaactgtgcattcttaatgattttatgttcagtaataaagccacatgtactagcatgcagcaaaaaagttttggaactgtatggtacttgtggtcatgaaatatgcaacatgtatatagaagactgataaaaataatcactttagctatgtccctcatctagttaagcggcttagcctgccagacatttctttattaaatatttttcaataggggctaataaatattttaactagtctcttaatttaaatatgactgccatatgtgttttatacttaagtcaccctgacttaagtaaaagctgataaagcttgattttttcacttcagcaaggctgcttaagtttagggattcagagctttcacagactcaaaacctagtggttttgaaaattttaaaaacttgggttttaaggggagaaaatttatctgaattaataattttccctaattgtttttaagagtacctgtaaacattctaagcttctggtattcaaaatctgatagattggtgccctgggtgtggaaaacctgaacaaaggcagaaataactgaaagatcagtgagcttttgtgcttatacactgatcctaatatagacatttagagctggagaggatggttggagagtctccagtcttggccctctttgtttagccacaaaattttgggtgagcaaggatagtgtggcatgaccatcacacagagtgtcaactctagagacccctgcctttgtttgtactctgcctccaattacaagtataagatttgcagaagattaaattcctaaattttgtcaggaaacctgacagttaattgacactttagctggataaaatacagaggtaagatggcagagttgagtagttacaatattgattgatttttgtcttggtttggaaagcctaaaatatttatgatatggccctttaagaaaatgtttggtgactcttgctctagtccattaaataatctagatttgggtaggaccaaagtgaccaagaaagaaaaacctgaaaaataccaattaattataataacaggacttttgaatataaaagaatgaggttttaaaaattttgatgtaccccttattaattagcaggatatttcacttctttgagagtagccactctcttaactcatgatcaattatgaattttatatttaaagaatctggtcataataattgacaaaaatctagattttgatttgtcaagctcctgagtatctgctgtgagtaaggctgtctctctacaaaggcaatacggggaaaatgttctaagtctttactttggggtctcatgaagttggcatatcctcaagatagaacgatcaagagcagatttcataaagaactgtttcccaaggccatgttgctttttttctggtctctgtgccgcatgtgaagccggtggagactgctctttcctcctcctcctcaattaccagttattcgttaaaatgagaaacttcctcctccttcccctcacaccctggccaacattgcaaaatgttatataaatgaattcatatagtttgcaaccttttgtaccttcttaaaaacaaattagtgtattttggatatagatctgcctttttaatttcatgtctgcatagtattccattttataggcatactttaatcaatattgatgggctgtttatagcaaaaatttgtaactatgaaattacagtatcagaatgtatgaatgaattttgataggtatttccaattttttctcagaaaagagtgtttctaatgtgcaaaagttcttatttttgtataagaatgcctatttccccataccaccagcaacatggtatatcatagaacattttactttgccagtcagtttttttaatcaccactagtcatttttttcaatttttgcagttgctgggtgttatatttgggctaagtgaagtttaattctcatgccttgaatattgcaagagagtatttcattgcaagaaataatgttggagataaaatatttgtgtaatgtttccaagtatgttgttggaatgtttcaaaaatcaatggaatttcagtatagcaggcctttggaaatgagcctgtaatagttaatggtgaggataagaaattattatgtagagcttaatattcttaagcagactgattcccaagcatgagtagaattttatcaagtttatttgttttaaaatcaatacaagttgatttcattgaaataaacaaattgggaaagaaatacttatttcagacctcattttgagaatgctggcttctctaatagaagttaaccaattgaaaggagtgtggggaggtgggggtgggaagagagattttttttcccttagcaaaccagtcatttctgagcttagcatttttattgctcaatttaacattgcctgagaacataattgcatttgagtttatagctgttctaacaatgttttgatgtacagagaacagaaatgtatttctctaggaattaggtacttcatcggtctagaattgacttaaattgtttagtaaactttaaataatattcacctcttaagtgtgtttaaggtgctttgcaaatggtgaaatggtgcaaatggtgcaagtggtgaaatagtgaaactgatggatttgagcaggaaatatatatcccgaatgggcagaatataggttaatgtgagggtagaaattggagtgggtgactttataccatggagaattcagattgaggacatccttatgtgtatgtgtgtcttagtagtggttaatcttccacttcaaactttgagagtctgtttatggattgggtacattttgcggaaattagattgacccccaaatgtacagaggaccctgtcttttaaaatcaaataactgaggcttttcctcatcaatgagaagttagaacagcaaattatctcacaaaaaaattatattttgggagaaggtaggtcaaaaattctagaatcattttctctttaatccagcttaatccttttgcttatccaaaataacatggcatgactttattactattccaatatgctaccacagaaggtttaggacttattgaaataaaatgatgacggaagagtgacctttcaaaagtaatatgtatgtaataccacagaaccgtggatttcaaaaatagtgaatgtgaaggaaacaaaaaaccttccaactacattttttttggcatcagaatttgttttctaccatagggctattcacatactgaatttcgttttccaaaaaccaaaagacctgaaaagaccactattaaacacacacattcttgctcattctactccccaggcctttgctgtccagaatggtagccactagccacatgtgtctacatttaaattaatttaaataaaattaaaagtgcaactcagttgcagtaactatatttcaggtgctcagtagtcacatgaggccacatgacagtgcatatgtggtatgtctccatcgctgcagaaagttctttcggacagcactcgctagactagtagtggggatgccaaataagagagacttgattccctgctggctttacgaagagttcctgggagggaagctgaagcttaggacttagttccttaaaaaataatgtactcataagaaattccttctatcactgttgttactgcctttttgatgatttgaagtcattgaactttgaaacagctcttttaccaacaaagaaatacacacctgccatgagagggttttcagccttttttccccattgttgttttctttcaacagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaacatattatttttcattatttgggggatatttcagttccagagcagcagtatcatgttttctttgttggtgctgtctatagttcatcatggtttacgtgtgttttcgttatagctgttgccagattctaaagggcttgatattcaaaaaaccacagatgctttcagtccagtatatcctagaaatatagagctctactttgtgcaatgcactggggatacagtggcgatactgtccttgtcttcaaggagttcggagtcctagtataggagacatacataggagaagataattttcacactgcagtggttgtagtaatagaatgggagtccaaaggggagttccggagaggtcaggggtgacttcctggaggagatgcccaagcttggaggctggataggctttgttgaaagatggtacacaagagtgtgaaacaaaattgtgtgtgcagggagcttaaaatacaaggctggggaaagaagttggagaagcaggaaagcccaggccctctagtgtcttacggaacatcctgtggaggtgagagctgacttgtaggtggaagcagctctttggaggtttgatttggaaggtgaactgagaagaaggtggtgatgcaagccggccgtgctgaagccaggatgaattggtgtgactgggcttcagttaggctggcatagcagttgagagagcttagcagtgggcagcagggcactgttgggggcggtggtgagcggtggattctggctgtttggaggcaggacagtggtggaattcgatcattgattggacgtgggacagagaagggagaagagaagactcatctaggatgagtcccaggtttctggctcagtcaactggggaaacaaagtcacagagctagggagtagttagagaacacatctgggggtgtgactcatggtcagttttgggctcgtcagttttgagatgcccaaatatcatgcagatctgtcccacctgaaaatggagaagacacgggaaaggagaggagtaaaaactaactccttttcacaaagtggaagttaccagaatgtgatttcagaggccccgggggatttatcatgtgactactgacccatcccacctcttgcccctgcctgttgcacagtgggcaagaatgtttgtgacctttcactaccaccacctcccccgagcatggtccccccagttttcaatatgaaccatcctgtgggtaccctgtcacaggctggccctgaggtgagcaatatttggactgtgatgttggttgttctccactctttctacaggacagaacagggcctctagagtgggaaatggctttgggaaatatgccaagcagtagccttgttcttcaacttgcccaagaggataattctccacacccttcctgtactcagtcctcagtttgcctggtgagagagcagcctcctcccgtgtgctctgccagctggacccagactggccatattaccagtgagaccaaaaagatggaggtggggaggtagctctgaggtctgggaaaccattccagctcctgccagttttaacttgtgtttaattcctggcacagttgtcctggaaatgcctttttctcttgcctgggaaccactagaaggggatgttgtctgtgttggccagggccatgcaaattcaacatcttgtttctgcccttcccccgtgtagctgaggctaggtgttggcattacccagtgcttgttcttcagagagcaaaagcactgctcgtcatgtctgaaatttagtgagtgagctcacccactaggctggtgtttcctgcccgtggctgcacattggaagcaccggggcactttgagaactacagatgcctgggtcccagagcatctaaggtgctctagggtgtgtccaggacacagccctggttgaggaccactgctatattgtatggcctcttttaaaaaagttaattttacttggaaatgatttcaaagctacagaaaagttgcaagaataaaaactgtacaaatgaggctcaaa

SEQ ID NO: 576 - DNA, 9087 bp, Homo sapiens
ggatgggcaggtgggagctgtggccgaaggtctggccacactcaccaccaagcatcaggtttccggactttgtgactgtgctggtgccgcagcagattccaactgtgcacaaaactcttactacaaacaaggcacttagaggccttctcacccatgtggagcgcaggtgctgcaacagggtggagccaaggctgagactcttgccgcagtcccctcagcggtaaggcttttagcggtgtgagcgcgctggtgctggatcaggttggagctgacgctgaaagtcttaccacactaggcacaggcatagggccgaagcgatggtcacactcggggcaggagtacggcttttcaccggtgtgtacccagtggtgcttaaccagatcagagccacatcggaagcttctgccataacccggacaacggtaaggcttgtcaccagaggggctgccttggtggtgaatgaagccggggaggcaggctgtggtcagtccacatttccggcactcgcaggttttggggcttgtagacggttgctcttggcaaaggcttcttcctccccagggctagagcctgaccattttccgggcgggcagctgccccgaccacaccaggaagggctgctcaggcggagccacctcgcaatccaggggtgacctgggggctccccgggacgcgaatgtcccgctcccccgccgccccgccccgtccggattctccctcgcctcttctggcgcggccgactgcgctgcgagtgaagaactccccgtttcctagatgccagctcctgagctcacgagcacgtccagagcggaggacactcgggacaccggggtccagctccggaaacggaaaattccacaagcccgtcactctaggaagcggcagcgaacgttctcggtaggtttaaccctcttcttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccctggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttgggtaagtgctccgcccccgtttcctagaaagattaggtttgcaactcccttgctctctagacccgggcagtctggagttctttgtgtcctatcccggaataacgtgctttgtgatggcgcatcgctcctgtttctcaatctgttgtgccccgtgacgtcactgcactctctatagatgagagagagccctcccagaccagataattgtagccattatctaggaattggttgttgaggacttctttcgaagctggactagcggaggccaaagagttatttggtgattttttcagatgattcttaccgtccagttatgatgttcatagcagacattcagtgcccaactatgtgtccggccctgtgcaaggttctgaagccccactgatgagctggaaggtgtagtggttcagaaagggagatctgcaaaagtcacctaacccctccgaggctaggattccttgtaaaatggggcaataatagctacctaaaaaaatcagagtggggagaaaacgaagtacaaatatggcacgaatatgcaaatattctaagcatgatacgtatttcaagttattaaaaactagcataagctgggtgcagtggtacgcgcctgtagttccagctatttgggaggctgaggcgggaggatcccttgagcctaggaggttgaggctgcagtgaacaatgactgcctgtgaatagccactgcattccagcctgggcaacgtaacaagacctcgtatcttagaaaaccaaacaaatcagtagtcgcttaggaagcaggaaaaaataaataaaaataattaaaaccagcacagtaagaacaaatcctagcaaaacataagcttttctgtttaccagctaaattggtgcctcctagtggcaatgtgtgaaagcagtttacatgtcactacctgccttccacgaaattatgctagttttgatgacatcttaacttttcggataaagggaagcattaatatatttaaaatttacataaaatgtatctggaccatatatgtttgacaagagctttggttattaaataacccccatcattcagctactatttttcatcttaaatatcttctgaatttatctgcttctctctcttcctacttccattgtgtgcccagagactggtatctctgtgctgtgtgatgccagtagctgggttggttcaagctattgtcttttcatgcttggactattatgacagccttttgactccccccttcctattctttccccataatgcattctccctatggatgtcagattgtatcgtgtcactccccttcataaaacccttgtgtggcccccagtgccttcacattcaagtcctgaccccttggcctgacatttgaagcctttcacagacactgtatcttacctctgggcctttggaaaggctgcttccaaacctgaaatgccttctcacacccccatccaccgtgcttctggcaaataccttcctgtgtacccctccagacccagcccgagtgttagcctctttctttttatttttttgagatggagtcttgctctgtcatccaggctggagtgcagtgacacgatctcagcttactgcaacctctgcctcctgggttcaagcaattctcctgccacagcctcccgggtagctgggattacaggcgtgtaccaccatgcccagataatttttgtatttttagtagagatggggtttggccccgttggccaggctggtcttgaactcctgacctcaagtgacccacccaccttggtcccccaaagtgctaggattacaggcttgagccacggtgccctgccgaccattagcctcttctgaaagccttccaggccctctcaggccacattctccaggttattgatgtgagagacagtaaggggtagaaccctcacaagcccaaactgtcgttgcagtgaccattcttcagtgcatgaagacagacagcatccagaaccgaacggcccgtgccctggggaacttagccatggaacctgagagctgtggggacatccactgtgctggtaagaggctgtgaggttggggtctgctagggcttggggcagaagaaaggcttgagtgtctgtccttgttcaccctctgtgctcccctttcctgccctcaggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtgagtccctgcctcagggcttgggagggtgagcagtgcagtgatgtggggtttgtgtctgtcttggtcctcttcactacctccacccctattctgtctgaataagacttttataacccagactcctgattcccacacgaccacctgccagttcctatttaacacactccactcccctgagtctacctttttttttttcgagacagagtctcactctgtcacctaggctggaatgcagtggtgccatctccactcactgcaacctctacctccttggttcaagcagttctcctgcctcagcctcccgagtagctgggattacaggtgccggccaccactcccagctaatttttgtatttttaatagagacaaggtttcaccatgttggccagcctggtctcgaactcctgacctcaggtgatccacccgcctcagcctcctaaagtcctgggattacaggcatgagccactgcactggctggatctaccttttaaccttggttccacgccagcacctttgaactttgggccccagacaagttcactgggaggtgggatatacgctggttaagatggtgggctctggagtccaagttcttactctcttaccatcactcatgagctgaagcatcacaggaaagctgaggaactctttatttttttttaaacattagcgttggggatctcgctttgttgcccaggctggtcttgaactcttggcttccagtgaccctcctggctcagcctcccaaagtgtagggattacagatgtgagccaccatgcccagcccccagcgcttcctatttcctttttattttctccatgacccctgtactctacactagccccacactaacataactcatggtactcttacttcttgtctgcttcttctcactggaacataaactccagggggacaggcactttgttcagtgcttctacccagcacctaaagaacggcttggcacgtgacaggcatcagtaattactgaatgaggttttagtcgtatccccctctcacttccgtttctcccctttctccgccctccttctctcccctggctttacctccctccaagacagcttttagctcatgcagtggctcacgcctgtaatcctagcaccttgggaggccaaggcaggaggatcgcttgagcacaggagtccgagaccagcctgggcaacatagcgagacccatctctacaaaacatttaaaaaattagctgagtgtggtgcacacagctgtagtgccagctacttgggaggctgaggtgggaggatcacttgagctcaggagttcaaggctgcagtgagctaggatcccacaactgcattccagcctgggctatagagggataccacatttctttaaaaaaaaaaaaaaaaaaaaaaaagacgcctcacgcctcttggactctgccccttaaccttggctctgggttcagtctccttccctttctgccctccgcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggtgagttcccatacccacccgtctccttgcccccatgtgagtccccatcctcccccatggcttccatgggcccagaacctcaccttcccactcacctgtcctccccagcccgtcctccagacaacctgtcaccagagtggggtggggagcagggcgttccagtccctccatgggcccacaggcagagttctgctgtgtcctctgccctagccctgggacccagataccctaactctagatgcagccccgcgcccaggatctgggctggtctgtgcttctttcctggctctgccattggttcagcactgtcctgactgctccccaccagcacgctgacctgtgaaccccagcctcaccatcacccccagcactgccagggactgccctgtctgctgtgccctgaccacaggctgcttcatggcgttactgctagaccaaggagcccttctgctggccctgtccgggcataacagaaggctcgcactcttgtcttctggtcacacctcactatgtcccctcagctcctatctctgtatggcctggtttttcccaggttatgattatagagcgaggattattacaatattgggataaagagtaattactacaaactaatgattaatgatattcatatatctctaagatctatatctggtataactattcttgttttatattgtattatactggaacagctcgtgtcctccgtctcttgcctcggcgcctgggtggcttgccgcccacacttcaggggcccagacttacaccctgactgtcccaccttctgtccttgtcctggacctcaggttcccagcgtcccgagcccagcactgtctcttcagtgccctgatttctcacccagaggtttcaccctccttcatctcacgggcccagagccctgtctcactcaccccacctgtcttagaccccagttcccagcctgacaagctttccactcacaggggagaggctactgcagaacctgacggttcaggctgagtcgccctttggggttggggccctgacgcacctgctgctctctgggagccctgaggaccgagtggcctgcgcgctgaccctgcccttcatctgccggtgagtgggaagtgggtgccttgcggggttgggggaggagtgctgtgtttcccaggcccgttgcccaccttttgaaaggccctctcttccctgtaggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggat

SEQ ID NO: 577 - DNA, 42513 bp, Homo sapiens
agtacgcagtcgcggtacaccggctcacggtcgccctgggagccgctcgccagcgccgctgccccagctagcaggaccaaccgcgccgccaggccggccatcctttctccctggctcgccgccgggggaggagcttaggagtatgaagcttccacttccggagtaaccggaagttcctgtgttctttattctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgaggtagggctgtttactgtcaccacccctgtcggattttacttcctaaacgtacctgtaactatccacttctctccatctcttctggcaccaccctggttaaagacaccatcatgtgtcgccaagacagccgcagtagcttcttaatggctctccctgcctctacttttgcctcttccaacctgcgctccattttgaaaaattaaaatttgcccatatcactttttttttcttaaaattatttactggctcccaattaccttgggtaaaatacagtctccacaaaccctgcctgatttggcccctgtccactggtctccctcactcccttgctccagacccgcttcagagggctatgtccctcaagcttcctgactgcctggcctggtctgaatcactcactcttcttttttcttctagtcgcaattgaagtaccacctcccgagggtgattgcttccccatgcggggtagaacctttgctgtcctgttcaccactctacctccagcacagaatttggcttatggtaggcgctaactgcgtttgtttgttcttctgtttaatgaatgaacagcatacatcaacataagaacttgacaaatccagggctgtaaaatcatcagtatggttctgcactgagatcggagagaagtaatatttctaggaaaattaggaaccctgggaacaggacgcttgctttagtatcctctccctgctcacctcccctgcactcccatcagcaccgacccacacccaatctcatagaagccttgtagctaaggatcaccctttctcctcccccactctcctcaccccttgtcaacttttctttttcgtcctgggggttggaatgagtaagaagtagcctgggattccattcactcacttaacaaacatttctgagtccttagctctagcaccttgctaagcaaggcaaaatctccaggaggcaccattcacattgcattttctgtgaatggtgctctggggagcagcattcacattgccttttctgtgaatggcaaattcttccagttaaatataacatgaatagtgtcccctggagttgaccacccaactgatactgactgagaagctgaaatgaacaaaacaaccccttagccctccaggagctgaccggaaatccagtgctaatactactttgcatcttacagattagttcttttacaatactgtttttttttcttttttcatttcattttgtcctttctgtgactctgggatgagtctttttatgaggatcctcatataaagatggacatttaggattaaagaggatgaaatcctgacaaaatagggagtctcccctttagaaaattcctaagtaaggctgggggtggtggctcacgcctgtaatcccagcactttgggaggccgaggcggacggatcacctgaggttaggagtttgagaccagcctgaccaacatggagaaaccccatctctactaaaaatacaaaattagttgggtgtggtggtgcatgcctgtaatcccagctactcaggaggctgaggcaggagaatcgcttgaacccagggaggcagaggttgtggtgagccaagattgcgccatcgcactccagcctgggcaacaagagcgaaactcaaaaaaaaaaaaaaaaagaaaaagaaaattccaattttgaaggcctcatcctatattatgtcaaacatactgaaatgcagtaacgccccacattaaataagatttataaataactatacatatatataattcaatctaattgctgttaatagttgacatattgctacatttatatacatttagttaaaaaaaattttttttcccagacagcctctcactctttcacctagactgaagtgcagtggcatgatcacgactcactgcaacctcaacctcccagactcaagtgatccttccatctcagcctcctgagtagctgggactgcagcatgcgccactatgccctgctaatttttttaattttttgtagagacacggtcttgctatgttgcctagactggtctccaattcctgggctcgagtgatcctcccgcctcaacctcccaaagtgctgggattacgggcgtgagccatgccacacggccataaaatattaattttcgcagctttcttatattttagaactaacaatggaaatttgttcgggtctaaagtatttcagaggtccttgaaaacccatgcctacatacctgatggaaaaagcaatcctaggttaatggtggaagtgggagtagagacttctgttctgttgacttcttggaagatggggtactgtctctctgggacagctcttgagaatttccctgccagcacagccccagataacaatctctagatggcgattacctggcctctcttcccaactttctagcctggagcccctagttctcccctgagcctccttagcttgtccttcttcctaacttgtatttggcttcagatgtgatccacagtctgaaaagtcactaattcattccttcaactcaggcttattgagtcctcctgtgtatcagccattgtactcatgggggaaaaaaaagacaaagcatatgttaatagtagagtgtgctggacaggcacagtggctcatgcctgtaatcccagcactttgggagggcgaggcaggtggatcatctgaggtcaggagttcgagaccagcctgacctaacatggagaaactcctgagatcgtgccattgcactccagcctgggcaacaagagcaaaactccgtttcaaaaaaaaaaaaaaaagtatagtgtgctaaaggctcaacggcaagctgaccatgttcttagatcaaaattggtagagagtctacaatgtgggttccttattcatcaaatgtttattaagtttaccatgtgcaagtctctgggaacagagtgatgaacaaggcactgtacttttcatggtcagaggagggaaacaggccataaacaagtgtcaaacaaaagactgaagccaggtgcggtggctcacatctgtaatcccagcactgtgggaggccaaggcaggcggatcatgagatcaggagatcgagaccatcctagccaacatggtgaaaccccatctctactaaaaatacaaaaaaattagctgggcatggtggcacgtgcctgtaatcccagctactccggaagctgaggcaggagaattgcttgaaccagggagttggaggttgcagtgagcctggattatgccactgcactccagcctggtgacagagcgagactccatctacattaaaaaaaaaaatatatatatatatatatacacacacacacacacacacacacacataccctctaacccaggaatttcactcctaggtatacctacataagctccagtatacctaaacaagtgcaaatttgtttaagtacagttatttgtggtagcattagtcattgttttcaatagcaagaagaaaaaggaaacaactaaatgtccatcaatagggaatgaattatattaatggagggagagccatacaatggaaggctgaacagaaattaataggaatggggcagatttgtaatgtactagcatggtaaaaccttcatgatagatatagatatagatatagatatagatatagatatatatacatatacatatacatatacatatacatatatatatatatatatatatatctcttgtgtctcagcctcccgagtagctgggattacaggtgtgtgccaccacatccggctaatttttgtattttttagtagagacagggcttcaccatgttggtaaggctgtcttgaactcccgacctcaggtgatccacctgtctcagcctcccaaagtgctgggattataggcatgagccatcacacctggccaaatatttttgataagtatcaagtgcacagtgcagaacaaaatatgtgtgtgtgtatgcatgtgtatgtacacctatacacttatatacagtaccccatgtgaagaaaaataagggtacgtgttatgcgcgtagtattatggttgttatttttgagaatatatctagaaagataaaaaagaaagtggaaatagttcttgcctctggtgggaagtgggactatgtgcctgatcaatagggaagtaaggaacactttttttttttttttttaaacggagtttttgctcttgttacccaggttggagtgcaatggcgcgatcttagctcactgcaacctctgcctcccaggttcaagcgattctgctgcctcagcctcctgagtagctgggattataggcatgcgcctccacgcctggctaattttgtatttttagtaaagatggggtttctccatgttggtcaggctggtcttgaactccccacctcaggtgatccgtccgcctcagcctcccaaagtgctaggattacaggcgtgagccaccgtgcctggccaggaacgctttttatttttgtacctttaaaagtgtgtaccgtctgtgtatataatcagttaaaaacaaagaaaagctgagtgtggtggctcatgcctgtaatcccagcccttaaggaggccgaggccggcggcagatcacctgaggtcaggagttcaagaccggcctgaccaaaacggtgaaaactcatctctacaaaaacataaaaattagccaggcatgatggcaagtgcctgtaatcccagctggttgggaggctgaggtgggagacttgcttgaacctaggaggcagagattgcagtgagccaagactgtaccactgcactccagcctgggcaacagagcaagtctctgtctcaaaacaaaaacaaaaacacaaagaaaaaatgtaaaacaatttcatgcagtagcaagcatcgagttaaatacagttgacccttgaacaacacaggtttgaattgcacgggtccatttatactcacatttcttccacctctgccacccccaaaatagcaagaccaaccccatctcttttcctttctcttccccctcctcagcctactcaatgtgaagatgatgaggatgaaaacctttgtgatgatccacttccacttaatgaatggtaaatatgttttttcttacttatgattttcttagtagcattttcttttctctagcttcctttattgtaaaaatacagtatataacacatatcacatacaaaatgtgtgtaaatggactgtttgctattgataagtattctggtaaacagtagactattagttttttttgttttgtgacaaggtctccctctgtcgcccagcctggaatgccgtggtgtgatcatggctcactgcagccaaaaacttctgggctaaagcaatcctctactaaaaatacaaaaattagccaggcatggtggtgcgcttctgtaatcccagctactcaggaggctgaggcaggagaattgcttgaacccgggaggcagaggttgcagtgagctgagattgcaccgttgcattccagcctggacaacagagcgagactccatctcgaaaataaaataataataataataataataataataataataataatagggctgggtgtggtggctcatgcctgtaatcccagcactttgggaggccaaggtggacagatcacctgaggtcaggagtctcaattaaaaaataaataggccgggcacagtggctcatgcccataatcccagcactttgggaggccgaggtgggcagatcacctgaggtcaggagtttgagaccagcctggccaacacggagaaacgctgcctctatcaaaaatacaaaaattagctggatgtggtggtgcatgctataatcccagtaataccagctactcggaaggctgaggcaggagaatcactcgaatccgggacacggaggttgcagtgagccgacatcatgccactgcgctccagcctgggtgacagtgagactctgtctcagaaaaaaaaaaaaaaaaaaaaaaaaaaaaaaaaaatatatatatatatatatatatatatatatatatatatatatgtgtgtatatatatatatatacacatatatatgtgtatatatatatacacacacacatatatatgtgtatatataaaataaaataaataataataaaacatttactttggctgctgttgctgcggggagaattgcagggtgtcaaaagtagcactggtggaggggtagtgatcaaagtctggtgctttagcccaaaggagaaatgatagagactcagactagctggtgatggaggtagaataagcataaatgtatcaaaaagaggagttgatagatcttaaagaatgattggatttgaagggcaaaggaagagaagaatcaaccaggtgggttcagtgaatgaaaccatcagaaacgaattgtcccctgaaatcaagactttgtgattgccatagttgtatgcttctcaaaggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgaggtgagtcgcaggacagaagagtgctttttgtttcagcagagcagcctggggagagataaaagctactcctggggcctgggcctgcattcctgagatgtgggtaagaggggcccagggtcagagtgtctggcaagcttggctctgcccctttgctgtcctggagactagggctaatcctgggctcagggagtggcctccccatggttaggatacaagtgctcatcaagggccacccctaggaaggaccaattttcctatcagaagcttctaagttatcctcctttggcccaaagggacacctcaagcctactctgaggaactctttccaatgaactaattcctacagtcacttccccagcaacctgtgcctcagcctcaaggcactgtggggtaggcctcagtttgtggcctggacatcggactgtggaccagacgactcctcccgatttctgtttgttttcagtcctctgaccccaagctggctggtgaagtaggtagagggaggagactttggtgcatgcatacacacacacacacacacacacacacacacacacacacacacacacacacacacgtctcctgtgccccccagtctccatggctggtcaatgattgactggcatttcacaggccgctggttgcagccccagcctgttgacttagaggtcaccctcggaagctagagccctgtcctgcctcttcagtgtcagtggtcactccactgcccacaggctggggtcttgggcaaaacacacgcatctgccctgatctgagtttgctgccctctgtcccgcagtcagccccactctgttcccactccctctccccagccccctagctagacccctctcaccagcacccctttcccttccctgagggtccccctcgctgtctttgtccctcagacatcctctttcctgggctctcctgccaggccctgctggagggacagttaaggaggaaatcgaatcagcagcgcccacccctgccccccttcctctcctcttgtcagacaccagacgaggttttttcctctggcttcccagctctgaatgggctcattctttttcagaggctcggcccctctcgagcctcctccccagggcgtgagttctgaccccagctcctccccccatccccactccagccccctctccagcttgctccaccctctctaccgcccaccgggactgggcattgtctgccagtccgggtttcttcctgggatttgggatgcagagaggatgggtttgcttgggcgggggggtggagagtgaaggggggaagcaggatctttgtagagggagggacctacagttacctggacttctttcctctgtctcccctcttggtacccttgactggggctcttgagggtaatgggtgaagccaaatctgccatggctcagttcccagctcagctctgtgaccttgggaaagttcctttagctcgtggaatctcaaggctcaaggttcctcttctgcaaaatggggaatgataacacctgcctcctctggagtcttggggactcagtgttctgaggaacgtggctgtaggtcagagtggcacagagtagggtccaatgaagcatggcgtccacagtagctttcctgactggactaacctttccggacacaacagcagggcaggggtggggcctggggagaaaggacacctctaaccctgatcctaacatcccgatggcctctaaggctgcctgcacactcatccaggtgcaagccctccaaggtgtggtgtgatgaaccagtgactcctggagccaggtcagcgcatcctcttcccgcagggctgtaagctgcaggactgagaggcaggttgaccaggtcctgggctggatgatggggtgagagtaaggggtcagttttgatacatgcccaacttttctctctagccctaagacatcctgggcaaattgcttacctcagttcccctgatcctcaccctaaccctaacaccagctcaagagaaaatagggatattgatggccatccagaagggctgctgtgttccatacacagcaatatttctcgaatgtttgtgacagcggtccaaggaataagttaattttacattatcactctggatacctgtacaaaactccaccttatccttactatatgaatgtgctagggttgtttttttgttttgttttttttttttttttttgagacagagtttcgctcttgttgcccaggctggagtacaatggcgcgatcttggctcaccgcaacctccgcttcccaggttcaagcgattcacctgcctcagccttcccgagtagctgggattacaggcatgcgccaccatgcccggctaattttgtgtttttagtagagacagggtttctccatgttggtcaggctggtaccaaactcccgacctcaggtgatccacctgccttggcctcccaaagtgctgcaattacaggcatgagccaccgcacccagccgtgctagggtctttttctgttcaattcctttctctctcttgctctctttctttctttcaatggagtcttactctgtcacccaggctggagtgcagtggcaagatctcagctcactgcaacctctgccctctgagttcaagcaattctcctgcctcagcctcccgagtagctgggattacaggtgcctgccaccacacctagttaatttttgtacttttagtagagatggggttttgtcatgttggccaggctggtctcgaactcctgacctcgtgatctgcctgtcttggcctcccaaagtgctgggattacaggcatgagccgccatactcggccaactttgtattactttcttaaagagagtttcccaaattatataagcttcaggccccacaaaacctagatctgccccagtataactaaatctgggaccatttattgagcaattattatgtgccaagtattgcgctgagtgcttccagagcattatctcctttaaccccagcatagtatgtcagatgctgttttacagatgagccaactgagaccagagatgctcagtcacttgcccaaggtgacatgactgatatggaatagagtcaagatttttttttttttttttgacacggagtctcactctgtctcccaggctggagtgcagaggcgcaatctcagctcactgcaagctctgcctcccaggttcacgccattctcctgcctcagcctcctgagtagctgggactacaggcacccgccaccacacctggctaattttttgtatttttagcagagacagggtttcaccgtgttagccaggatggtctcgatctcctgacctcgtgatctgcctgcctcggcctcccaaagtgctggaattacaggtgtgagccaccgcgactggccagattcaagatttgaacccaggtcctcttggtcccagaggcccctgtttctcaactccctaggatggcatagcaacctgtcccacaagaggtgcctgctttaagtgtgctcagcacatggaagcaagtttagaaatgcaagtgtatacctgtaaagaggtgtgggagatgggggggagggaagagagaaagagatgctggtgtccttcattctccagtccctgataggtgcctttgatcccttcttgaccagtatagctgcattcttggctggggcattccaactagaactgccaaatttagcacataaaaataaggaggcccagttaaatttgaatttcagataaacaatgaataatttgttagtataaatatgtcccatgcaatatcttgttgaaattaaaaaaaaaaaaaaaagtcttccttccatccccacccctaccactaggcctaaggaatagggtcaggggctccaaatagaatgtggttgagaagtggaattaagcaggctaatagaaggcaaggggcaaagaagaaaccttgaatgcattgggtgctgggtgcctccttaaataagcaagaagggtgcattttgaagaattgagatagaagtctttttgggctgggtgcagttgctcgtggttgtaattccagcactttgggaggctgaggcgggaggatcacctgaggttgggagttcaagaccagcctcaccaacgtggagaaaccctgtctttactaaaaatacaaaaaattagctggtcatggtggcacatgcctgtaatcccagctgctcgggaggctgaggcaggagaatcacttgaaccagggaggcagaggttgtggtgagcagagatcgcgccattgctctccagcctgggcaacaagagcaaaagttcgtttaaaaaaaaaaaaaagtcctttcgatgtgactgtctcctcccaaatttgtagaccctcttaagatcatgcttttcagatacttcaaagattccagaagatatgccccgggggtcctggaagccacaaggtaaacacaacacatccccctccttgactatcaattttactagaggatgtggtgggaaaaccattatttgatattaaaacaaataggcttgggatggagtaggatgcaagctccccaggaaagtttaagataaaacctgagacttaaaagggtgttaagagtggcagcctagggaatttatcccggactccgggggagggggcagagtcaccagcctctgcatttagggattctccgaggaaaagtgtgagaacggctgcaggcaacccaggcgtcccggcgctaggagggacgcacccaggcctgcgcgaagagagggagaaagtgaagctgggagttgccactcccagacttgttggaatgcagttggagggggcgagctgggagcgcgcttgctcccaatcacaggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaaggtgggtctggtgtggggaggggacggagcagcggcgggaccctgccctgtggatgccccgccgaggtcccgcggccggcggggccagaggggcccggacgagctctcctatcccgaagttgtggacagtcgagacgctcagggcagccgggccctggggccctcgggcgggagggggcagttacacggcagcggctcgagatggcccatccaagagactggcgctttccaggctccgaggggctccgggaacttgtcaaagaagttctctgaaattgttcagaaagttttcccgcaaagggtgtattgcgtagagcgcgcgcgcgcgtttccccccttcttgagccccctcaagctttctcaaagcctttccagttggcagcctccgcctccggactggcctgggctggattccttgggggggtcctctgccctgcccctcctccagcccctccccgctccccttcagacgattttggtttggttgctcctgcttctggcggggtcgggtgtgtgtgtgtgtggtggagtggagggtggcatagcaacctgtcccaaccagagccggggaggaaagggtggcccggagggtggcctcttgctggggtctgggttgggggcgggggagacgtttgctttgaacagattcttggggccagcttagggactgtgctctgtgacttttggagcgcgtggaccatggaggggtgggggtgggtttcttggggtgtaaagtgggagagttcccagagaaggaagctaagaaataaggccagatgggagcctagggagggctgcgttgttctgctgccttttccttggtgctgtgcgtggggaagggtgagtgggggcagtgtgtatcctgacccatctgtccacctgtgtgcattaatcataaaagctaacatatagcctgggccaggtatactctgccaggaactgtttgtggtgttttgcatgcattctcctttaatcctagaacacccctatagtggaagttctgccagcattctggactgagtagcagtccagaggttgagtagcagctagtaagtggtggggtcaagatgggaccccaggcagtgcgacccccaaccatgcattcgaaatcgctatatggatgagtgcacctggagcaatgagggacactgctccctgagtcactgggctgcaggggagacaaaatgaaagtgttctgggagtcgtgggtggtctccataggtcagagggtctggggagggagtgggtgtcatcgtggctgtgtgttgcccgaggggccctctgtgagtgagtgcatggccgtgttatctctgcaggtctacgccagggtgttcctcagttgtgtggtctttgtatttgtgtgtctgggctttgtgttgccaaacagcagtctctctgctgacttggggacacaggctgaactctgtcctctgcaggaactcccttaaggtgctgggccagatctgccataaacagagggaggtagccttctatggccacgccttcttgctgaggaagaaggttcctctcttccagggagtacatccttgccctccctgtttcccagacaagcatcttcacctctcatcttctgatgagaagggtgaggccatactgagctgtcaggctgagctgctgcccttcctcaccttgggctgggagttgatcagggaatggcagttgctgcagagctggatttgagggctgggttctctggatggggcctcctcatgtcctcacccctcaacctgcactattgattgtgttgtgcaggagttagttaaaaagtcattgcacagcctgggcaacaaggcaaaactctgtacaaaaaatacaaaaattagttggatgtgattacacgtgcctgtagtcccagctactccggaggctgaggcaggaggatcacctgagcccaggaagttgaggcttgcagtgagctgtgattgcaaatgctctccagcctgggtgacagtgtgagactccgtttcagaaaaaaagtataccacccagctgcctccagcacccagattttacccaaggggtgaggtctggggcaggaatgtgggggaaggggaggcctagggggagccccagaggggtcaggatttttctgaaatcctttcttagaggtatgggttttacaaattgcagcaaatacatccttttaatcttgcagaactccttcatattttaattccagtatgattcttccaacagcctcctctctttactatacttggggaaagtactcattttatttgtcaagaaaaaaacaattgaaaagatagggatcaaatgtaaaaagaaaaaatacgtggcattccaaagtcaaacacaaagcatgtttaattttctcgtggtttgggattacccatattcctgctgtatgaacctgtcttgtcttaacttttaagaaatgtacggtgtacttcctatatgctaggtttttatccatgctttcatttaatctctgtgacagtcctgtgaagtaggtgcacagatgagaaaatggaagttcagagaaatgaagcaacttatccaaggctcccagctacccagtaatgtccagggaatttttggactctgaagaggaggcattaagaggtggttagagtcttattccagccaacaataatgggttgaacaaagccttaggggcaggcaggtggccagatgggaggagaagcgctcctcttgttcaggcgaatgacctttccatccacttctctaggctgtagaaagtggagctgagctgggggccctgaggttccctcttgacttcagagtcctctcccttcctgtccagccaatgcctgtcttccttttgggccctaccagcatgacagggggctgcgggcaggaggggacagaggccacgttgacacacagggctgtgggtgagagagacagctgaagtgtcagcgtgaggggccagtgtggggctgcggctgggagggctggggtggggcccagggtagttgtgcctgtccttgggtgatggaatgatctggaaagagattccttccctgccctccacctgtgagaagcccctctagagtgacatctccatcttatgtttggccacccatcctccccctgggaagagagccgaggtggggtaagggatgtgtactctttcaaggagtgggagaattattctagcgaatgtttgtgttgtcccagttctgtttacaaagcctcgtcatgtttacagatggctgcgcaattcattacctcatttaactctcatgtacctcctctgagggagtaagagctgttacagccaagtttaggtcagtaaatattcaccaagttgcaggtactgcagggcatagagatgaatccgatttagcttctgccctggaggtctgggaacttgctcaagatcactcagtgagcagctgagctagggttctcaactaaagaccctgggcccaggccctggtctgatgtcaggcctgatacaccaggtgtttgtggtcggggaatcccagtgtcacttgaatgggctgtgacattatgggtctgggagagctgagctttggggacacaggtcattttactgtagtattcatggaaaccaagggaagtattggcttttctgctgtgagcaagaggagcagctggggctgcaagctggtggggaggagagaacccacctgagagaaacctcaggactggggtcaagtcctgaccaccagagtccagagagacatgaaggactgtgaccagctctgagcagagagatggattccatgacctcaactggtcccttttgttcggagactcgtgactggacttcattcatccactcattcattcattcactcagcagacacttatctagcgctccctgtggctggtcctgcctcatactgtctttgctctggagaattggaggttggggttcctgaggggcagggtcctggagacaaggacactcctgggtagaattaggacctaccccccaggaaatcaacggggaccaggtgccgtggctcacacctgtaatcccagcactttgggaggccgagacgggcggatcacaaggtcagcagttcaggaccagcctggccaacatggtgaaacccgcctcaactaaaaatacaaaaattagccaggtgtggtgtcaggcacccgtaatcccagctactgaggaggctgaggcaggagaattgcttgaacccgggaggcagaggttgcagtgagccgagattgcgccactgcactccagcctggcgacagggcgagactccatctcaaaaaaagaaaaccaatgggacagggcagatatggggacaatggtaaggagatgggagagtgggagggaggtgtcaggaagaccttcttgacttcatgtaggctggtgggggtgttagccagcaagcctccagttccctgggaaccgttctcagggtaccaattttaccacctgtctgcaaacactttaagattcttaatcagactcaaattggccacaaatcaggtaaacaaactcactagtggggtggggctaccacccgttctgaccctccagcccaacccagcccagccaccctgccctccgtagagcctgtggtgtttatcggtggcattgggagaattagtgtgtatttatgttggcgtggggtgtggggtggatttgtgtgtgtgcagttaggcctagtggaaggaatgtgggatctgaaggcaggccagcctgagttccagtcctgcctgttgctcacaagctttatgaggcgagagctaacccctgccagcctcagttgtcttctttgcaagatggaggttgcagccccagtctctggagcatgttatgcagatccaccgagagtgcctgccaggcacacagtaggtgctcagctcagttactgtggcggcccccactccccattgttgttgttttcctattgcctggcggccacagctggtatcccttgaaaagggctacagggggtggagtcggaccctgccccagccctgtggagaccctgggcttgggccagggcctggggtctgggcctgcagacagctgtgtctataaagcagctgaagggctgaggccgggggaggtcctggcagcagggcgttattttgggcctggcctgccacccccagctcctgtttctcttgggagtctgttgggggaggaagtgtggggaagaggagggggtgcaagtgggtgaggcatggagtggggaggcctccctcagggacatggacccttgagttctatttctgttcctccctcctgttcctccctctttgtccttatctgcctagagaggtgggaatagaggccattctgagtatcactaggagaccaccagtttgtggccactggccactggcccaggcagggaacctgggggcttgccctaccagcctctcccagcaatctgaaggcagggggtacctcgtattaccccctaggatttgaccttaggctccaacttgctgggagagcagtgcctctggtgtcagaccccaagccagcccttgtgctgtccctgaatctgcatgtagcctgtgggaggcggagcagtgaccggcaggaattctgggcagctcaggcacctgtgggcctgagggtgccctctgcccccacccttccgatctcctgggcaagacacgccaggtgattcatctcaccagagcagaaaaacaagttcaactgggcactttaatctcccctcactggcaggcctggtgtgagctgctaccccggcgcccctcaccaggggtgctttacctcctctagtattcctgaccttagtgggcatttctggtctcagggataccaggctggggtccaagtgggccaggtgtggcagttcagccctatgccccatggctgatggctcgcgctgggcaggtatgcagggctgacgtagtgcctttgtggcagcagtttcgtggcacacattctgccagctggttctggagtcttgccctgaggaggtggccagggtgagggtgccagcgcaggaacctttggcgcatgcttcaccctggcctgggatctgcagcctgggtccagatgcccacaactggaatctgacgctccttttctcttcatgggggactcccagaggtctctgcaatgaccagagccccggttgtcccatgcctcagctgcaactccagctgaccctccttccccactctctgggtggcattacgggggtgtggatcccttgccaagaggttggcatgtgggtgtgctggaatggcatagggagaatgcaccgagtttgtttgcttgggagaggggcagggggtatccagaagattcatgattcgtcatcgcctctcttgggggatttttacccctttgccctgagttgtgcctttgggacaaaggaagcctttctttgccagccaacaccctgtactggcgggcgagctccccagggctggcacgctggggcagcctctgaatgcacagggtgggcctagtcagaagaagcctttcccctgaaatccctctacttcccaagcacgcaagctttctcctgctgttaaacctgcagtgtgcaagggacatgggcggaggggtccttcagtcaggcttctccctgtctgaggtggcatgacttggagtgagtttggatggggtggccaggtctgagaaggtcccccgccagtgtcctctgacccatctgctctctcctgccagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggtgaggcccgtgggcaacccagccaggccctgcctccagctgggctgagccctctgtttacaggtgggtggcagaagaaggtgccctgcccttctgtttcctctcttgttgtggtttctcaaccaggaagtcctttctaacatctaacccccattcattttactgcagaatcagttgactctctctataacgtggctggccgaggtcatgtctggatgggatgcgtctgtgtttccgctaaatcttgtgctctcttgccagcatgatcatgtcccctgtccacctgctccagccactatccctctcccacttacagcagaagaaagggctggtgagaaaggtggattacaggcccacttctgccactgacgagccctatgaatgtggcctacacccccttagcttcactgggtctcagtttccctatctgtatattgggagcagttgtgaagctcagaagagaaatgtctgtgaaaaggttatgaacaggagggagagtggaaaccaacctgctggatcgtgtccacagaccctggaatggggccacatgcttggtttgtcaaattgcagacgccggccgggtgcgatggctcatgcctgtaatcccagcactttgggaggccgaggcggacagatcacttgaggtcgggagttcgagaccagcctgaccaacatggagaaaccccgtctctactgaaaatacaaaattagccaggcatggtggcacatgcctataatcccagctacttgggaaggctgaggcaggagaatcacttgaacctgggagacggaggttgtggtgagcctagatcgtgccattgtactccagcctgggcaacaagagtgaaactccgtctcaaaaaaaaaaaatttgcagacgccatcccatccaggcctttgctttcactgatgaagaaactgagatacagagagggcagggcacctgttcggagtttatgaaatgcccccccaccattatctttcttgatcatataagaatctggtgaggcaaggtagggcgtgatctttatctctattttatcgttttatttaagcgggaacaggactgctcagtggctgggggccttgcccaagatctccaagtactggggaaccccagggaggccctggggggtggcagtgttcctatttcagccccactctgcttccccctcccaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacaggtggccttcaccgtcattgaaaccttctcttggttattcagagctgaccagggccactgctaaccagggggaggctttgtgtgcattagaaatggtgtcccttctgggcagacgcaggcagagcccgggaagacgccctcagaagattggaaaaagattccccttcttcctgggaagttgtagcttgcgtcagcacatataattcaatcgtgagaatgcaggctgggtttttgcccccacttggctgagtgaagtgtacagtgaacaacctatgtaactatttgctggccctggagccgactctgccccagagtctgggtgccaggtgctttgcccgcatggcccatttcagtcacgctgcagtcctgtcaggaaaaaatcagtgttattctcattctacatatgagaaaactgaggcttgcagatataagggccaaaagttacacagctagtgagtgatggggctgagtttcagactccacagtctcttaaccaccaagcagcatgcccagagtagaggtgagaaggaaggagagagctgcggtccacatgagcatctggacctagcatggacaactcactcctccctggctctcgctttgttcttgttgcgggtgtggtggtggtgggactcaaagacggtaaagatagctttctctcctccctggggaatctgggggttgtttaaaaggcctgctcctcttttagaaggcaggagggccccaagggaagcagaaggtgacagaaggggaaagggtcctctgatcattgctcaccccacagagatcttgaaaggaggggtcttgatccagcggaacccccagctctgctaccaggacacgattttgtggaaggacatcttccacaagaacaaccagctggctctcacactgatagacaccaaccgctctcgggcctgtaagccatgcccctccctgctgcctcttctctcagacagcctgaccccagccgcaaactcccaacttacaacccagtgcctgcccgccactgccccagccgcctacaccacccatttcctccctctctgtccctcctgccatctccctgtgcctcttcatctctggggttctctgtcttgtctccctctgcttataggttgtgcctctggtttgggggcctctcagcctgtctgggtccctcccttgctgtgcagttggcctcgtggcctctgctgctgtttgtgcctctctctgttactaacccgtcctctcgctgttagacatctctctcactgcctgtctctggttctgtcctcaggccacccctgttctccgatgtgtaagggctcccgctgctggggagagagttctgaggattgtcagagccgtgagtctcagggaggcctggagtcagggaaggggagggctggggccgggtggaatgcaggtgtcatacaggtgacatgggaggggtgggataacaggcttgggatgtctcccctgggccaggtagtctccctagaaggtgatgctgatgagggtctggtgcccagggcgccactcagccctcatcctgccctttgcccaacagtgacgcgcactgtctgtgccggtggctgtgcccgctgcaaggggccactgcccactgactgctgccatgagcagtgtgctgccggctgcacgggccccaagcactctgactgcctggtatgtgcctctgctttgtgcccaatgtgctctaccccccaggatgcaaggggtgggcaccctgcctggtactgccctattgcccctggcacaccagggcaaaacagcacagtgaaagccagccacctgtccccccaggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctgtgagtgccagggagaaacacagttttctcattttggtggggaggtttgtttctgtaaatgggagcatatggggagcactgtctgcatcttgctttgagagctggtcatgacagttcctgccgagctgccttgttctttcaacagctgtggagcaggtggcagtaaggagaggcagctaagagcccagacttgggagccagactgcctgggtttgaaacccagctctatcaattagtaggcacgtgaccctcttgctgtgcctcagtttcctcatcagtaaaatgggggcaagaatagtcccaactgcataagatggttataacatttgaaagagttaatatttgtaaagctcttagaacggtgcctggtatgtactaagtgctcctaaatgttagcttttattctatagcctggtgaggtcagttttacctttcgttttgtttttgagaccgaatttagttagctctatcgcagtggcgcgatctcggctcactgcaacctccgcctcccaggttcgtgctattctcgtgtctcagcctcctgagtagctgggattacaggcgcccaccaccatgcctcgctaaattttgtatttttagtagagacagggtttcaccacgttggccagactggtctcgaactcctgacttcaggcgatccacctgcctcggcctctgaaagtgctgggattacaggcgtgagccactgcacccggacttttttttttttggcagagtctcgctccattgcccaggctggagtgcagtggtgcaattttggctcactgcaacctctgccttccgcattcaagcaattcttgtgcctcagactcttgagtaggtggaactacaggcatgcaccaccatggctgggtaatttttgtatttttagtagagacggagtttcactatgttggccaagctggtctcgaactcctgacctcaagtgatccacccgccttggtctcccaaagtgctgggattacaggcatgagccatcgtgcctggcctagctcagttttatttaacagatcacctatttactgatgggcgtttatggactgggctcagacctggggaacctctttcctcctctcacaggaacaggagtgggccttcagatcctggctgactgtgttagggagaggacaaaatgtagagccagaccatttgggttcaaatcctcgctcctccactcactagcacaatgaccttgaataatttacagaactctctgctttggtctccctttttgcaaaatgggaatctcacagtgctgatcccgtctggttgttgtgaggggtaaatggatgtcaggtgctgatgcgtggtagggcatttaagtattggttgatattattcttcttgtgcctgggcacggtaatgctgctcatggtggtgcacgaagggccagggtatgtggctacatgttcctgatctccttagacaactacctttctacggacgtgggatcctgcaccctcgtctgccccctgcacaaccaagaggtgacagcagaggatggaacacagcggtgtgagaagtgcagcaagccctgtgcccgaggtacccactcactgcccccgaggccagctgcagttcctgtccctctgcgcatgcagcctggcccagcccaccctgtcctatccttcctcagaccctcttgggacctagtctctgccttctactctctacccctggcccccctcagccctacaagtgtccctatatcccctgtcagtgtggggaggggcccggaccctgatgctcatgtggctgttgacctgtcccggtatgaaggctgagacggccccttccccacccacccccacctcctcagtgtgctatggtctgggcatggagcacttgcgagaggtgagggcagttaccagtgccaatatccaggagtttgctggctgcaagaagatctttgggagcctggcatttctgccggagagctttgatgggtaagagtgggcacgatgacctgagacagtgtcagggcagacagagtcctgaggatccagatgtggcagcatctcttggggatggcaggagacagaagtggggggatcaagaatgcaaagaaagcagatgggagaccagaggagcagggcctttggtgggtgggggtgattatttttgtaaatgacatgctatccgtgaacaaggacttgtatggaggtcagaccatctagataaagtaaaattccctttgagttcatagcagctttattcaaaatatccccaaattggaaataactcaaatgtgcatcactaggtgaaggaataaacaagtggcagtgtatccatttggtgaagttctacttagcaaccaaaggaaatgaactaccgatacaacataaatgaatctcagaaacattacattgagcaaaagaagccagagacaagattccatactgtctgatcccctttatgtgaggctctgaaccgaaaaaaccactctgtggtgggagagatcagaacggtggttgccccagggtggggggcttcaaaagggaggcacacaaggacatttctggggtaatagaaatgctctgtatagtgattggggtagtggatacatgagcgaatccatttgtcaaaactcatcaaactgtgtgataagagtctgtgcattttatttatttcattttattttttgagatagagtctcactctgtcagcaggctggagtgcagtggtacgatcttggctcactgcaacctctgcctcctggattcaagcaattctcctgcctcagtctcctgagtagctgggactacaggtgtgtgccaccatgcccagctaatttttgtatttttaatagagatggggtttcaccatgttggcaaggatggtctcgatctcttgacgtcgtgatccgcccacctcagcctcccaaagtgctgggattacaggcatgagccaccacacccggtgcattttattgtatataagttatacttcaataagaaatgaattggggccaggcacggtggctcacgcctgtaatcccagcactttgggaggccgaggcaggcagatcacttgaggtcaggagttcaagaccagcctggccaacatggtgaaaccccatctctactaaaaaatataaaaaattagccaggcttcctggcatgcgcctatcatcccagctacttgggaggctgaggcaggagaattgcatgaactcgggaggtggaggttgtagtgagctgagatttcgctattgcactccagcctgggcgacagagtgagaccctgtctcaaaaagaaaaaaaaaaaaaagggtcaggcgccgtggtgcacacctgtaatcccagcactttgggaggctgaagcaggaagattgcttgagcccaggaattcaagaacagcgtgggcaacatagtgagatcccatctctacaaaaaaacacaaaaaattagccgggcatggtggtacgcacctgtagtctcagctactagggagactgaggtgggagaatcacctgagcctgggaggtggaggttgcagtgggttgaaatcatgtcactgtactccagcctgggtgacagaatgagaccctgtctcaaaaaaaaaaaaaaaaaaaaaattccctttcacacttcctttacctccactcccctttccagagggggccatggttaacagtgtgtgtgttcacctagaccgtttatgcatctgtagacacacacacagtgaagtgtggttttcgtcgttttggtggggaggttggtttctgtaaatgggaacatatagggagcactgtctgcaccttgctttgagagccggtcatgacagttcccattgaactgccttgttctttcaatagctgcagagcaggtggcggcaaggagaggcagctaagagcccagacttgggagccagactgcctgggtttgaaacccggctctaccacttactaggcatgtgacccttgtgctgtgcctcagtttcttcatctgtaaagtgggggcaagaacagtcccaacttcataagatggttataccaccatgcctggccagatgattataaagtttgaatgagttaatatttgtaaagctcttagaacagtgcctggcagatactaggtgctcctaaatgttggtttttattatgtggctgggtggctcggggttttatttaacagctcccctatttactaatagacatttagatcatgttccattttcactcttacaaacagttccactttgtgtgtggctctgggaacatgggccagtgtctccctaggccacattcctagaaataagatttcttttcttttttttttttttttgagacagagtctcgctttatcgccaggctggtgtgcagtagtgtgatctcggctcactgcaacctctgcctcccgggttcaagtgattctcctgcctcagcctctcgagtaactgggactataggcgcgcggcaccacacccagctaatttttgtatttgtagtagagatggggtttcaccatgttggccaggatggtctccatctcttgacttcgtgatccgcccgcctcggcctcccaaagtgctgggattacaggcgtgagccactgagcccaggcagaaataagatttctagatcaaaggatataaatactgttttgatagatgttgccgaactaaggcctgggctttgaagcccaggatgggaacagctgggctcgatgggcaaagggtttgagtgaaggcattcatggtggggagtggctggcatggccagtgctgggagtgatgtccaccctgttcctggccctgctgactcctctcctgacccctccagggacccagcctccaacactgccccgctccagccagagcagctccaagtgtttgagactctggaagagatcacaggtgggctctgtctctgcatcctgttctgcaggggctgggagtccttgtcctgtccccactcctttaatctcaccctctgcctgcaggttacctatacatctcagcatggccggacagcctgcctgacctcagcgtcttccagaacctgcaagtaatccggggacgaattctgcacaagtgagcactgagaaagagggggcctgatggggaggagtcccagggaggagtccctgtgggaagctttgggcctgagggagtactcctgtagcagtaacctttccatgaaagtctgcagagtgtgctggggatggaggaagatgagaatagcctttgctgaccgggaaggggtccgtggtaaggtgcccacctttctcccatagtggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtggtaagacagggagcccagtgtgcgcactccccatctgccagcacacagcagtgcccagggggccctggcagcagcgttcttggacttgtgcagactgcccgtctctgtgcacccttcttgactcagcacagctctggctggcttggcctcttggcatggcttctctagctgggtcctacctgccttggcatccttccctccccctctgtttctgaaatctcagaactcttcctctccctacatcggccccacctgtccccacccctccagcccacagccatgcccacagccagttccctggttcacttggacctggggcctcccctaaaagtcccctgcggtcccttcctcctcactgcagtgggcgagggcctggcctgccaccagctgtgcgcccgagggcactgctggggtccagggcccacccagtgtgtcaactgcagccagttccttcggggccaggagtgcgtggaggaatgccgagtactgcaggggtatgaggggcggaggagagggtggctggaggggtgcatggggctcctctcagaccccctcaccactgtcccttctctcaggctccccagggagtatgtgaatgccaggcactgtttgccgtgccaccctgagtgtcagccccagaatggctcagtgacctgttttggaccggtgagctgctggcgggctcagagctgggtggaggggggcagcgagggggattgccagggacttggcaggatggcgagatgcagtagggtgtgctatctggtaaaatatccctggagagggctcagcgctcagacctgaacagcaacagagtggcagaaaaggggcctgggggacactggggcccttcagactatgaaaaggttctaaggaggtctgtgttggtggctgtgactgtggctgtgctagggtggtgagccctgtgggctcaggcgtcagactacctggattcagacccagctcctgcttccaaccttggttttttattcctaaaatgggtattgtaataatacctaccttgctggggtgtggcaagaatgaaattaaacagggcttggcacagtgaagcacgggaaaggctttctacagagcagtgactgttgttactcgctgttacaccttaggtaatgcgttttcctctctgggtgcctcccattttctggctcaagtccctgcccaggatcaagcttggaggagggccccgagggaggggccacagagactgggtgaagagcaagggtgtttgtcccaggagcatggcgaaaattgctgctgggtggccttgggaagcacaaaggggacccaactaagggcctgatcctactgccctgggggtgtcagtgccagccccccacaaatcttttctgccccccccaggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcgtgagtccaacggtcttttctgcagaaaggaggactttcctttcaggggtctttctggggctcttactataaaaggggaccaactctccctttgtcatatcttgtttctgatgacaaaaataacacattgttaaaattgtaaaattaaaacatgaaatataaattaatgccctagcagttctatccccactgttaataatttgaaatatttttcctctagttatttttgtctgtgcacattctaatatgtatatataagttaacatatattaatattattctccagttatttttatctgtgcacattttaacacacacacacacacacacacacacacacatatgtatttttagacggagtttcactctgtcgcccaggctggagtgcagtagtacaatcttggctcactgcagcctccacctcctgggtttaagcaattctcctgcttccgcctcctgagtagctgggattacgggaacgtgctaccttgcctggctaatttttgtatttttagtacataggatttcaccatgttggccaggctggtctcgaacccctgacctcaggtgatctgccagcctcggtcccccaaagtgttgggattacagcggtgagccaccatgcccagtcatatatttctttttaacaaatagaatcatagatcatacatattgtttgcaaattgctttttctcactttccagaaccttgaaatgtttttccatgttctaacatggtgatctaccttattcttttaatttttcttatttagttgtctttacacatgaaacacatgaatacatccttgtgataaacattttcagtaacataaaagtataaatgttacaaagccaacgtgccctttcactcaactccctgtccacccagtctctcctgtctgctgggagaaccaccgcattgacttgtgtgttcacccttccaggctcttttctgcacacttatatagacatactacatttatattaggtcgagtcaaataagattgctgtttgtgtaaaccaaaaagtgtcaagagcctgggcgcagtgactcacacctgtaatcccagcactttgggaggctgaggcaggcagatcacttgagatcaggagttcgagaccaatctggccaacatagcgagaccccgtctctactaaaaatacaaaaactagccaggtgtggtgatgctgttctgcactttgctttccccccgacttgaggtatcctttcttgtgagtacagacggatctaccacctttattttttttttaattactcaacctgtaacatggatgtaatttcactttgtttttgagggatattgagcttgtttccctgtttttgcagtttattgcaattgagctccacacacaagtgagccctcttttgtatgccccctagtgggaatacagtgctggcaatgtttatcacaaggatatattcatgcatttcaatttaaagacaactaaatgagaaaaattaaaagaatatggatccaggctgggcatggtggctcacgcctgtaatcccagcactttgggaggccgaggcaggcagatcacctgaggtcaggagttcaagaccagcctggccaacatggcaaaaccccgtctctactaaaaatacaaaaattagccaggcgtggtggtgggcgcctgtaatcccagctatttgagaggttgagacaggagaattgcttgaacctgggcagcggaggttgcagtgagacgagattgcaccagtgcactccaacctgggcaacacagtgcaactccttctcaagaaaaaaaagaaaaaaaaaaagaatatgggtccagatccatatggatcctagatccagatcacggtgttagaacatggaaaaacattgcaagattctgctaagtgaaaaaagcatttgcaaacagtatgtacagtctatattcagaggaggaactgctgggtcatagatgatatttcataggtattgccaaaccgttctctggagaagtggtatgggtttaccctgggattcttctatggagggaatagttgagctcccgggcttgctcttctgggtgcccctccccgcttcctatccaccacaaggagctgcaggggagcggggcatgccggttccttggctggagaaggagtctccttgtgaggtggtagaaggagcactgacggccttgagcccagtttctgcctttgtcaaatggggataatgacccagccacacccctcccagggttgttgtgaggctggaaaggtggttcccaagagggtggttcccagaattgttgatgagactgtttctcctgcagctgtgtggacctggatgacaagggctgccccgccgagcagagagccaggttggcctggaccccaggatgtacccttcattgcccttcactcccccactggatgctgggtggtcactgctgtagggaggggaccccctgacatatgtcccttcccacccactcttccactgtggaacctcctgtcattttccacttcaccaagtgacagaggacctgctcagatgctgaggggaggggactgcaaggaaagatggctaggaaacccagtccctccacaccctagagtaacttgatgccttgtgagggacacaggcaaagttcaattccttggaagtcaagggagactgagaagagtacagctgcagcactgagggagtgatgaattcttaactggggatggtgggaggcttcgagtgggaggtggcatttgagctaggctttgagagaggagcaggtattgcacttgcatttaggtagaaagcattggggtgcaaggtgacactggagggggaggcatcaggaaatccaggatgtcttcaaagttctggtgtcgggggctgttgagtaagcacaggaataagggggtcaagttagagtcagggtggggtctgacctggatgccataggacctgatccccaagccacagggtgggacttgactgggcagtggggacctttggaaaggactttggggagaaaaacagactggagtctgtcttaggcgatcatcggtccgtgaaatgagcatgtgttacaggcttggtatgtaccagaccctgtgctaagcaagggggtatggagaggagagggtgacaagaatattggatcaacacccgggagctccatctatcccaggatgcactatcttttttttatttttttgagacggagtctcactctgcctgcaggctggagtgcagtggctccatctcggttcactgcaacctctgcctcctgggttcaagcgcttcttgtgcctcagcctcccaagtagctgggattacaggcacatgccaccacacccagctaatttttgtatttttagtagagacggggtttcaccatgttggccaggatggtctcgatctcttgacctcaagatccgcccaccttggcctcccaaagtgctgggattacagacatgagccaccgtgcccagccagatacgctatctttttattgagtgattgagacagggtcttgctctcttgtccagtcttgaatgtggtggtgtaatcacaggctcactgcagccttgacctcctgggctcaagttacccttctgcagtagctgggactataggagcgtgccaccacgcctgggtaatttaaaaaattttttttgtatagacagggtctcactatgttgcccgagctggtctcaaactcgtgggctcaagtgatcctccagttttggcctcccaaaatgttgggatcacaggagtgagccaccactcctggcgatgagccaagtcttttttttttttttttttttttgatatggagtcttgctctgttgcccaggctggagtgcaatgacacgatcttggctcactgcaacctctgcctcccaggttcaagcagttcaagcaatcctcctgtctcagccccccagtagctgggattacaggcatgcgctaccacgtccggctaatttttgtatttttagtagagatgaggttttgccatgttggccaggctggtcttgaactgctgacctcaggtgatccacctgcctcggcctcccaaagtgctgggattacaggtgtgagccatcgtgcctggcggagccgagtcttaaaagatgaccctgtggagaaatggtggtccaggctgaagggacagcctatgcaaacactgggaggtgtggaaaatcatgacctgtgggtggaaattttggctagaacatcaaaatcatcaggtgtacattcctgtacccatgcagcagtcagaatctctgggggtggggccccaaaattgtatgcatacagactgtgtgctgatttgtgatattacttaggattttttgactttacaatggtggaaaagcaataatatacattcagtataaaccgtactttgaatacccatacagccattctgtttttcacttttatttttatttatttatttatttattatttattttgagatgtcattttgctgttgttacccaggctggagtgcaatggcgcagtcttggctcaccgcaacctccacctctcaggttcaaacgattctcctgcttcagcctccagagtggctgggattacaggcaggcaccaccacacccggctaattttgtatttttagtagagacggggtttctccatgttagtcaggctggtctcgaactcgagagctcaggtgatctgcccatctcagcctcaagccaccatgcccagccctactttcagtattcaataaattacatagccaggcaccgtggctcacacctgtaatcccagcactttaggaggccaaggtgggaggatcctttgaggccagaagctcgagaccagcctgggcaacatagtgagaccccatttctacaaaaaataaaaaaactagctgagtgtggtggcgtgtgtctgtagtcccagctacttgggcagctgaggtggaaagactgcttgagcccagaggtcagggctgcagtgggccatgatctcaccactgcactcagcctgggcaacacagcaaggccctgtctcaaaaataaataaataaataacacaaacttatttaacagtttactataaaataggctttgtgtcagatgattctgcccaactgtaagctgctggcagtgtaaatgttctgagcacgtgtaagccaggctaggtgtcttaaatgcattttcagtttcaacttagaattggtttatcaggacgtagccccttggtgttgaggggcatgtgtattaacagtctccttagtgacttttttttttttgagatggagtcttgcactggccgtagtgcagtggcacaatctcagctcactgcaacctcttgtctcccgggttcaagcgattctcctgcctcagtctcccaagtagctgggattacaggcacccacaccacgcccagctaatttttgtgtgtgtgtatttttagtagagacgggggtttcactatgttggccaggctggtctcgaactcctgaccttgtgatctgcccacctcagactctcaaagtgctaggattccaggcatgagccaccgcgcccagagtccttagtgatttttacaccatgaattgttgaagccctaagccagagccaagggcaagagtatagagaatctggagatgcggagagggttctgattgcctacaaggagtttggactttattgtggaggcagcggggagccaaggcaggttttagagtaggagagggtccaagcctgtgggtcacccttccgacttccctttccgaatgccaaacaccttcatgtcccccgtgggccccctttgtccctcccaccccaaactagccctcaatccctgaccctggcttccgcccccagccctctgacgtccatcatctctgcggtggttggcattctgctggtcgtggtcttgggggtggtctttgggatcctcatcaagcgacggcagcagaagatccggaagtacacgatgcggagactgctgcaggaaacggaggtgaggcggggtgaagtcctcccagcccgcgtggggtctgcaccggcccccggcactgacccaccaccccctcaccccagctggtggagccgctgacacctagcggagcgatgcccaaccaggcgcagatgcggatcctgaaagagacggagctgaggaaggtgaaggtgcttggatctggcgcttttggcacagtctacaaggtcagggccaggtcctggggtgggcggccccagaggatgggggcggtgcctggaggggtgtggtcggcagttctgatgggaggggcaagagctggaggcagtgtttgggggagggcagttacagcggagaagggagcggggccaagccctagggtggtgaaggatgtttggaggacaagtaatgatctcctggaaggcaggtaggatccagcccacgctcttctcactcatatcctcctctttctgcccagggcatctggatccctgatggggagaatgtgaaaattccagtggccatcaaagtgttgagggaaaacacatcccccaaagccaacaaagaaatcttagacgtaagcccctccaccctctcctgctaggaggacaggaaggaccccatggctgcaggtctgggctctggtctctcttcattggggtttggggagatatgactcccgcaaacctagactatttttttggagacggagtcttgctctgtcacccaggctggagtgcagtggcgttatctcggctcactgcaacctccacctcctggactcaagcgattttcatgcctcaggctcctgagtagctgggattacaagcgcccgctaattttttttttttttttgagacagagtctcgctctgtcacccaggctagagtgaaatggtgcggtctcagctcagcctcccaggttaaagcgattcttctccctcagtctcctgagtagctgggattacaggcgcgagccaccacgcccggctaatttttgtatttttagtagagatgggatttcaccatgttggccaggttggtgtcaaactcctgacctcatgatccgcccgcctcggcctcccaaagtgctgggattacaggtgtgagccaccgtgcccggcctaatctttgtatttttagtagagacagggtttcaccatgttgtccaggctggtactttgagccttcacaggctgtgggccatggctgtggtttgtgatggttgggaggctgtgtggtgtttgggggtgtgtggtctcccataccctctcagcgtacccttgtccccaggaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggtatgcacctgggctctttgcaggtctctccggagcaaacccctatgtccacaaggggctaggatggggactcttgctgggcatgtggccaggcccaggccctcccagaaggtctacatgggtgcttcccattccaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggttaggtgaaggaccaaggagcagaggaggctgggtggagtggtgtctagcccatgggagaactctgagtggccacctccccacaacacacagttggaggacttcctcttctgccctcccaggtgcccatcaagtggatggcgctggagtccattctccgccggcggttcacccaccagagtgatgtgtggagttatggtgtgtgatggggggtgttgggaggggtgggtgaggagccatggctggagggaggatgagagctgggatggggagaattacggggccacctcagcatgtgaagggagggaaggggctgcctgtgccccaccttgcagggtctgtgcacttcccaggattagggaaagaccgggtagggtctgtctcctggcatcacatctccccctgctacctgccatgatgctagactcctgagcagaacctctggctcagtacactaaagctccctctggccctcccactcctgaccctgtctctgccttaggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgtgcgtggctgagctgtgctggctgcctggaggagggtgggaggtcctgggtggaggagcccacaaggggcatgaaaggggaccaggatgtatgtagacccaggagccctagtatgttaggagcctcaaaaccttcttgtatcccttttacagtcaaagtccaaagccactcttgaggaacactcttgtacaaaattaagctgggcacagtggctcatgcctgtaatcccagtacttttggaggctgaggtgggaggatcccttgaagccaggagttcaagaccagcctgggcaacatagtgagatcctatctctacaaaaaataaaaaaattatctgggtgtggtggtgtgtgccagtagtcccagctactcaggagaggctgaggcaggaagatcacttgagcctagtttaaggttgcagtaagctatgattgcaccactgaaatccagcctgggtgacagagcgaaacctcatctcaaaaaaataaaaaagcaaacaaaaagaaaaaaaaaattaaaagggaaactagaagagatgccaaaggttctggctgaagaccccagagtctggtgctacttctctaccacctgagggctttgggctgtcccttgggactgtctagaccagactggagggggagtgggaggggagaggcagcaagcacacagggcctgggactagcatgctgacctccctcctgccccaggttggatgattgactctgaatgtcggccaagattccgggagttggtgtctgaattctcccgcatggccagggacccccagcgctttgtggtcatccaggtactgggcctctgtgccccatccctgcctgtggctaagagcaccctcctgcagagggtgggaaggagagatgagtccagtatgccaggcccctcacggaaggctgcatgctgggctggggaggggccaccatcctgcctctccttcctccacagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccagggtcagtgccctcggtcacactgtgtggctgtctgcttacctcccccaaccccggtggactagggtccctttctctgatgttccctcaactgtcacctctcaaggaaaccccattatccctacaaaaaattcttactgccttccaacccctgtgaccccattctctccacggtgactgtgtcataccccaaaggtgacctctgtttttctcctgtgaccctgtcaccttccatggagtccccatcccagatccgtgagtgacccccatcatgactttctttcttgtccccagagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctggtatggagtccagtctaagcagagagactgatgggcaggggaggtgggaccttcagcccagggtccactgtgggggcagagggagtggcagagacaccggggttccttcccctaatgggtcaccttctcttgacctttcagaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagctaggcaccggcctatgtctgggggtggctctgtgccatcccttcctgctcaccttacactcaattcctcttttcctggagggagtggctgggaatcttcagaaagcttggatgaggagccagacatccagttctccagcttcagggttgggggagatcgggaagctggattcagatctgagagccctttgacgaccagatcattcttatttagaacgaactaattcctaaggccactcaccagaatggggttatttcctccttgtgagtgaggagagtggtgggtagggtgggggaaagacgaggcagggtctactgtgggactcattttccttgccttggctatgccagaggagctcactgacctaaggagtagctgtccagaaagcccacccagccagcacagccaccctggcggtgcaaaggctgggctgaccggacttctgtgccccccacattcccagactggacgtataaaaacacacactagttagcattagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttctccattactggctcttcggatggcctcaatgagctagaggagtggaatgacaggatgatgcactgttggggtagggtgaccaagaggtcctcccaacgctgtaaatactcacatctttctcatagggaaagcccccattctccagcttggagaacaccagctgtccatttatctctatctcaaaggcacctggtaagaaatcaacagataaatggtacactgagaacataggcagaagtcaggagttcctccaaaggggtcccccgccttcaagtcccccatcaatcccactggagacccatttgtagctccttaagcaattccccaaccctgggtcaactccagggaacctgagggaggcctcgcctgtgtgcccctcgcaacactcaataaaggactccctcccctccaaccctacacgattgcagtctaataggtttttccccacaggcctctgtgacaccccctgacctatggaagggaactcatgttggccggacattttaccatgtgccaggcactgcgggcactttacataaagcagccaatgtcagaactagaaagcgggagagctgggattcagagcacagactgacccagcaggtgttctgcgagcctcacctgtgcccccgaggcgcgactcgatctcgatgcccggatactgctccttcacagcactggccagctccaggtaggtcgcctcgaagccgcagggttcactggggagtcaagagatggggctgggctggggattcgggggtggggcctcccgtggacccacctccgtccggcccgcgggaccagggtgcgggtcctccagccggggccgctcaccagtactccaccacgatgcg

SEQ ID NO: 578 - DNA, 47527 bp, Homo sapiens
ctgcggtgcacacggcgcctcgccccgcctcaccggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggtgagtcctgtctgtgggtctccggcgccaggcaaccgtagagggctcgcgcccgccgcccgcgcgtaaggaggctccctcgtcgggccctgtccggcccggccttctgggggctgtggggccgtccagccgggttttccctgcgttcggcgccggcctgcagactcgggcccgcggagcccccgccgccccttcttgcccctgcccgcgtcccttcgggccgaccgtgaccgtggcgccgccgcgacccgcaagcagcccggggaggctgccctgccgcgctgtcacgccgtcaggttgcgttcctggggagggctggagaggctccatctcgtgcctttcaccttctcgcgcggcgggcacggaggcgacggttttcgggacgccctgctgcggccgcgacgccctcccgaggccggagcgagggccccggggcggctccagcccttcttcgcccctcccgtttgccccgaaccattgctaggagcctgtgttttctgcacttttctgatttcattcttacgagagtcaagtacagaggcgggaggggaaagggaaggggaacaacattctttcgagaattataaaccttgagctccgttaaataagtagcagcagagcattgtcactggagcagtggtagtcgcgggtaggaccgtttcggtttttagccaataggctggttaaaggtacttaaaacagtaagttggaaggtgctgaaattctaaggtaaatacgtgacctttcaaaaccaaagcagtgagacgggctaggctgggctgctccccgctgcgcgtgcctgggtcggggggtgcggaggggcagggggcggaggcctcggacgggacggggtgggagggaagtggcatccgcatcgtcttacatcgcgctgtaagacccgattttctcttttcggaggatcccatctcccttctcagactcttcatcctacctgcactgtggatcccttgacacttcagaggctctgaactctcaggccggtcacactttttcatcattttgtttcttgtcttttaaacctgcatgcatttcaaacgtagagcaaacattaaactttttttttaaactgaagatagtggtgcaagactttgttattgaaatgcaaaccaaaagttatcttgaatatttatcgcgctggaaaagcaggtttaattagagtgaggtggggacgtatatttcttcttccggagacacagccttcccactcaccaccccaatccctcctctctgtcaactagggttacagcagccttacactggctagtcttttctgaattctgaattcacttctgggggccaaggtaaagaatttatcgtattttatcctcattttccttttctgttttttttgagacagagtctccctcgttgaccaggctacaagtacagtggcccgatctctgctcactgcagcctgcacctctagggttaaagggattttacagcctcagcctcccgagtagctgggatcacaggcgcctgccaccatgcctggctaatttttatattcttagtagagagagagtttcaccatgttggccaggctggtcttgaactcctgacctcaagtgatccgcttgcctcggtctctgaaagtactgggattacaggtgtgggcaccgcgcctggccttttaaagtgtattattattatttttaaatttatttatttatttattttttgagacagagtcttgctctgtctcccaggctggagtgcagtggcaagatctcggctcactgcaagctccacgtcctgggttcacgccattctcctgcctcagcctccctagtagttgggactacaggcgcccaccaccacgcccggctaattttttgtatttttagtaaagacgggttttcaccgtgttagccaggatggtctcgatctcctgacctcgtgatccacctgcctcagcctcccaaagtgctgggattacaggcgtgagccactgtgcccggcctaaagtttatttttaacttatgtatatatatatataatttttgaggccgagttttgctcttgttgcccaggctggagtgcaatggcgctatcgtggctcactgcaacctccgcctcccaggtttaaacgattctcctgtctcagcctcccaagtaaactgggattacaggcgcccgccgccacgcccagctaatttttgtatttttagtagagactcgaactcctgacctcaggtaacccccccccgcctcggcctcccaaagtgctgggattacagacgtgagccaccgtacctagcccgttttactttttaaatgattaaagtaacattcaggttgtttaaaacatttaaacatgacagaagaatatcaagtaaaattcagacagcgcagaggtatgtcaagttagaattccttgtttgttcactctttacatcctcaattccattccctaggagggtattatattataatattgctcggcaactgatgataatataaggacacatttccttcataagcacgtggagacctacctcatttcctcccaaccccacccctcactttggagaccgggtctcactgtgttgcccaggctggagtgcagtggttccctcacggcttgctgcagccttgggctcaaacgatcctcccacctcagcctcctgagaagctgagactataggcgagtgccaccatgcctaatttttgtaatttttgtagagacgggtttctcatattgcccaggctggtcttgaattcctgaactcaagccatccacctgcctcagcctctcaaagtgctgggattacaggtgtgagccatcctgcccagccaacttgcctcattttcagaatgttgcatggtataccgttgtttggatgtaccctaatatacattttttggttccttattgatggacattttgactgtttctgggttttagccattaaaagctttgctttatgaaaatctttttgtcgttctagggtaagtttcaagtagataatataaacagatgattgtactttgatataattttatttcacaaggaatctttttaaacttaaagttgtttttttttttttttttttgagatggagtctcactctgtcgcccaggctggagtgcagtggtgcgatctcggctcactgcaagctccacctcccgggttcacaccattctcctgcctcagcctcccgagaagctgggactacaggcaccctccaccacgcccagctaattttttgtgtttttagtagagacggggtttcatcgttttagccaggatggtctcaatctcctgacctcgtgatccgctggcctcggcttcccaaagtgcagggattacaggtgtgagccaccacgcctgatgttataacttaaaagattttataatttaaaagcagtagctaaatctatttgaattaaatgcatttctaagattccatatattcttttattattttttgagacggagttttgctcttgttgcccaagctggagtgcaatggcgtgatcttggctcactgcaacctccatctcccaggttcaagcaattctcctgcctcagcctcctgagtagctgggattacagacatgcgccaccacctcggctaattttgtattcttagtagagacgggcttttgtcaggctggtcttgaactcccgatctcaggggatccacccacctaggcctcccaaagtcttgggtttacaggcatgagccactgtgcctggctctatatattcttttatatttagaggctggaacagaaaattttgaagactgtattaaataatagaggatttattactcttcttaccacgaagtggtgttgaccttaaggttatattgcctcatttaattgggttggcagaagtgataagagaggtccttcagattagagggggctctgctgcccaggccggagtgcagtggtgagatcttggctcactgcaacctccacctcctgggtttaagtgattctcctgcctcagcctcccgagtagctgggactacaggtgcgtgccaccacgcccagctgattttttgtatttttattagagatggggtttcaacgtgttagccaggattgtcttgttctcctgacctcatgatctgcccaccttggcctcccaaagtgctgggattacaggagtaagccaccgcacccagctgcttgttcttttttaaaagtaatttcttcctgggcgcggtggctcacgcctgtattcccagcactttgggaggccaaggcgggtggatcacgaggtcaggagttcaagaccagcctggccaagatggtgaaaccctgtctctactaaaaatacaaaaaagtagccgggcctggtgatgggcccctgtaatcccagctacttgggaggtgggggcagataactgcttgaatccaggaggcgggagttacagtgagccaagatcgtgccactgcactccagcctgggcgacagagcgagactccatctcccaaaaaaaaatagtaataatttctttcattgcaaattttatctcaggtacaaaaaagcatataaaacatgtataatttaaagaatactattgcaatgatcattttgtatccactaccagattaagaaacaaaatgtttggccagccgcagtggctcaacacctgtaatgccagcatcttgggaggctgagacaggcagatcactgaagactgggcgttggagaccagcctggccaacatgtgaaaccctgtctctaccaaaaatataaaaattagccggtcgtggtggtgggcacctgtaatctccgctacttgggaggctgaggcaggagaattgcttgaacctgggaggtggaggttgcagtgagctcagatcacgccactgcactccatcctgggtgacagagagagactctgtcttgggggtggtggcggtgggggaacaaaatgtttgcatttttttcttccagaggtagcctctgtcctgatttgtttgtgtttatctttctcttgcttttttattttatttatttttattttattttattttatttatttatttatttttatttttattttttttttttttggtgacggagtttcactcctgttgcccaggctggagtgcaatggcacgatcttggctcactgcaacctctgcctcccgggtccaagcgattctcctgcctcagcctcctgaataggtgggattacaggcatccaccaccacgcccagcttggttttgtatttttagtagagacagggtttcaccaggctggtgtcgaactcctgacctcaggtaatccacccaccttggcctcccaaagtgctgggattacaagtgttagccattgcacctggcctcttcagtttttcttgtaggtctcagtttcatcgggtatcattcctttcagcttgaagaattccctttagcatttctttcttagcgcaggtttggtgatgaattatctcaatttttgtttacctggaagtaccattattttactcttattaaaaaaaagaaaactggctgggaatggtggtgcacacctgtaatctcagcattttgggaggctgaggcaggcagatcgcttgagttcaggagtttaagaccagcttggacaactgggtgaaaccctgtctctcttaaaaaaaacaacaacaaccccctcccctgccccccaaaaaacacagctttgttgagatacagtatatatactgtaacattcacctgttttaagtgtacagtcgaatgatttttagtatttacggagctgtgcagtcattgccacaatctagttttagaatcttgtagccttttgcagtcactttgtatctttcttctccccatccctagacagccactaatccgctttatgtctatagatttgcctattctggatgtttcttgtaaatggaatcacacaatatatggtcttctgtcttttacttagtcagttgttgaggttcgttcatgtagcatctatcagtaggaacctctttcctttttgttgctgaatttgtatttcgttgtatggatgtgctatgttttatttatccattcgttgatgtatgtttggttgcttccactccgtggcaattacgaataatgctgctatgaacaagttattgtgaagatatattttcatttctcttgggtagttagataggagtagaattgctgtcaccttcttgtttttttttttttttgagacaaggtctcactgtgtcacctgtcatagctcactgtaacctcgaacttctgggcacaagtgatccttgcatctcagcctcctgagtagctgagactacaagtgcacaccaccatgcttggctatcctcatttttggagaatatttttgctgggtatagaatttgggattgagtttttttttttttttttttttcttccgagacagagtctcacttttttgcccaggctggagtgcagtggtgcgatctcagctcactgcaacctccagctcctgggttcaagtgattcctgtgcctcagcctcctgagtagctgggtctacaggtaagggccaccatgcccagataatttttgtatttttattagagatggggtttctccatgttgcccaggctggtcttgaactcctggcctcaaagcagtctgcccacctcagtctccaaagtgttgggattacaggcatgagccaccacacctggcctgattttttttgtcttaaagcgttattaacagtgtcattcctgtgtcttctagtatcctttgttctggttagaagtgagccatcattcctattgttctgtctctgtatatgttgtattgatttttttccccataagactgtttcaagagtttctctgtatctctggttttcagcagtttgattatgatgttttctttgtatttatcctccttggagtttgctgagctttttggatttataagttaatatttttcaccaaatttgagaaattttcatttattcttttttttttttgagatggagttttgttcttgtttcccaggctgaaatgcaatgaatggtgtgatcttggctcactgcaacctccgcctcccaggttcaagtgatcctcctgcctcagcctcccaagtagctgggattacaggcatgtgccatcacacccagttttgtatttttagtagtgacggggtttcaccatgttggccaggctggtctcgaactcctgacctcaggtgatccacccgcctcagcctcccaaagtgctgggattgcaggtgtgagccaccgtgcccagcccatctattatttttttcaaaatttttttatttcttattctgtcttttcttcttctgggaactttaattacatatattttagaccacttagtattgttcctcaggtctctaaattggataatttcttttgatgtttaagtttactgtccttttcttctactgtatctaatctgcgattaagttcatttagttaattatttatttatttattttttagatggaatcttgctctgttgcctgactggagtgcagtggtgcaatctcggctcactgcaacctccgcctcctgggttcaggcaattctactgccttagcctcctgagtagctaggattacaggtgcctgctaccatgcccagctaagtttttgtatttttagtggagacggggtttcaccatgttggccaggatggtctcgatctcttgacctcgtgatccccccgccttggcctcccaaagtgctgggattacatgtgtgagccatcctgcccggcccatttaatttttaaattcaaacattgtaatttgcagttctagaattttctttctttctttttttttttttttaggggagtctcgctctgttgcccaggctggagtgcagtggtgccatctcggctcactgcaagctctacctcccgggttctcgccattctgcctcagcctcctgagtagctgggactacaggcgcctgccaccatgcctggctaattttttgtatttttagtagagacggggtttcaccatgttagtcaggatggtctcgatctcctgacctcgtgatccgcctgcctcggcctcccaaagtgctgggattacaggcatgagccactgcgcccagcccctagaattttcatttgaatctttttacattttaatttattttttagagacagggtcttgctatgttgcctgggctgggcttgaagtcctggcctcaagcaatcttcctgcctcgaccttctgagtagctgggattacaggtgcaagccatcacattggctcctgattctttttttaaaaaatagtttccttttctctactaagattctccattggttcagttattttgaccatgttttcctgtaagtccttgaatatgatttttataatgggtgctttaaagtctttgtctgctaatttcaatatctgagtcattttgggatttatttctattgactgttctttttcctccttaaaaatagatcacattttcctggttctttgcatgtctagtgatttttttttagtatatattggacgttgtgaataatatgagtcaattttgttatcttcatctgaaaagtattgctttttattgtaacaggcagttaaaatattggctgatcaccttgaaattgtggagacttggttttatattttgttaggatatgtccccaaggtgtttactgatcctccctgacttggtggaatgaaaattccaaaatgtctcccttattttaaagtgtttggggctctctttgtgacttactcctttccgagatgtcccccttcaatttccagctgttatggtggtcctgaactcccatcttctggcatctcaagccaagaagactgtggctttttgctgccactgtggccactttgtgccaaggggactccctgggctgggaatgggagtttaatggggttcctaaggggaacagctgatcccacttactgtgttttctttctttttttttctttgagagggagtctcactctgttgcccaggctggagtgcagtggtgtgatcttggctcaccccaacctctgcctcctgggatcaaatgattctcctatttcggcctcctgagtagctgggattacaggtgcatgctaccatgattggctgattttttttcttttttgagatggagtctttctctgttgcccaggctggagggcagtggctcactgcaagccccgcctcccgggttcatgccattctcctgcctcagcctcccgagtagctgggactacaggcgcctgccatcatgcccagctaattttttttttttgtatttttagtacagacggggtttcaccatgttagccaggatggtctctatctcctgacttcgtgatccgcctgccttggcctcccaaagtgctgggattacaggcgtaagccaccgagcctagccgatttttttttttttttttttttttgagacacagtctcgctttgtctcccaggctagagtgcagtggcacaatcttggcttactgcaaccttcgcctcccgggttcaagcgattctcctgcctcagatttttgtatttttagtagagacgggatttcaccatgttggccaggctggtcatgaactcgtgacctcaaatgatccacccgcctcggcctcctgaagtgctgggattataggcgtgagccaccacgcatctggctgtgttttctttctttcaaggatgaagtttctttcaatttctgcctgtttttcagccctgtccagtgctttcaattttttttttatttctttctagaatttatggtggccttgaaacatttcatgtttacataatatctttgtttttaaaaatagtatgctacactcctatagttatttaggcacatgatttttctccttcttccagttatgtcttactgcgttacagattaatgccaaaaccctgtggcttaaaacagtcattttattatgtttattagattttatgggtcaggaatttggaaggggcatagccaggatgatgtatctctgctccatatatctggtgccttacctgggaaggctcaaacttttgggatggtgctatagctggatagcagttacctaaaagtgtctttactcatgtctggcagttaatactagctgttagctgggacctcaactgtaactgtgggtcagaacacctataaatggtctccttacagcatggtagcccaagcattagtgttccagagaaccaggcagatgctccattgccttctgtgacctgatcttggaagtggcatggagaagttacatagcatcacttcctctactctactggtctactagtctttattgttgacccaaattcaaaggtaggacataaatctacctctcaatggaagaagtgtcaaatattttagatatgtttaatttatttcatttatttatttatttttggacagagtcttgctctgttgcccaggctggagtgcagtggcataatcttgcactgcaatctctgccttccaggttcaagcaattcttgttcctcagcctcccgagtagctgtgattacaggcatgtgccaccacgcccagttaattttttgtatttttagtagagacaaggtttcataatattggccaggctggtctcgaactcctggcctcaagtgatctgcccactttggcctcccaaagtgctggaattacaggcgtgaaccacctcggcacctagctcctagacatggtttaaaaccatagtgctcatttatcaaatagcaagctcccccttgggtcctagcgtagtcctatatacatctcaattaggtacttgttgaagtattgaatttttcttaactatagtagaataggacctaaagtaaagttgtgtgtaaagctttaagaaaggagtaaggtattttacttttagaaaacattttcttaggttgattagtttttgtctttctgtttgtaggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattggtaagtgagaaagactggttggtgacatgtatcccttaccttttgccctggaaattaatgccggttcctttgaactgagaatggctttccagaactatttatttcactgctgttttgtatagatgattatcagagttctagatactattgccaagcagaatatggtaggccctggattcattttgactttgtaaatgtgtacttaatatcttttcttcagttccagtgataatataattattataggcaatagcatttttaacttactgatacaacatatatgtaagtactttaagatccttaaaggctcagaatttgatgtaacccaaaattattgttgtgacttattgaaggtcagacaacagtgacagtactctgcagataatagtaacaaccttaggctccattggaactgaagccctgcagcggctctagggaagaaataccatctctgtttccccagctgcaacatcaggggagcatcagaggaagagatttgtgaaggaaactattgtttaattttctttccatcattttttaactttaattgaaaatgacaggcataaaacaaaagcagagagaatggtataaagattccatcacctcctttatcccatgtgtctatcatccagcttaaaaaaaaaacaccccaaaatcaggacctatcttggtttataattccatcaaccactctctgtccgcacttttttttttttttttaaagagacgaggtcttgctatgttgtacagctactagagtacagttgctatttacagatgtggtcgtagtatactacagcttcaaattcatggtctcaagcaatcttcctgcctcagtctcccaggtagctgggactacaggttcatactaccattcctggctcccacagcattttttggaagcaaatttctttatctgtttacattttaaaaattcatctctttcaatgtacagttctacacctaaagtccaatagaaaaacaaaatgaaatgaagcagagcaagaactaacgataattgtgaagcagtctgctcactgcagtctccgcctctgacttcccaggttcaagcaattcttgtgcctcagcctcccaagtagctaggattagaggcacatgccaccatgcccagctaatttttgtatttatatttgaatgtttttgagacagagtctcgttctttcgtccaggctggagtgcagtggcgtgatctcagctcattgcagcctccacctcctgggtttaagcgattctcctgcttcagcctcccaagtagctgggattacaggtgcctgccaccatgcccagctaatttttgtacttttagtagaaacgaggtttcaccatgttgaccagactggtctcaaactcctgacctcaggtgatttgcgcgtgttggcctcccaaagtgctgggattacagatgtcagcactgcgcccggccttgtatttttagaagagatgaggttttaccatgatgaccaggcttgaactcctgacctcaagtaatccacctgccttggcctcccaaagtgctgggattacaggcgtgagcctctgtacccagcccatttatatgatctgtaggacaaaaggaatgttaaaaagcaggtattgtgctagcaagagttttaatgtttcagtgacttgggctgtgttttaagttttttacaggctggtggataatgattgatgcagctgtggtgtatcctaagccagaacagttgaaccatgcctttcacacatgtggtgtattttccacattggctttcttcatgtaagtatgaagataattctctattcaaggtgatttttctaaaaatactttcctgttaatgtgcagtgctttcttgaataactttttaatttatttgatagactattttttaacatgatacatacataattcccattttattacgattttttttaaccaagaatgagtgttggatttggtcatatatctttttagcacctataacaattatcttgtgatttttttttttcctcatatttttaaatctggtcagttacatattttgtcagttgcaagatctactttttcgcattttaatacctctgaatatcaggatgcatcttacagtcagtggtatcttagaattataattgataacatttttatttcttgtcagtattaaaaattaatggtgtatcttaaaactgatggctctgagatttcatgaaacatgttacgtttctgcatttttttagtagtaaatcacccgtaggtgttgtagtacactcaacttttaccttgcagtattatttttattttttttaatgtgctacttgactgtgtttgccagtgtttgaggaaaaggcaagattggcctcaaaagagatttgtttgtggcttttgtttttattaaattatttttaagtttatgttacctcatttcataaaaaagcttggaagctttttatggatgtcttttaacaattaaaaaatattaaacattaagattacatcatttccttataccatcaggaggtttttttgtttttgagacagagtcttactctgttgtttgggctggaccacactggtgtgatcttggctcactgcaacctctgcctcccgggttcaagtgattcccttgcctcagcctcccaagtagctgggattacaggtgcctgccactacgcccagctaattttttgtatttttagtagagacggggttccaccatgtttgccaggctggtcttgaactcctgacctcgtgatttgcctgctgtggactctcaaagtgctgggattacaggtgtgagccactgcacctggccaggagttttaaaaaggttatattttggaaaatggaactacttatatccattgtggcttctaaaaaaaggaaattcctgttactaattaatgtaccttgctctaacaaaaatggaaggggaagctgaataaagtgggcatattatacataagctacattttctctgagcttaagaaatggatcatagaaaatcacttgacttttaacacaaagagaaactgtttaactcttgataataatgagaaccttgaagtgggatagcactgagtcattcatgtataaatgtgaaatagacaaagaatccagaaaactggtccctcttgtataatctctggagagaagtgatagaaatctcttaaaataaatgtgttttctgggtgtactttatgaaaataagactaatgtaacatttctatcaactagcatttttattaggttaaaaatatgttaaattattcagatactgattttagttatgaaataatctgttttccgtctaagtgttatataaatatttgagtattttaacagcgaatactgaaattcatttgatgattttgtgccgttctaggataaatgctgtatccaatgctcaggtgagaggtgatagctatgaaagcggctgtttaggaagaacaggtaaagatactttgagctgttaatgggtgttgacaaaacagaaatttgtcaccagaaaaaaagcctctcttgtgagtctttattcaagactggtaatgattatatagaatattttttatttgctttaaaacaaagttttagtgttattcaaatccttaagaaagtaagttattgctagaagttactgtttttgtcatgttacactgcccatgatatagataaaaaatgttgctattcaaatggatcttggactccagtgctaatgatggatttattattatcccaattgttgaccaataatgttacttacaagatggctgactatgattattaacaggaaagtaatgaacacattaggggatcaaacctaggactacagtgtctttacattcacttctgatcacctgagtagccacctacagactgcaacaaaattgttcagtagaaagatgctatttgtctacacataaattagtttttatagtttgaattcatttgaattgttatccaatttttgttttttttttttttttttttgagacggagtttagctcttctttcccaggctggagtgcagtggtgggtttttggctcaccacaacctccaccccctgggttcaagcaattctcctgcctcaccctcccgagagctgggatttcaggcatgcgccaccatgcttggctaattttgaagttttagtagagatggggtttctccatgttgatcacgctggtctcgaactcccgacctcaggtgatccacccaccttggcctcccaaagtgctgggattacaggagtgagccaccgagcccggcccaattgtgttttttaaacatttacggccgggcgcagtggctcacgcctgtaatcccagcactttgggaggctgagacgggtggaacacctaaggtcaggagttcgagaccagccctgccaacatggagaaaccccgtctctactaaaaaatatacaaaattagccaggcgtggtgacacacttctgtagtcccagctacttgggaggctgaggcaagagaatcgcttgaacccgggaggcagaggttgcggtgagccgagatcacctcattggactccagcctgggcaacaagagtgaaactccgtctcaaaaaaaaaaaaaaaatttacattataatatgaagaaattaaggtacagtgggcttacataatgtgtccaaagtcacagagcaagtaagtggtggagccaggattgaacatggacagtctggctccagagcccatgcttttagccactatgctgtgcttgtttcccatctagaaccatttggtcactttgtctggtttggtatcacgtgtatattttttctttttgtcagcttaattgaatataatttaagtataataaaattcactaatgtatttattattttattaattttttttgagacggagtctcactctgccacccaggctggagtgcagtggcatgatcttggctcactgcagcctcaacagcctgggctcgagtgatcctcctgcctcagtttctcaagtagctgtgattataggcacatgctgctgtgcccagctaatttatttattttttgtagagacagggttttaccacgttgttcaggctggtcttgatctcctggcctcaagctatccacctggcctcaagctatcagcctcccaaagtgctgggattgcaggcatgagccaccacgcctggccagaatccaccaatttaaagtgtacaatttgatgagcttgatcaaatgtgtacagttacagttgtgtaactaccactacaatcatgatacagaacatttccattgccccaaaaagttccctcatacccctttttatagttaatactcttcccctcacctcgtggccactactgatctactttctatgatggttgctttgccttttctatgatttcatataaatgggatcatatagtaagtatcatagccttttaaaccaaataaagcagctttgaagagcttagctttcttttctacttgatgttttattttttaaattttgtatttattttgtttgagacggagtctcgctctgtcacccagactggagtacagtggtgcgatctcagctcattgcatcctccgcctcccaggctcaagcaattcttctgcctcagcctcctgagtagctgggattacaggtgcctgccaccacgcctggctagtttttgtatttttggtagaaactgggtttcaccatgttggccaggctgttctcaaactcctgacctcaggtgatgcacccgccttggcctcccaaagtgctgggattacaggcatgaaccaccatgcccagccttctacctgatgctttaaatgctgatgtagattttgtaacctcacttctactggaatccatggagaatttgcgagagggtataatgacaaatgacagatgagcctaagtttaaagtgcacaatatgtgtgtgtatgcgcatgcgatcgcgcttacttttcatcatatcctgtatgtcagcctcagcagtaatgtcaggaatgagggaaggtaaagaaaaaatatatattagcaagtgaagatgttgtatgtagagcatacaataatgtactccatcatttttctttcaagaatattccacggacattgctgtgaattatgttactattatctttttttgagacgaggtcttgctctgtctcccaggctagagtgcagtggcatgatcatgacgcagaaaagccttgaactcctgggctcaagcaatcctcccctctcagcctccagagtagctgggattaccggtgtaagccactgtgcctggccactattatctgttttttataggaagtttcactgtaacttatccaaagttttttagcttaaaagtggaacctgtatttgtctttggtctgtctggttcccaagcccgtcgtttttaccctaagtgattattatattttattctatgatattccctattctattaaaattaacagtacagtttatatttttatattgtgcatatagtgcaatttctgtttagtgtttcaaaaattaaggacaaactgtcttatagtcatgcccaggtattgctactcttaagcttttgtactgcttaagtggtttatctgtaaactatctctatttagttcccggaggaattaataggaaagtatcaaaataataaatatactataaatgaaacagctaaataataaaactataaaaaagaacaggaactaggtagaaaaatgatcattgtacttagaacctgggacaagatggatgcttttaattgttcattaaccttaactcagagcttccttgtagccaaagcaaacaagagaaaatgttacagttttatttttttgctaaacaaaagcatacttctttttcttttttttctctttttgttaatatgccctcagacatacttactttacaagagaaatttttttcttgtttaattctattagaaagtttaatgtatatagccataaataaaggacatgatggaaaataattgtaaggatttttttttttttgaaacagttttgctttgttgcgcaggctagagtgtagtggcatgatcttggctcactgcaacctctgcctctcaggttcaagcaattctcttgcctcagcctcttgaatagctgggactacaggcacccgccaccaagcccgactgatttttttttcttttagtagagatagggttttaccatgttgcccaggctggtctcgaactcctgagctcaggcaattagcccaccttggcctcccaaatttctaggattacaggtgtgagctaccatgccccgcctttaaggatttttaatagttccttttattcacgttagataaaagctatgattgaatataatttagagattgtatttctccaaagaactaaacattactgtttatttctggagatctgcttagtattgtaataaaatttagataatatagagacctatttctctcagatatcagctgttctaaccattatgaactttgatcagtgcttcttccttatctggtgtctaaaatgaatcttttccctggtaacaaaatatttgcaactgaggcaaatttagttttctgttatggaaattggctaggattttatttttacttcagtggagctttcttccccttccagaggttgatggggctgtcagtatacctgtgaacaggatctggtgcaagtattaacctgctttcctaaaaatatgttgaatctactcaagtgtccagatgatttacattatcgagatctagaattttgttcaatacagggttgaagagatacttctgatcttgaagttttcatgaatatgtggtacagattggctgcctcagcaataaaaaagcctgaatatactcctaaagaatggccgttatttgtaccatattgaataatggtgtgattatagaagcttaccattgattaaaaagggacatattagtccttcttcatttgaagtctctcattcctatgtggtgatggctatccagaatacatgtgctacttttaatagagcaattattttggtaatatatacaacagtgtaattttttaattagggcattcgtttctctagtcagtaaaaaggtaactttctttttttccttttccatgtatggtttaacttcttttagtgttttttttttaaatcatcattcatttaacttacagcagatttatataaatatatgactatctttgatatgcataatatatactaggctaacagggctcctagtattatgtattcctaagacgttacagagctgcaaaaatgaacaaaatcataaagcctcttctctacacaggtgctcgagtttggcttttcattggtttcatgttgatgtttgggtcacttattgcttccatgtggattctttttggtgcatatgttacccaaagtaagtatatattcttcttgtattttataggagagattcagatatgtcttttatatttggcttactctaccttgagtacaacttagtataattgttcacttagattgaagatactgctctgtgtgaagatacatgagtttaataaaacttgtcagtgggaacacttagtgcagtaggatagccctggttaggaaatccaagccactgacaaagctggtacctctcagctgtctccagactttctgctttccttctttaccttagacagccaggattttatgctagaggcccatttactgggagttgcagtagaaaaagtgagaaaccagtacaggtgtacactcccttatatacaattctaaaatccacaaaatgctgaaaatcaagttatttataactagtctggcagcaaaacctgacctaaactgacatggagctcactattttctttatcccatttagtgtaagtattcaaatgttttattgtaggaatgaaaatagatatattagattataggatgtgcttgtctatacccagctggcggtgctatgtagtatatgtgctttcccttactgttcttaaacctgaagaattctgaatcccaaaatatatcttgccccagggatttcagataaggggtatagaccccttatctgataatctatggattgccagtagataatctttcgtttcattgacaccttctctctccaacctaatcctgtaatttttttttttttttttgagacggagtctcactctgtcacccaggatggagtgcagtggtgtgatctcggctcactgcaacctccgcctcacaggttcaagtaatttgcctgtctcagcctcccaagtagctgggattacaggtgcacgccaccacacccagctaatttttgtatttttttagtagagacagggtttcaccatgttggccaggctggtctcaaactcctgacctcaagtgatccacccatcttggtctcccaaagtgctgggattacaggtgtgagccaccatgcccagccaatcctgtaatttttaagtcatgggtacagggggagttttttaagggcaagactgaacacatatgtatactcttcatacagaaacagctgatggagtgggatgagctcttattacaccatgctgaaatctgtggctctgccaggtgccatagcttttcattcacagtagtgatgaaaaatagaacccagtttcagaaatgtctctggaagcgtcggaagactgtttcactggccctcttcctttgctcctaagacaggagtcagtttcagagaacgcaatttattcatcctctgactcctctacctctggaatctctttgtcagccttctttgcttaactgtcacatctccttgtcctgactcacagctggtttttgaatacttttgatagtatcatttaagtctcatagtttgatcagtataagatctttggaatacttttgtttttcttttgtctttcacttgatacaaaataagtcagattacaagaggacagtggttggcttaaataacattggtcaccaactgtatctaaaatgtgttttttagttaattaaaaatactactagagcacataattctggtatgaagcatatctgaaggaaaatgcttttttaaagatagcttcattgagatataatttgcataccatataattcagccatttaaaatatgcagttcagtgtttttagtattttcacagaattatgctaccatcatcacaatccaatttgagaatatttttatcactgccatacccattagcagtcactccccattactccttcccctagccctaggcagccactaatgtactttctgtctgtatctatttcatacacatggaatcttataggaaagtgtttttttgagacagaaccttgctctgtcgcccaggctggagtgcagtggcgtgatctcggctcactgcaacctctgcctcccaggttcaagcaattctcctttctcagcctcctaagtagctgggactgcaggtgcatgccaccacgcccagataatttttgtatttttagtagagatggggtttcaccatattggtcaggctggtctcgaattcctgacctcaggtgatccacccacctcagcctcccaaagtgctggtattacaggcgtgagccactgtgcccagccggaaagtgtgttttaaactcattttatccctgactgtaagaagggtgggctgctgtcactgattttcttaaaaggtctccatagttatgttaaagaaaaactttagataaattagcaatttgagcaaaccaagaagaggttcggagagcttcacccagcagcatgagcagctgtaggctgaacacaaggcaaagacaagaaatttttagattgtctgtagctatatgtttgtcttatttgtgcatggtctcatcagttggctgcttgggattggctaaagcttagccgtttgtgattgactaaaattcagctatttattaaaaaatataaccctaggtttcagttcgtttacgtaagttaggttccggggggtgggttggggtcacacaggaactcagagtagggagatagcctcaggttaatggcttcctgcttatttactttagcagttgaagtgatccatgagctttacagtttctatagtgaaaatagggataaattgccatttctgtaaggtatgtagggaaatattgtttgtaaaggctttactattgttgagtgtatttttttttttttttttgagttggagtttcactcttgtcgcccaggctggagtgcaatggcacagtctcggctcactgcaacctctgcctcccgggttcaagcgattctcctgcctcagcttcccgaatagctgggattatagccgcctgccacgactcccagctaattttttgtatttttagtagagacagggtttcaccatgttggccaagctggtcttgaagtcctgatctcagacgatctacccaccttggcctcccaaagtgttgggattacaggcatgaaccaccgctcccagccaattgtatcttaatatttaaagaactagtaaatattgataaatttcttgattgtgaatttcatctttctatttcaacagcattactcatttaaatatacttttcttttttttttaagatggagtttcgccctgtcgtccaggctagagtgcagtggtatagtcttggcccacggcaacctctgcctcctgggttcaagtgattctcctgtctcaatctcccaagtagctgggattacagccatccaccaccacacttggctaattttgtatttttagtagagacagggtttccccatgttggccaggctggtctcaaactcctgacctcaagtgatctacccgcctcggccccccaaagtgctgggattacaagcgtgagtcaccacacccagcctaaatatacttttctatttgtaaagtgaatatgactttatttcagagagcatttctaggccatgtttcaaatcttttactgtacagatttgcttgaactattaatattcatagtaatagctaacttttatatattactttataggctagatactgttctaagcactatatagagtcactcatctaattcttacactctggagtaggtgctattacaatgcccgttttacaggtgaggaaatgaagatatgctgaggttaaataatttgcccaaggtcatacagttagtcattggtatagataggattcaaacctgggtctggctcaaacttggagctcttaaccatgctgctgtattgtttgctatgatatcaagagctcagaattgaaccagtttcttcatcttctccagtattttttaaatcaacatttgtagttttacaaaagttaataatccacaaaaatttaagtagtttccattttgtttcttttcttttcctataaagatagtaaccatttcctccaggatagattcagtgaaagagaatgataaattctaactgtgttatttatatctgacatatttgcatgataaaactcctggattgagagccaggcattgtggtgtgtgcctgtagtcccatccacttgggacgctgaggcaggaggatcacttgagcccaggagtttgggctgtagtttgctatgattgtgcctgtcagtagctgctgcactccagtctgggcaatatagtgaggccccatttctttaaaaacaaacacaaaaaacctcttgaattcatgaaagaaaataaattaacagactgtttaaaagtcaagaatttattttgtatgtttttacgattttgcatttcagtgttggccataggaggcaaaggagcaagttactgcttcctcagcagttttgatgtagctagaaccagcaattactttgactaaaagaaaactttgtaagttcattgacttttatccagagtaagagcagtcctttgctttgggggaattaaattggcattttcttctttcagtttcattatagatgtcttacagttaatgaataatagcagtatgttgtaatatacaaaatgtatcattatgaatggcactgatactttattactgccgtttgcctatataaccgtctaatctgttttactttgtgtatgtagatactgatgtttatccgggactagctgtgttttttcaaaatgcacttatattttttaggtaagttgccttattttttaaccacgcctgtaacatttacagaaatgtcaacttaattaaggcagcatatatatggaacacatataaatcccatggattggttacaatgatagaacttcttttaaaaggtgagaattccactgttacataagagcagagaggccttttaactagaggtcttgctgtgtatcaagactttagctggatcctttatatattttaccctttgaattcacatttaggccaagtgctgtggctcatgcctgtaatcccagcactttgggaggctgaagtgggtggattgcttaagtctaggagtttaagaccagcctgggcaacatggcaaaaccctgtctctataaaaaaatataaaaattatctggttgtggtggtgtacagtgccagctactcaagaggctgaggtgggaggattgcttgagccgaggaggttgaggctgcagtgaggcaaggctgcaccactgtactccagcctgggcaatagagtgagaccaaaataaaataaaataatgcatttaattattttaaatatatgtcaggtgttattcccattttatttatttttatttttatttatttatttattttttgcgagggagtctcaccctgtagcccaagctgccttagtgcagtggaacaatctcggctcactgcagcctccgcctcgggactcaggcgattcccatgcctcagcctcccgagtaggtgggactacaggtgcacaccaccacacccagctaattttttgtattttagtagagacgaggtttcaccatattgcccagagtggtctcgaactcctgagctcagacaatttgcctgcctcggcctcccaaagtgctgggattatagccaccacacccagtgttattcccattttatagatgaggaaataaagtttagggcttgctttaggatgcctagctagtaaatgagaagcctggatttgaatccagactgctgcttccatagcctgtgtcttattaaaaaaccctatcagacccattgtttcacttgactagcctttcgggaaaaaaaaaattaacaacaacaggtaaagtacctttatgaagaaaaaaggaaaaaccagaattaatacctagtggccagccaggtgtggtggctcatgtctgtaatcccagcactttgggaggctgaagtgggtggatcatctgaggtcaggggttcgagaccagcctggccaacatggtgaaaccccatctctaataaaaatacaaacattagtcgggcatggtggtgtgtgcctgtaatcccagctactcggaaggctgaggcaggagaaccacttgaacccaggagacacgggggttggagtgagtcgagatagtgccactgcatttcagcttgggtgacagagcaagactccatatcaaaataataataataattaatacatagtatgcatattatatacaaaacctgttgggaaattctgttttctgaatgcccttttaagaaaagttaaagtaagtggaaaaataaaccaatattaaaagtattttttaggggcagtcttctaaaatatccccaaaatgaagtccattctatgctttttagaatgaatgtcttttttttttttttttttgagctggattctcgctctgttgcccaggctgatgtgcagtggtgcaatctcagctcaatgcaacctctgcctcccaggctcaagcaattccgtgcctcagcctcccaagtagctgggattacaggcatgcactgccacacccagctaatttttgtatttttagtagagatggggttttgccatgttgaccaggccggtctcgaactcctgacctcaagtgatctgcccacctcagcctcccaaagtggtaggattacaggtgtgagccaccatgcccagcctagaatgaatgtcttttaatgtcaacataggatatttaggtatatatttataaaattttatctgcctctgtccccatcccccataaatcattaagtaacttctaagccttgaaaaactttgcttttgtcactggttttaagtaatttgattacgatgtactgtggtctagttttcttgatattccttctgcttggtgtatattgagtttcttggatctataggtttatagttcatcaataaatctagattcttctcagccattatttcttcaagcattttttgtatccactgcaccctccctctgggatttcaattacaggttataataggctgctcgaagttgtctcacagcttgctaatggtcagatttttttttcctgtttgtgtttcagtttggatagtttctattgttacattttaaaattaatctcggctgggcatggtggctcacacctgtaatctcaacactttgggaggccaaggcgggtggatcacttgaggtcaggagttcgagaccagcctggccaacatggtgaaacctcatctctactaaaaatacagacattagctgggcatggtggtgcatgcctggaatcccagctactcggaaggctgaggccagagaatcacttgaacccgggaggctgaggttgcagtgagctgagatcacaccattgctgagcaacagagcgagacttcatctcaaaataaataaatacataaataaataaaattaatctctctattgtcactttgaagaattaaataaattaatctctacttctgcaatgtctaatctatgccatccaatgattttttcatctcagacattgtattttctctctctagaagcttgattgggtctttaaaaatatttctgatgtcttcccttaacatgctcatgccctcttccaccttgaacacacagagtatatttatagctatctcagggtccttgtccaattgtctgtgtcatttctgcatctgcttctactgattttttctgcttctgtttactcttcattttggacctattttcccttatttggtgctttgcatacaatttgttgggactggatctttgctagtcctttaaatgtttttaagctttgttttgggatgcagttaggtgactcagaaacaatcagaaacaatttgatccttttatgtctcttaagctttgttataggcaggaccagagcagctgtagcccaggactgatttgtccccctactaaggcagtcataccctttgagtgtttccactctctgatgcttcatgtattccgaggtttctctactcgacttgtgagagtatgaactctcttccagccttgtggtagctctgggacatgttctttccagtggttctttccttcccttgggtagtttcctcttatgtatagactcttcagtactcagccacagactgaaggagcaccccctgcagatctcctgcgttccctctgtgtggctgtctgtacgctgcatggcaaactctagccatgtggtctccctccactctcagaccaccatgctctacctggatttcgccttgtggccttgacactcctggttttgaaagatgtttggcagtttctgctgtcttatatgtcaaagacatgtgactgacagccttctggggatatggtaagttgttatgaagacattttaggcagtctttagagattaagttcagattcaacactttgtggtggtagatgaatccacttaaatgacaattggatgaacagaaaccttgtatgctcaggtggacatagttgacagctgtgtcatctatgtgctctgcccagaggctggcaagttatcaggcagcctgtatgcttcctgtgtgctggacctgttctaagctctggggtacaacctcttttatttacatctctggtcactcctctgttttccttgcaagctgatcctccactccctgcctactaccttttgaagtctcttaaagctgttcttggccttaagaaactccttgttatttttctgtccctgggtgaactcatgtgtacttaggactccaattattgcttatatgccagtgagtcacagatgtccctttccaggcctaaaccgtatatccagattcctacttcacatcccttcttgggttgctgacatttcaaatccaaaacatttagtatgcccacagctcaactcatggccctggagtgtcccatctctctgctcccgcctccttatcctctctcactttgccgagataattccccctcttcttttggatctcaattcagtcaccactcctcaggaaaacctttcctgacctctctaactaggtctgatccttatgtttcactctgaggatactgtgcacctctcatttatagcatttttttataggtggaattttatatttatttgattgtctccttattagacccttagctccattagggagcaagtttgtctggactcagtctcaccccagcacttaggtgcttggtacgtagccacttttcagtgcacaataattatttgttgaaggaatgaagaattgcagcatggtctgttgtagggtgcttcagttactgtaatttagatatggtaggctcctggagacataaaatggccctaatgcctgtcactatgagaatggtctctctccctttttcttttgatttattgattcatttttttgtttctgagtcatagagaaatgtctcttttccttacaagttgcctgttaataacttcccaggccttaagaaagaatacagttatgcttagccatcgtagttaacagactgctttacaaaataagcaaattaagaccaacactgccatgatgtctaatttaatttttaaaattgataggaatcagtgaagtacctgtcaaagcatattgagaaaatgaattctgtgttgcttgttccatcggttttttcctcatgatttgttttcctatctttctagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacggctctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtatacccaattaaagatgcagttatgtttataaaataagaagaaatagacttgtaaaatgcttatgtgagggttattgaaggtttccctgaagactgactggaaatggtggctgtttttttctatttctgactctgccatgaatttttttttttttttttaaagacaatatctcactctgttgcctaggctggagtgcagtggtgcaaccacagctcactgcaccttcaaatgctggagctcaggcaatcctcttacctccgctttccaagcagctgggaccacaggtacgtgtcattatgtctggttaattaaaaaaaaatgttttgggaggcctaggtgggcggatcacgaggtcaggagatcgagaccatcctggctaacatggtgaaaccctgtctgtactaaaaatacaaaaaaattagccgggcgtggtgggggtcacctgtagtcccagctacttgggaggctgaggcaagagaatggcgtgaaccttggaggcagagcttgcagtgagccaaaatcgtgccactgcactccagtctgggcaacagagcaagactccatgtcattaaaaaaaaaagttgttttttgtagagacgggggtctcactatgctgttctgggtgaactggtctcaacacatccacctgcctcaacctcacaaagtgctaggttgacaggcatgagccaccacacccaaccctgaatttgttttttagttgtgagcaaatcacttaattttctgtttcttcattttaaaaaaagagataatgtggtcaggcgtgggggctcacgcctgtaatcccagcactttgggaggccgaggcgggcagatcatgaggtcaggagttcgagaccagcctggccaacatactgaaacccggtctgtactaaaaatacaacaaattagccaggcgtggtggtgcacccctgtaatcccagctactcgggaggctgaggcagggagaattgcttgaacccgggaggcagaggttgcagtgagccaagatcgtgcaactgcactccagcttgggtgacaaagcgagactccgtctagaaaataaaaaataaataaaaacataaaagagataatgttagtatccactcttagaaatattatgagttagggcagaatctttggtaatcatctacaaatgcatgtgattcccttactaaggttctcaagctgtcacatagattcagtggtcattgaatctgagtgttttttgtgtgtggaccaatattatcagagtattccattttattgctctaagatccttgtattccttgtgctgttgccactgagtaaaaacccagaggctgtatttttccagtatatatatatatgtgtgtgtgtgtgtgtgtgtgtgtgtgtgtgtgtgtgtatttctatacacaagacgttgacttgacattgatttgcatcaacataatgaaattggaagactgaaagattgatgatatcaaaccatataatttggccccttgagcaagagcccccagagggtttgacatgggtgcattgaactcatgatctctacatttttccccagtggaagggttttcagtcacaacatcaactcaggagtctttgttttcattgttcttttttatggagtcctttttacagtgtcttactcttgcccaggctggaacgccgtggtgtgattatagctcactactgccttgaactccttggctcaagcagtcctcccctcagtctactataggtgtgcaccaccacactcagctctcctttttagatttagttgcacctttcccaagttgcttttagaacactggtggccctgaaggtgtacctgagaaaaggtgtgtgtgtcaaagaagcttgggaaaccctgggctgaactaggtctaaacatgttttttctttctttatttcttgattttttttttttttttcagatggagttttgctcttgtcacccaggctggagtgtagtggtgcaatctcagctcactgcaacctctgtctcccaggttcaaatggttctcgtgcctcagcctcccgagtagctggggttacaggtgggtaccatcctacccggctaatttttgtatttttagtagagacatggtttcaccatattggccaagctggtctcaaattcctgaccccaggtgatccacccgcctcggcctcccaaagtgttgggattacaggcgtgagcactgcgccccgccttcttgcttagtcttttttagagaggggtcttgctatgttgcccaggctggtcttgaattcctgagctcaagtgatcctcctgcctcagcctcctgagtagctgggactagaggtgcaaatcaccacactaggctccaaaacacctttttaaaattctgtaaagttcttttctttcttagaggtttttttttttttttttttttttgtgtgtgtgtgtgtgtgtgtattgtatgtctttaggaggagggtgtcaattatatggtgttttctattactgagacttggaaatttatctcctggaacatgttgaaaaatgtaatttggggccaggcacagcggctctcgcctgtactcccagtactttgggagtccgaggcgggcagattacttgaggtcaggagttcgagatcagcctggccaacatagtgaaacccatctctactaaaaatacaaaaaattagccaagtatggtggtacatgcctgtaatcccagctacttgggatgctgaggcaggagaattgcttgagcccaggaggcagaggctgcagtgagctcagatcaagccactgtactccagtgtgggcaacagagcaagactgtctcaaaaaaaaataaaaaataaaaaataaaaaaaataaaagaaaaatgtaatttggggaaagtgctgctatggtggctttagaatagatagaacacagggaattaacaaaaggagaggaaaatgtttaggtgtgggcatggctggctttgggaaaagcctgtggccagcctgattatggggaataaaaatggtggcaggagggcacagtaggaagaattcttccaattgcgttgttactagacagttgtggtttgggcgctgggattctcggaggcctatggatttaagtttaggttggtttacttctcccttattcccttattctggcactgccatttattagctatttgactgcaagactgtttccctgtctgtaagtatgtttgagaattaatctgaggaaatgcttaacaaagttcctggaaataataagtgattcacacaagtaggctttttttttccttttttttttgagacagagtctcactctgtcatccaggctggagtgcagtggctcactgcagcctcagcctcctgggttcaagccattctcgtgccttggcctcccaagtaactgggattgtaggcacatgccaccacgcctggctaattgtttttgtatttttagtagagatggggttttgccatgttggccaggctggtctcgaacttctaacctcaagcgatccgccagccttggcctcccaaagtgcagggaattacaggcgccgtgcccggcatttcttatgatgacttttgaagggatgtttcctttctcatctgatgactttttagctttttgccacaaggtggcatgccatgctaagaaaaacaagacttccaagtttagagcctgccagagcatttttttgtagcacttttatcacagcttaagtaattttacttagggttttggatagcagtaaatgcctcttcaattctttcagctgtggcagataggatattttaaatttctttgagtaagtatggcaggacaggctgcctagaccctcatggattatgccagtgtagagagtgctgggtctttgatttggggagcatgttgacctcttccccaccccagaggtctagacataaaaccagagagctctccaaaaaggatgtaaattgtgctcttttccagcagcagtttctggttttttttttttttttttgagactgggtctcactctgtcaccctccacctcccaggctcaagcgatcctcccacctcagccttccaagtagctcaggtgcatgccactacatcctggctaattgttaatgttttgtagagatggggtttcaccatgttacccaggctggtctcgaactcctgggctcaaaggatctgcctacctcagcctcctaaagtgctgggattacaggtatgaaccactgcacccagccagcagtttcttttgtttctttttctttctttttttttttttttttgtaaagagatggagtctcactattttacccaggctggagtacagtggctttcacaggcatgaacattgcacacttcgacctggaactcttgagctcaagtgaccctccagcctcagcctcccgagtagctgggactatagtacaggtctgtgctccaacagtttctactcctggtgccaaaaacattattcagtgtgatcagtgtacttccctcccaccatggaagttgtgagtttagaaattaaccttttttttttttgagacagggtctggctctgtcacccaggctggagtgcagtggtgtgagctcggctcactgcaacctctgcctcctaggctcaagagatcctctctcctcagtctcctgagtagcttggactacagacgcacgccaccatgcctggctaattgtattttttgtagagacacggtttcaccatgttgcccagattggtctggagctcctgagctcaagcggtctgctcacctcaacttcccaaagtgctaggattacaggcgtgagccactgcgcccagcctgagattaactttttatgttgaaattacatcagacttaccaggagagttataaaaatagcacaaagaggccaggcatggtgctcacgcctatatctcagtgctttgggaggccaaggtgggcggatcaccggaggtcaggagttcaagaccagcttggccaacatggtgaaatcccatctctactaaaaatacaaaaattagccaggcgtagtggcaggtgcctataatcccagctacttgggaggctgaggcaggagaatcgcttgaacccaggaggcggaagttgcagtgagccaagaccccgccattgcactccagcctgggcgacagagcgaaactctgtaaaaaaacaaacaaacaaacaaaaaaaaaccacaaagaattcctgtataacctttcagattcccagaagttaacattttactacatttgctttggtctgttattttaaatgtttggcagcatgctgcagatgtgacgcctgtttacttacccttgaatcctgtgtatatttccccccaaacatcactgcgatacgatgccaaagtcagaaaattaacattgatacagtactttgtgccttattcaaattcttcagattacccctgtaatgtactttatagtaaagaaaaatactatttttctgtggcaggatcctgcccatggtcacacgttgcatttagtcgtcatatccctgcagtgtctctaatatttggaatggttcttcagtctttgtcttctgtgactaggcatttggaacttgagtggcttacgtatcaggactactagcagttgctgtgtgcctttgtgttctgtttaggtcaacagcacctgtggggttgtgcggtgcacagcctacaggaatgtacccacagccccgactactggtgctccactattttagtagttagcatggggctggccacttgagaagtgtctggatctggaggacacttgaaggtactcacagttgtattaagggtcacaggaaaatttcagaaagtaaatagtcaagaaacacattagtttgattgattaattgaattttatgccaggcaaaattttgtacctgcccatctccaaggacctcagggtcctcctacctggacttaccagctctttaagggtttgaccctctcttaggcttttcagatacaaaaatactcttattacccacagagaatagatcagatatttttattcacctgaatgtagaaatgaaacgagttgaattaatatttacagttattatacattgttactcataccactatttaatttcaaggaaaatcattaatatcatatgttgtgctttttgttttgatttgttttgtttttttttttgagacagagtctctctctgttagcccaggctggagtgcagtggcacgatcttgctcactgcaacctccgcctcccaggttcaagcgattctcatgccttaacctactgagtagctggaactacaggcatgcaccatcatgcctggctaatttttgtatttttagtagagacggggtttctccatgttggccaggctggtgtcgaactcctgacctcaagtgatctgcctgcctctgcctcccaaagtgctgggattacaggcatgagccagcgcgcctggccacatatcatttgatgtttatgttgtagctaggtatatggatgtaaagtaaccctgagggtctgcctccctcctctttttttgataactgaggggcccagagaagctagtgctgcctgtatttctacaatgggatgaatttttaggctatcattttttaggaatgtctaggtgtcattcctagagcattggcaagttgccctgaccagagtcctctccttagcaacgggtggctctgaggccccaggtcccaagtaaccactctgaccagtttccataccctctcaagcgtagccagctgttttccctcaccacagactggaaacaaggagaaagacgtcactttcacttcattcccgtgggacagtccttgagtctcaagggaggctgggagtggcagtgaagggtggggaggcatgactgcatctccggaagctgctggggtggagtctcacttctcatcaaacagaaggacagctggggatgttctcatctcaaatagagactatttggcaaacagcaaatatattttgaagggctctgggcgcctcagagatgtgactgcatagtgtggaagttgtcagaatcaaaatggagtcacttgtgcttcaaacaaacaagcaaacaaataaaaaaccctgacaaatagagctggggaaggccatgaaggattctcatgcaaaaatgcttgataacaaaaatgatcacaaggccgggcgtggtggctcatgcctgtaatcccagcattttagaaggttgaggcaggtggatcacttgaggtcaggagttcaagaccagcctgggcaacatggcaaaatcccatctctactaaaaatacaaaaaattagccaggcatggtggcggatgcctgtagtcccagctactaaggaggctgagacaggagaatttcttgaatccaggaggcagacgttgcagtgagctgtgattgcatcactgccctccagcttgggtgacagagcaagactctgtctctaaataaataaataaataaaaatgatcacaaaagactgcaaaaatctcaaccttgcacaaagcccttcaccgccttacacaacaaacacttctatgaggacatctgcccaacaactgcctgtctaaccttggaatggcatcccccttgctattgatccttatagccaaggataattatcttaaaacagtgatctaatcctcattttttcctttaagaacctttgttttccttcaccttcctaaatatgtacatagtttactctggcacacgtgttccccttgtaataccctattcccaaatcagtatcatttcctttcagagagcctctctctgttgtggcacttcaaagacatagtggccatagtgactatgcaggcttctttaaatgttatgtaccaagaagtcctttttttttttgagacagattcttgctctgttgcccaggttgaggtgcagtggtgtcatctgggctcactgcaacttccaccttgtgggttcaaccgattctcctgcctcagcctcctgaatagctgtgattacaggcacctgccactgcgctgggctgatttttgtatttttagtagagacagggtgtcaccttgttggccagactgatcttgaactcctgacctcaggcgatccgctcacctgagcctcccaaaatgctgggattacaggtgtgagccgccgtgccctgccagaagtccattttatgtgatttaaacactatggacagagacgttattttattttattattattttttgagacagagtcttgctctgtcgcccaggtggagtgcagtggtgcaatcttggctcactgcaacctctgcctcccaggttcaagtgattctcctgcctcagcctcctgagtagctgggattacaggcacacatcaccacgcccagctaatctttgtatttttagtagggacggggtttcaccatgttggtcaggctggtctcaaactcctgacctcatgatccctcctgcctcagcctcccaaagttctgggattacaagcgtgagcccccgcacccggcctattttattattatttttgagacagagtctcgctctgtcaccaggcatgcagtggcacgatctctgctcactgcaacctctgcatcccaggttcaagcaattcccttcgctcagcctcctgagtagctgggattacaggcatgcaccaccatgcccagctaatttttgtatttttagtagagacggtgtttcaccatgttggtcaggctggtctcaaactcctggcctcaaatgatccgcccacctcagcctcccaaagtgctgggattacaggtgtgaaccactacacgcagcttaccttctgggttctaataaatatttatgaacagtgaaatttgaatatcatagaattttcatgtgtgatgaaatattcttcttttgactttaactattccaagatgtaaaagctattcttagcacacgggttttacaaaaacagggaatgggctgatttggcaagtaggttatggattatgccctgtcaacggattatttataagagtgcttccaactcaaaaattttgacaatgtacttagcttgactttatttttcttgagacagagtcttgctctgttgcccaggctggagtgcagaggtgccatgtcagctcactgcaacctccgcttctcgggctcaagtgattctcctgcctcagcttcccaagtagctgggattacaggtgtgagccaccacgcccagctaatttttgtatttttaatagaaacaggttttcgccatgttgaccaggcttgtctcaaactcctgacctcatgatccacccacctcagggtctcaaagtgctcggattacaggtgtgagccactgcgcctggccttgacagtgtaaatactaatcccatcaattagtcatttattttactaaggagaatgaggcatttcatttcagaaaatactatttaaggctgggcacagtggctcacacctgtaatcccagcactttgggaggctgaggtgagcggatcacctgaggtcaggagtttgagaccagcctgaccaacatagtgaaaccccatctctactaaaaatacaaaaattagctgggtgtggtggcgcacatctgtaatcccagctactctggaggctgaggcacaaaaatcgcttgaacccggaaggcagaggttgcagtgaagtgagattgtgccactgcgctccagcctgggcaacagggtgagactgtgtctctaaataaataaatggggtggcacagatgcacttaccctaacagagttgatttgccctctgtcctgctgggctgaaactctttcctgttctcctgctatagatgtatcctccactcctcgctggccaccatcctgctgcccaacagaagaagctcttctgtctccgatttcctgaacggtctaaggtaagtctttacaactcctatctacaacttcttcctccaaacttgtctacttaaggtgcacctaatgcatacaacagatgcttcacagggagacttgtgtgcatggggtgggagtgggccttgtttttctaactcttgccactgcagacagcatggtacacaacacttaagagagttagccacttttgccggacacggtggctcacgcctgtgatctcaaccctttgggagaccaaggtgggtggatcatgaggtcaggagttcgagaccagcctggccaacatggtgaaaccccatctctactaaaaatacaaaaattagccaggcatagtggtgcacgcctgtaatcccagctattcgggaggctgaggcaggagaattgcttgaacctgggaggtggaggttgcagcgagctgagatcgcgccactgcgctccagcctgggcgacagagtgagactctgtctcaaaagaaaaaaaaaaagccactttcttaccagcagtacagggccccaactgcctcccatgtagctgggattataggtgcctgccaccacactcagctaatttttgtgcttttagtggagacaggctttcaccatgttggccaggctggtctcgaactcctgacctcaggtgatctgcctgcctcggcctcccaaagtgctgggattacaggtgtgagccaccgtgcccagcctataaatggattttaaatacatatcctttgaacaacagagcccgacagtactgacacaatcagatgacttgcgtgctcagtagataacattactattgattaatcagttaattctctttattgcccacaaatccctgccttggtcaacacagtgtgacttgtcacatataaatgaagtgctaatgtgccttctgcaaatcccccttataacttttatatttttgagacagggtctcttgctctgttgccaaggctggaatgtagtggtgtaatcattgctcactgcagccttgaactcctaactcctaggctcaaatgatcctctggtctcagcctcctgagtagctgggactacgggtgtgcaccaccacgactagctaattttttattttttgtgaaaacaaggtctcactatgttgcccaggctgttctcaaactcctggcctcaagcgatcctcccatcttgacctcccaaagtgctgggattacaggcatgagccaccatgcccagccctctttttttttttttttttgagatagggtctcgctctgcctcccacgctggagtgcagtggcatcatttcggctcatggtaacctccgcctcccaggctaaagcatcctcccactttagcctctcaagtagctgggactacaggtgcatgtcatcatgcctggataatttttgcatttttcatagagacagggtttcaccatgttgcccaggtgggtctagaactcctggcctcaagtgatccacccacctcagcctcccaaagtgctgggattataggcgtgggccactgcactaggccctggccttctttataacctttggaggatcaagtgacatccataggaagtgtttgctgagttcccatgaggcctcagtagctctagcaggtgttatttaagaaaaaacaagtttagattgagtaattttagaaagctgaaactctgcagaaaataggctacaataaagaaaacacttcacatagactttaaaaaacatgcactatacaatcttttatttccagtttaaaaacaaaatcttaaattactaggagtatatttacaagattaattacattttaagccagcacaccatggatgtacatgaagggccactcggtgtccctcgctgggacaggttgtgtgacctgcccaaggggctccggctcatttgccaaagtcaagacgacgaccaggtcttctgactgctcagcccaaccaataatgaaaaaagtatcagagatgtgtcatatccattttgctaacaagcaattacatgcctttttagtgtttaagagaagccttaattttcctgggatatctccgtaaaatcattctggaatttgattttgaaaattctttaagaaaaaaaaaaaaagcttgtcacccccatgagacctgctgtctctcatgtctgcagggacaggccttttagaggcagcaaaagggaatactggtctctggaaagtccagacagaactctagcagctccgatggcttgatctcttccagggagccagtgggctaggcccatgctttggttcaaagcgtttggagaacatcttcttgctccttttccggaaacgagataatggacacagagtcccagacgtcatcctttggtgagctgtccttgtccaaggcctctaagatgggctgagttgggtcttttaaatacttgaggaggttggaaagcaaaattgtaattagtttaccagttcagtataccagaccttttaactttagtttttgtttttattttatttttatttttattttttttttgagatggagtcttactcttgcctaggctggagtatagtggtgtgatctcagctcactgcaacctctgcttcccaggttcaagcgattctcctgcctcaatcctccaagtagctgggactacaggtgcccaccaccttgcctggctaattttgtatttttagtagagacagggtttcactatgttggccacgctggtctcaaactcctgatcgcaaatgatccacccaccttggcctcccaaagtgctgggattataggcgtgagccactacgcctggcctactttagttttaattggtatagttattttattcagatataagttgattctgtccaccaatgacataacttatttttctttttattcaacaatgaaacaattttttttttttgagacggagtttcacgttgttgcccaggctggagtgcaatgacacgatctcatctcactgcaacctctgcctcagcctcccaagtagctgggattacaggcatgcaccaccacaccctgctaattttgtattttaagtagagacggggtttcccatgttggtcaggctgtctcgaactcctgacctcaggtgatccgcccgcctcggcctcccaaagtgctgggattgcaggtgtgagccactgcacccggcaacaattttttattgttgttgagtcagtctctttttcgcccaggctggagtgcagtggcgcgatctcggctcactgcaacttccgcctcctgggttcaagcaattctcctgcctcagcttcccaaccaagtagctaggattgcaggcgtgcaccaccacggctggctaatttttttttttttttttttttttttgagacggagtcttgctctgttgccaggctggagtgcagtggcgtggatctcagctcactgcagcctccgcctcctgggttcaagtgattctcctgcctcagcctcccaagtagctgggactacaggcgcatgccaccatgcctgggtaatttttgtatttttagtagagacagggtttcaccctgttggccaggatggtctcgatctcctgacttcatgatccacccacctcggcctctcaaagtgctgggattacaggcatgagccacctcacccagccaacaacttctaatagttgaatactccttacccctcatctcagtaatcactttaatactcatcccagggctgaccatgttaatatgctgagagtttaaaagggcaaaactcaggaaaagcaagttttgtttttttcttctgattttctgattggaagaaaagcaagttcttccttgcaaccctcagtgtaggcctgtgggttattaatcttaagacgtctctaaaattgtaacctttcagtgaaggagggactgggggctcttgttcagctgtgatggggaaaaagagggcaagttcacaagcattggtctcaggcactcctccacccctccccttgcaccagcgcacagcaagcagagaatctgggagcgagggccttaggccttaacatataaaggggtgtttcccagcgattaatttcccttttgctcccgcaggctttaggcttagccatagattcaccaagttaccaagaatctagtgtctagctcttggaaatgctgaaagatactggaagacaataagcttgtagctgactgactgaaagaggaacaaaaccaaaacatgtacccttgtgaaaccccagaattataagtgaaacatgattcactgttcccatgtaactcagagacctttggcggatgttctttatgctttcctagaaaagtgaactgacaggcctgtgttttctgttcatgtctcagaggaatgactcatagtatattcatgtactggggctcagctggtagttctaccaggagagagagagattattactgcaagtaagattctgagacctgttaggagctgtgattttgtgacaatattaaccagggaggttctagtagggaatctgtatactgcctgtgtacctacaatacatcatggcagatgaaggaacaagtgactagggttctttctgaaagtgctgctatgtttctgcagacttggaccttatctaacctctgttcatcccacatgtaactgagtaacattctgcttccaacacctttactctaggtttacccaagaataatgtgaagcctccagaagcaaatgctttttatttattttatttttttgagatggagtcttgctctgccacccaagctaaagtgctatggtgcgatattggcttactgtaacttccacctcctgggttcaagcaattctcctgcctcagcctctcatgtagctgggattacaggcgcccaccaccacgcccggctaatttttgtatttttggtagagacagggtttcaccatgttggccaggctggtctcgaactcctgacctcaggtgatctgcccaccctggcctccccaagtcctgggattacaggtgtgggtcactgcgcccggctgcaaatgctttttaaatgttcttctctcagctcgcctctgatccccaaaatgtcctgaccgtgtcctcagaaggcccaatggcctcacagagcctcagggggctggggttatgcaggaaaataagactttccacaagacccacgctactgttctttctcaagtcctttcaaatattagcaatacccactgggcaatgggtacacggggcctggcactcacagctctgggtgttgactctgccttagggccctcctaagcaccctgtgggccccaaagctcaagctcctgatcactgtctccaccgccttcacgtcctccagccaggccacttccctggagcattctccagacagcagaggagacctgctgcctcggagaggggtctactgcagccaatctccaggccaggccacctttttagccaaccccatgccattaaaaaaaaaaaattaaattgtggtaaaatacacataacataaaatgtaccatcataactctttttaggtgtacagttcggtagtgccaagcacattcacattgtgcaatcatgaccaccatccatctccagaactctgtacagccccagaactgaaactctggccccattcaacacgaacttcccacttccctccctccaccaccgcaaccaccattctacttcctgtctttatggatttgatgactctggggacctcatttaagtggaagcagacagtatccttttgtgactgccctactctactcagcataatgtcctcaaggtccatgtgtgtggtaggatgtgtcacaatccccttcctttctaaggctgaatgatattccattgtatggaaagaccatctattaaagatttatctattaatccttcaacgacaccggagtgcttccaccttttggctgttgtgaatcgtgtcaacatgaacatgggtgtacaaacaaccccataccatttgtaacccaaatctctgtgtccacggctttgcccacagctgcactcttaggggttgccaggggcagtggggccctgatgtgtcaccattaagatgtctgcgtggccgggcgcagtggctcccgcctgtaatcccagcactttgggaggctgaggtgggtggatcacttgaggtcaggagtttgagaccagtctggccaacatagcaaaaccctgtttctaccaaaaatacaaaaattagcaggccatggtggtgagcacttgtaataccagctactcaggaggctgaggcaggagaatcgcttgaacctgggagatggaggctgcagtgagcagagattgtaccatgacactcccgcctgggcaacagagcaagaccctgtctcaaaaaaaaaaaaagagatgtgtgcacacgtacctcttctatctgtaatgggatgcttggtggagtgtgaaaccagtatttaatcaggcctctatatttcaggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacatcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctcag

SEQ ID NO: 579 - DNA, 18335 bp, Homo sapiens
agcctatccggagcgatccatctcgttacgtcaccaccagcctagctcggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggtgaaaagactcggcagtctgcagcggggcgggtgggagtaattgtgggaggacacgagaccgctgtgggaaggggagcgaacgaagctaacggctgcggggcgggcaccgaggtgcttagggagggtcccaacggcccagacccctgctgtttaggggcggagcggcccgcccctcaagagacaagagtagggaaggcgggacaggtgagtccctccccgcccggcagtgtcccgaggcactgcggctttctttcagcaatcccgcccgagctaccgcgttagagcagggcagggctacctcccacttctccaaggggatggcggttatctccggcgggagctgcggcgggattctgaccgagccctccgctcccggggattggctggagatgggaggagggcgcttaggctgcactgaggttgaggaaccagatcactagggtgcaccatcaccctgagcttccagtccagcctggaagcgcaggtatccccgcacggagtcaacatgccttccaccctagacacctgctgcatcgaggtgtaatacccgcttgaattttgtcaaattccccactcgatccattttatcttctttttccagccccttcccatcttcctttctactgtgagtcatcacacataatctttaattttaacttttaaggattttaaagttggaaatctgcttggtaaaggatcatttgctggtgtctacagagctgagtccattcacactggtttggaagttgcaatcaaaatggtaagaataaactaatcaacttctctcctgtactttgcaagtaactagagaggtatcagagatgtcagaaactccttgtctactagcctttcctttgattatagtgtaaggaacactttacataggcagaagacaatagtgccaagtccagccgttgaacttaaaaatattttaggaaagccttgaccttgcttaagtaagttttatcttcattaatgttcagtagacctcgtatgtggtgtaattatccatacttggagtaatgagtagaaatcaactaacaaataatttgtttatagttcactgtgtataattttgtatttccctgtaacatacaaaatattattcttgattgttagaagtcagcctaataggagtaacataaacataagcaaattaagaattatttgtcagccgggtgggtggctcacacctgtaatctcaacgctttgggaggctgaggcaggtggatcacctgagctcaggagtttgaaaacaactgtgcaacatggtgaaacctcctctctaccaaaaatacaaaaattagctgctgctgggcacggtggctcacgcctgtaatcccagcactttgggaggccgaggcgggtggatcacctgaggtcggtagttcaagaccagcctgaccaacatggagaaaccccatctctactaaaaataccaaattagccgggtgtggtgctgcacacctgtaatcccagctactctgaaggctgagcaggagaatcgcttgaacccgggaggcagaggttgtggtgagctgagatcgcgccattgcactccagcccaggcaacaagagctaaattcccatctcaaaaaaaaaaattagccaagcgtggtggcatgtgcctgtggtcccagctactcaggaggctgaggtgggaggatagattgtgcctgggaggttgaggctgcagtgaactgtgatcatgccactgcactccagcctaggtgacagtgagaccctgcctttaaaaaaaaaaaatcatttatctaaaccacttagaaaaagaactggaggttttgctctaaaatttgcctgaattgggatttttttttcttaatagttaggctagttgtgctattagattatttaaattgagataggatattagaattaattggtcaaacttttaccaagcaccctctctgccgagcactctgctaggtgcatggggaaaacagataacagtaggttgaccacaaagacgtataaaaggacttcagtctattttaaagtatactttattttcaaagttcacttttaagcagtttatatttgaaagtctgtcaacatttaaacctgttatttttagatagataagaaagccatgtacaaagcaggaatggtacagagagtccaaaatgaggtgaaaatacattgccaattgaaacatccttctatcttggaggtaagatataaattttgtagaagtgaccaaggacactgaatttttgtatattttaatttattatgccctttcacatttcagctttataactattttgaagatagcaattatgtgtatctggtattagaaatgtgccataatggagaaatgaacaggtatctaaagaatagagtgaaacccttctcagaaaatgaaggtaggtgtgtggttttttttgtttgttttgtttgggtggataaaagttttgcattttaaagtgtagttttgaggaatatgctattttataatatatagtaaaactgtttgaattattactttaagctagaaaaggagatttcctacatcccaagctgctaattcttaaaacaattcaattattacggtagtaaagtaagaaatttgttatccttctgtccttaaaaccacattttaaattaaattattggtagcagtttactgtgtatcttttcaaatgtagtaacctttttaggatgtcattggtgactataaagtagttctaaatcaagcataaatagccattgaaactgtttattatagaaaacatgaaacatacaggtagtgtgctataatgagtcccctgaacttaacactcagcttccaaaactagtgactcatggtcatattatttcatctttactgtttttactaccttgattttccaaagtattttgaagcaaattatagacatatttttaactagaaatatttcaaagtatagacttctttaaaaacgtagccacaaagtcattatcacacctaataattatttactatcaaatatatagcttcagacttcctcaatttctcataattttttgcagttcaaagcagaaccaaataaggtctatacattgacacaaatgattgttttcaagttatcttgctctgctaactgagattacagacaagctaacagaagtagttgctgataggcttcttgtacatctgaatctatataagccatttggaaaacaattcggacatatgtatttagagttacggaaatatttatattctttgactcagattccattgttggaagtttattccaaagaaataatacaaattgaaaaaaaattgatactcatcttgataatgactactgcagttttttataatacttcattaaaaaaggccttattaggctgggctcagtggctcacgcctgtaatcccagcaccttggggggctgaggcacgtagatcacctgaggtcaggagttcgagaccagcctggccaatatggtaaaaccccatctctactaaaaatgcaaaaattagccgggcacggtggctcatgcctgtcatcctagctacttgggaggctgaggtggatggatcacaaggtcaggagatcaagaccatcctggctgacatggtgaaaccccgtctctactaaaaatacaaaaaaaattagctcggtgtggtggtgctctcctgtaatcccagctactcaggaagctgaggcaggagaattgcttgaacccgggaggcagagattgcagtgaactgagattgtgccactgcactccagcctggtgacagatcaagactccatctaaaaaaaaaagcttacaaattgattacttgggaaagtttgggagacatcgttggaactttagctttttcttttttttaacaattagaaaatatgtatgaatcgtttgtgcaattgtttttcttaattgctatggttaccctaatgactctcagttgctaaaaaaaaagtaggcttctcttaactgcatgtaaaacgctcatcagttggaaataacgaagattaaaaggaatgcctagttttcttaaaggttaatatgataggccaggcgcggtggctcaagcctgaaatcccagccctttaggaggccgaggtgggtggatcacgaggtcaggagattgagaccatcctggctaacacagtgaaaccctgtctctactaaaaacacaaaaaattagccaggcacggtggcgggcgcctgtagtcccagctactcgggaggctgaggcaggagaatggcatgaacccgggaggcggagcttgctgtgagccgagatcgcgccactgcactccagcctgagggacacagcaagactccgtctcaaaaaaaaaaaaaaaaaaaaaggttaatatgatctctttagaggggtgtgttggtaccactctgataattgctggtaattgaagtggctggtaaatctaagctccaagccactgttctactacagtgctctagaatatttacctgggtttcataatgtatactaaatactagatactgaatcttccagagtttctaaattgtaaattctcttttttaaaatcctaacagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactgtaagaataattctatcagaggcattttgttttttggtaacattatactagtataaatatgaagctgcatgtaagcggggggataccagggaaatgaatgtctaaaaaaaaaaaccactgtcatgattttgacctgtggttaacagtcttaacaggagtgtgtgtgttcatgaatgtgtttataaaattgtttaatatttggaaatttttagcctcattttttaattttatatggagtgagtctccagtgcaaagtatcatatatattagtcatgccttaccccctaaagtacttaataataactgtatacatagatagaaaagctgagattgagtggtcataattctgactgcttccaatatgaaaactaattttcagtgactgtattgtgtgttttttttctttttctgttcattttgtgatttttatgcttaaattataagagggcagtagccatacagaaatgctgtcaaagtgccctgggcattttggcatgggagtttagctttttaaagatagcatagttatgccaatattgttttctatagttattctaaaatgttcaggtattcaaatcagaagaaatccttctctaatatttttaccttaaaaagttacctgataattttttattagtttatgggatttttttgtttgtttgtttagctccaatcatctttgtccaggaaaaactccttttccatttgcagacccgacacctcagactgaaaccgtacaacagtggtttgggaatctgcaaataaatggtgagtttttaatggagtatttaatcaagaattaattacttggaaacttaccaagcattgcagtgttctatttgagatttttaaagaaaatcattttcttgcttggtgcagtagctcatgcctgtaatcccaacacttgtgaggccaggactggtggattgcttgagggcaggagttcaagaccagtttgggcacatagcaagaccctgtatctacaaaaaataaaaaattagttgagtgtggtggcatgtacctgtagtcccagctacttgagaagctgaggcaggaggattgcctgagctcaggagttcaaggccgcagtgagctatgatcacactgcactccagcctgtgtgacagagagagagaccctgtcaaaaaaaaaaaaaaaaaaaaagcattggccaggcgtggtggctcatgcctgtaatcctagtactttgggaggccaagccaggcaggtaacttgaggtcaggcattcgagaccaccctggccaacatggtgaaaccccgtctctactaaaaatacaaaaattagctgggtttgctggcacacacctgtaatcccacctactcggatggctgaggcacaagaatcgcttgaaccagggagacagaggttgcagtgagctgagatcacgccactgcactccagtctaggtgatagagctagactgtctcaaaaaaaaaaaaaaaaaaaaaaaaaaaaaaaaaaagcattttcagtacgtctcaataaagctctgttacaatatttgaatatttgctgtaagtcagccactgtccttaatgtttaacatatattaagttctcacaaaaaaacatgaggaagatactgttattatctccgtcttacagatgaggaaactgggtacacagagcttaatttgcccaagctatgtgaccattcagcagaggagccagggttcgaacataagtagtctggctcagagactttattcttaacccctgctcttgcagcctctctataatcagcaccttctatcagtgcccataaaataatgaaaagatgattgaccttatttttaagtggaagctgataaggacagtatagggtaccaatgggacctcacactaaagtacagagctactaaaacctaaatatttttaaacagctatcatccaagtcatgttgtttataatacagagtttgaaggttaaacattcctcattaatgaacatgacagattcacagaaggtgaattgggaaataatgatggaaaaaagaataaaagagacatatggagaggaggagatcattttttactaagtatcgtattacctcatagacaaaaagcaaataacacagctgtaatttaatcagagagttgtatgttatcttgagtctattctctttttttaatgtatattattctcagaagcccaaaaggaaattaatctttttatttatagtaattagagatgataattcaggtttgttttttaaactataaaactgccacatacttaattttgcacatctgttgtgtttacagatacttatatttagtaacacagacttgtctgagatggagaaataaccttgtttataataatccagtagtgttcctgcaatttttcagtatattatttgatacaaaatactttctgtcataaggagagtggggggaaagcactaaaaagtcatttaagaaaaaaaatataattcaaatttttagtttagcattgaaaaattgccttaccaagttttatataatctgatcatttaaagcctgtaaaagatactgttctgtatgtgaactttaaaaccatacaaaataaaaattggtaaacttaattacttttttaaaaaatgctggtgcaagtacatgtgtaatattaaatattaatgttaaagctgttcatatagtgtttttgcttttagttgcatattttcattaattgcaggtatttctaagtaaagatgggctagacagttcttagcttaaagagagtaagtttatatatttttctcatgtagaatgattacttgggaactcaaatctgcttttgttggcacattggcagttgcatgctttaggattaataggtgaccatatagtgactagtttttgccttaattgaaaaattaattttatgttaatatcttttgtgtcttagtcttaggaatactaaaggtatttcttcacgatctggtttaaaatgttctttcaaagtcatgtcttaaactgcttatttgttagaaaattatgagctcttattgttttgttttttgtaactagaattcttttgttcaaaaaatgctattacaatcagagtgacgttattttgtgtcgacttgtgtttttagttatttactaaattgcttcattctatgtatattgtagctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtatgtctgttatcttcttaagttactaaataacattttacttgagaatacaattcttgagaacatattttttagtcctctgtaatgtccttttactttggggtgtatacatgatcaactttattaaagagaaaagagactgggtgtttatggaaaaacagctcttatttccctctatcttcttaattatagtgacatgatactggtaagttttgaattttaaattattaatttaaagtagatttgaatgaaaaacattttaaaataatactggctatatgctggttaaagattattttgttcacaattccaatcagtgagctaatattatcctttgcttctatttttattgtttgtaaatttaatcccatctcaaattttaaaaaactggaaaatataacttttatttttttagcttctggaactaaagaaaaggcatatacacatttaagtttagagtttaaaaattattgtatgtgaattgagaatggtgtgtgtttttttaattctatctttatcctgttgtttgttcccattttacttcccatttcatccttgcctttgtttggcttgctattatcttttcaaagtccttattctccactctaccttctgtttgctttctgctcattgattatcacttcacacttcattatacattcttaactttgcaccatatggttcacagttgtgctcaaatatacctctgatctggactgttgtagtgaagcagctttgattttgacttcaatatttgtttctgccatggttaagtactcctaagtattatgtatgtcagagctgttctagtaaacaaaagaattattactgattttgggttttttttttttttaggtgagcatacttgattcagaggaggtgtgtgtggagcttgtaaaggagtatgcatctcaagaatatgtgaaagaagttcttcagatatctagtgatggaaatacggtaatgtgtagttactttattaccttgcaacttcaaattatcgtttaagcacgtttagcattctaattcattttacaatgatgtaagtttttttaaaatcagtttgccagtatgatagtgtctctggaattcaaaaattgaaatagcatattaaacatatttaaataaattggtgcagtgttaaaaataattatatctagtaagaaaatctaaacttttggtttaagttaaaaagcaaaaaaattacttttacagaatatttaacatttttctataaaataatatttaatgttacatttaaacactttgtatacgttttagcaagatatagtactggaacttaatggcatgtaattagaattttaaaaaaatcttttggcagatcactatttattatccaaatggtggtagaggttttcctcttgctgatagaccaccctcacctactgacaacatcagtaggtacagctttgacaatttaccaggtatgtgaatttaccagggaataaattttgatagtagatttatatgtatatacgtataaactctatatatagatataataaattataaatagcttcagtcaaactttaggtcatatcatattcttgtactttgtttctggtgagagttgtatgcctttaatgcaatgtttattattaatattctgtgttataatggtactatattctatttaaaaactaactctagaacattagtcatatgtctcacaaatgtaatttgtatacttgtttagaatgtggctatagttatgttaaaaaaaattcaacattgtgcttgcttcagagcacatatactaaagttggaatgttacagagaacatggcccctgtgactcacaaatttgtgaagcattctgcatttaaaaaataattcaccatgtatgtggcttttgagctttgaaatcagtgctgctacataaatgattatttataattatagttaaccaaatttgactcccagtttggtttctggatattatggactatggacataagtactgaatagtaagccttcattgaggtaactcttagaaaagaataagaaaacctgtctaatgtaaccctattagaaatcacaataaatagataaaactgtatgtcaggtcaacactttcttccctaatgttaagtattttttttccttagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggtaagtaccatttggaaatggtaatttgttcctttagtttgtaatttagtagttacgtatatgtgggtttttaaaattcaacacagtcagttttaaagatgtgtatgtatataactatacatataaattgcacagcggagtatacatgtcaaatcatattaatcaaaatttatctagccttcctttaaacaatttatcctataatatgtatattagtcctctttttctacttagctccagtttaactacgtctaggctgatggtataaaaatcacatgaaatgcgcaatgtcctatttcttattagaaaccttaaatggacatataccaaattatgagaattataaatgtagcaaaaaggatagggttgagtctaaatctattctgtaaagatgaatgttcttattttctaaatctattctataaagatgaactattttttaatctataaacctcctttaagggacgcaaagcattcatatcacacagtacacatataattatagctatccttcaattatgtttttgtatgaatatagtgattttttaaaatgtaaaagtatcaggcttaaaccagatatatgttgggaaaaaaatggatgatccatatttattgaatgctttgatagtctcattttattaatagtcaataaatgaataaaaatgataccttgatccaggagccattatatactggtatgataataaatataaatctaggaatatttttaaaaaggataagagaacagttttctgattttttttttttaggggtaaaaatacacaaaacagaagatttcattcaggtgattgaaaagacagggaagtcttacactttaaaaagtgaaagtgaagttaatagcttgaaagaggagataaaaatgtatatggaccatgctaatgaggtacatacctaattgtaggtttttcataccaattaataatgattgcaaatgacataggtgaaacaatgacagaagcactcttcttttgaaatagggtcatcgtatttgtttagcactggaatccataatttcagaagaggaaaggaaaactaggagtgctccctttttcccaataatcataggaaggtaaatgtctgaaaattttaaacatatggctaaaatgttttaaaagtttgatgtttatattataaacattctttagttttctgtaaattgaaagcttcaagggaatatatttggacttttccccttcagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctgtaagtaaatatatgtcacttctgtactttaaacctttcaatgattgcctgatgcccttcttgtaaaatagtttattgtggctttactatcatctacgtacttttccagcctcatcctgagccactttatcccatactatttatgtttgagcgtcaaaggccttctttcagttctttaaacaagtcaaagggccttttcacatgctgttcacttgacctggaactcttttccccaaccacttaactttatatgtgtaagtcttatttttcaagtctctgtttaaatgttacctcaatgagccctaatctcagccctctggggaaagctaagtgtattaacatatacatatgtagtttttttttttgtttttttgagacggagtcacccaggctggagtgcagtggcacgatctcggctcactgcaagctccacctcctgggttcacgccattcttctgcctcagcctcccgagtagctgggactacaggcgaccgccaccatgcctggctaattttttttgtattttcagtagagacggggtttcaccatgttagccaggatggtctcaatctcctgaacttgtgatccacctgcctcggcctcccaaagtgctgggattacaggcgtgagccaccacgcctggctagttgttttatttttactagtaaaatatcattaactgcctaaatgctcatgatagactcatgattaaatttattatatatttaatgaacatggcgatgaagattatatagcagtgtagaaaaatgcaacattaaagaaataggtgtgtatatttgtgtgtactcacccacatacacaaaaagaacatgccatgggataaaaagatgaaagaaatccaccaaaatgaaaacagcaattgtgcaggagggtggggggttcttttctgtatttttctaatttccaataatgtggttatattttcgttaaaaaatgtttgtttttaaaaaaattaagctaatgaaaaatctcataattgtctgcttttgctgaatgtggcttataaaaatgctgaggaataatatcttcctgtcctttattctttgtagatggttacaaatgaaggacttggtcttacaactacagcttctggaacagacatctcttctaatagtctaaaagattgtcttcctaaatcagcacaacttttgaaatctgtttttgtgaaaaatgttggttgggctacacaggtgagaagtttctagtacagtgcattttctcagtatgaatttcttttcattttcacactgataagacaattaccaaaaaatacaaattattgtaatgatatctttttacaaggaagtttttgtaccttttaacattggttatatcattaaaaattttaacttcttaaatttgtattcagttggaagactccagacattgctgataagaggttgcctgctaggcttgggtgacctacttttgccatttgtttttaaagtagaggtcatgataattactaattgtgaagagtagagtgtgatatctgggacgttttaaattttggaaattatttgtaatcaatattagtagagtaactttcttttttttttttttttttttttttttttgagacaaagtctcacactgcaagctccgcctcctgggttgacaccattctcctgcctcagcctcccgagtagctgggactacaggcgcccactgccaagccgggctaattttttctatttttagtagagacggggtttcaccatgttagccaggatggtctcaatcccctgaccttgtgatctgcctgcctcagcctcccaaagtgctgagattacaggcgtgagccactgcccccggccagtagagtaactttcatctggcaaaagaagaaaaggatttttccattaaaagtcatgtgaaagccaggtgtgatgtcacgtgcctatagtcccagttactcaagaatctgaggtgggagggtcatttgagtccaggagtttgaggccagcctgggcaacaaagcaagaccccatcttttttaaaaagtgaagtcaatattgagtttcaaacttatagaattttatgtagttgtgaacctatatgtgtatattatctaaaatcttgaaacttggagagacttctgagcctgacacatgtacttttacttaacagtgaagtaaatgcaacctagtactttatgggggtaggtaacatttgttgagcacctgctttgtggtacctaccatgtttttcacatactttgtctagtttatcccccaaaataacctagtaaagttgtatctccttttatagatagtaaaattatgcttcataatggtagattaacttgcacaatcctacactgtactcttaagttggcagagtctagatgtaagcctaggtgtgtttgatttggcgtccatgtactatgcacttctccattttgagtgacacattgtgactattaatgactaaaggaagaagtttcagaggctaaaatgtaatattctcaggccaggaaagaaattcttgtggcttaaggacaaagaaaatgttgcttttattccctaaatctcttcttgttaagaaatactaaatatttcttgtgggggaaaaaaaccaacaaccaaaaaacttagaaatcctaatggaaattaatgggaaacaggattcactttctaataattttaatattgtaataccttagctattaaaggaataatctgaaaaagacatgaatattctcagtgctctgccatcgtagccccaaatttgtagtcacttagagagttttttttttaactgtggaaaacctgttaaatatgttaaatattaatacagaaccacaaaccctctactgtatagtaattttgtgtgctactactgctgtttttttttttttctgtgcctgttcttacccatgcttattatttttctagttaactagtggagctgtgtgggttcagtttaatgatgggtcccagttggttgtgcaggcaggagtgtcttctatcagttatacctcaccaaatggtcaaacaactaggtaagttcttaaaatactggtcgagattcagccctttgctataatttctctttctctatatgttgaaatggatgatttaataaagatacttctttcattttgacaatgatcgtgtgattctttaaactgttaattattcttagcaattcatgtagtcattaatgcatattttatgattatctgtattaactcagggcaattggtataaataatccactctaagaggttgggttccttgtagccttactgttccatagtgtaactcgatggcctttttcagaagtaagggactcctaattctaggttcaaataatataccaaacctatttacttaaaagaacagaaaaaagaaatctttaagatataacctgcttatttttcccaaatgaaaggctatatccccaatctaatgtaacgtgattaatgtttgaaagacttttttgaatgtgtatattcattctatatgaaaatatgtgtcaggcaccaagccaaaaataaagaatctggcaatatgaaaaacaaggagttatttgctttcctcatttaaatcagaacttactaaaagtagggtactgacgatgccaatgcaggcgttctcttttatgagaagtgcttattgtaatggaagtacttgggacaaatataatctgtagatacctaccaactgcatttttgtgttaaatttagataatgcagtgccatcacttaaataactatgtttcaagtgagaggctttgttaaaagctctttgaggtgctccagaaagtggaaggatgcagatgcaaagtgggtaaaacccttgttcccaggatacatgttgacattttatttgctatggtcatttggaaaatgttaacatttaaatagaaatatattcataatgtgtttagcttggtatttttctgtagaattagggcttttttttttttttttttttttttttttttttttgagacagagtctcgctctgttgcccaggctcgagttagtggtgcgacttggctcactgcaacttctgcctcctgggttcaagcagttctcctgcctcagcctcctgagtagctgagattacaggcatacgccaccacacctggctaattttgtatttttagtagagacagggtttcaacatattggccaggctggtctcaaacacctgacctcgtaatccaccccccttggcctcccaaagtgctgggattacaggcattaaccaccgcgcctgtccggggccttttaaatttaatgaggaatccagatttttggcttgcttttgaaattacgaagccagttcaagtttatctaattttccttctgttacttaaatgtgtttagaaaatggtctgttttaaaagaaaagaaactgtatgcttcacttgatttaggtatctaataaataattgttataatttttctgaggtgcctcttgttattgaagaattactgaaaaatataatgtgctttttgggactctcatgagaaccaagtaattcagttacgattttgtctttttttcttttgcttcacttaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataagttacattatcttttgattcatttaattaaatacttatttttaaataacttaccagtaaactcactttttaaattttgttgcctgttgaggagccaattaaattttaaatattaattttgcaaatgtt

SEQ ID NO: 580 - DNA, 27950 bp, Homo sapiens
acgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtgaggagcggggtccctaggtcaaggggactcgtgagcggtgagacgactgaaattactgcccgtccccggacacacagatgggctttcactctctttctctccctccctccttttcacacgcactcactccgggtctctgcactggcagtcattcttgcctacacaggggtgagagtccctgcgctgtacgtggtccctttcgcagtcctctgggagtgggcggaccttctccaaggctggtagacctcccagggaagttgggacttctaaattcacttcccttccaaaattctcccctgaaaatgccctgctcttatggggacctcggtctcctggcccctttactctcgaataaatattgcgcagttgcggtatgtcaggtaaacgggacagacaagaaccctgcgcttgaggagcttgtagtcgttctctcttttgcttaagcaggtaccgcagttctggcaggtctgatacccgtgtcattagggaaatggacagatatgaccgccagaaatgagttaggaaaaccccaaaagggccagatcctcaatgctatgttgaggaaaagttcatctaagggttgtggggaatcctgtgctcaaacataccttttgtatgttctcttttgtaggctctatctctctttttttgtaggctctcttgagtaggggtgaatccttatcccatgcagctcagtttaaaaacctgtccccagcccacctcactgtggatattctaaaggtgaagcccaggagatttatttgtttctcttagttttttttttttttttttttaaggtagctgcctgttccttcaggttaactccactttgggaatctctgtggaatcctaaaagtgaagctctcaggaaagagatgggtaactctggttttttcatactttataggtttaattcacagtgccaatgtaaggactgtgaacttggagaaatcctgtgtttcagtggaatgggcagaaggaggtgccacaaagggcaaagaggtaggttctatgagaattcctctaccacatttaatgtcttcctacataaaggatctgtgcagaagtggaatctgtgagagcctagtttctgatgctgtgctcttctcactcacgcctgtaatcccagaactttgggaggctgagacgggcagatcacctgatgtcaggagttcgagaccatcctggccaacatggcgaaacctgtctctactgaaaatacaaaaattagccagtcgtggtagtgcatgcctgtaatcccaactacttgggagcctgaggcaggagaactgcttgaacctgggaggcggaggttgcagtgagccgaaactgtgccgctgcactccagcctgggtgacagtgagaatctgtctcaaaaaaaaaaaaaaaaaaaaattggctgggtgcggtggctcttgcctctaatcccgacactttgagaggcctggtctggaggattgcttgagctcaggagttcgagaccagcctgggaaaaatgttgagaccttgtctctacaaaaaaattaaaaattatcagggtgtggtggctcacgcctgtggttccagctactcgggaagctgaggtgggaggattgatttagcctgggaggttgaggctgcactgaaccatgatcgagccactgcactctggcctgggcgacagagtgagacctttcctcaaaaaataaaaatggtcttcttggctgggcacagtggctcacatgtataatcccagcactttgggaggccgaggtgggcagatcgctttgagctcagcagttcaagaccaggctgggcaacatgacaaaacctcatttctacaaaaaatacaaaaaacattagccgggcatggtggtgcatgcctgtggtcccagctgctctggaggctgaggctggagaattgctggagtctgggaaagcacaggtttcagtgagctgaaattgcaccactgctctccagcctcctgggcaacagaatgaggacttgtctcaaaaaaaaaaaaaaaaaaaaaaagaatggtccccttccagatgcattgggattttatttagtcaggtccattctaaattgaagcaatcaataattttctgggttttttttgtttgtttgtttgtttgttttgagacagagtctcactctgtcacccaggctggagtgcagtggcgagatctcagctcactgcaagctccgcctcccgggttcacgtcattctcctgcctcagcctcccgagtaactggtactacaggtgcccgccactacgcccggctaattttttgtatttttagtagagatggggtttcactgtgttagccgggatggtctcgatctcctgacctcgtgatccgcctgcctctgcctcccaaagtgctgggattacaggcgtgagccaccatgcccggctctggtatgtttgtagaaagcaaactgcagccaggcgcagtggctcatgcctgtaatcccagcactttgggaggccgaggtgggcggatcacttgagatcaggagtttgagaccagcctggccaacatagcgaaacccccatctctactaaaaatacaaaaattagctgggtgtggtggcacgggcctgtaatcccagctacttgggaagctggggcaggaggatcacatgaacctgggaggcagaggttgcagtgagctgagatcatgccactgcactccagcctgggcaacagagtgaaacttcgtctcaaaaaaaaaaaaaaaaaaacaaactgcacagaattttaggttttagaaaactttgcttgcccaagctaggttctgcatgcacactacctgtgatatcagtttggtgaatgaaatcaataacctggttgaggagacaaaaagacgtttctgaatcaccaactaaccaactaacagaagacaacttgtgatgaatggcacagatgagcattgctagagcagctcagaggtggaaacttgctgagaatgggctgggcttagagggtggagtgtgaaggcttagctgaagcagcaagatggcacacatggggaccatgaagaagctggccacgagcagtgcagggcccaggatgcttggcagccgcaaaacagctgaaaaaggagacaaaggtcttcatgtctggcactgagctggttaggttttcttctgtaggcagtggggaaccttggaaggattttgaggagagcactgtgactaagacatttctgttctagtggcattgtggtgtagtgaaaaggtcactgggctaggagtatgaaaacctggattctagtctggctctgccactgctttgtgttctcaggcatgtttctgcccctcttcgaagtttagtttcctcatctataaagtgaggatgataataatgtctacctcacagggttgttgtgaggatttactcagcacattttttggactgcttccaaaatgctagacacttattgggtgctagggatacagaggtgaaggagacagactcttggactctcttccatggagcttaataaaataatacatgtagctgggcacagtacctgtaatctcagcactttgggaggctgaggcaggaggacctcttgaggccaggagtttgagtccatcctgggcaaatacagcaagacctcatctctactaaaaataaaaaacaattagccagtcatagtggcttgcgcctgtggtcccagctactccagaggctaaggcaggaggattgcttgagcccaggagttcagggctacagtgagccactacactccagcctgggtgacagagtgagaccctgtctcaaaaacaaataaataaaaaagataaaacatgtaaaaagcttgcttagcatagtacgtatagtagagatatttaggtggtatatttgagaaataaaaggattgaatactttccattatctgcccctaaagaattaagaggttcctaaaattcctttcaaccagctattatcagtcttttgtgatttgtttttgttgcttgtttagaaatatatcccttgttttacctcagatcaaatactgcttttggaataagatccgaacttcttagtggggcattcagagccttttcaagctctggtttttttttttgtttgtttgtttgttttttgagacaaagtctcactctatcgccaggctggagtgcagtggcacgatctccctcagtgagccgatttcggctcactacaacctccatgccccaggttcaagcaattctcctcactcagtctcccaagtagctgggattacaggcacctgccaccacacccagctaatttttgtatttttagtagagacagggtttccccatgttgaccaggctggtctcaaactcctgacctcaagtgatctggccatcttggcctcctaaagtgctgggattacaggcatgagccaccacatgtggctcaagctctgattctaatcaccctttttctttgtaccacatactcttcttccacatatcctatgccctggcaaatgaggcagtttactgctctgtgactgcctaattccctgctgcctttacactcttattcctttctcctgggatgttcaccctgaattatcaacatgagaatcagttgattgtcagagcaaggcttaaaactctggttttcgcgggtcgtggtggctcacacttgtaatcccagcactctgggaagctgaagcgggcggatcatgaggtcaggagttcaagaccagcctggccaatatagtgaacctgcatctctactaaaaatccaaaaacttagccggatgtggtggtgcgcacctgtagtcccagctactcaggaggctgaggcggaagaatcgcttgaacccgggaggtggaggttgcagcgagctgagatcgcgccattgcactccagcagcctgggcgacagagtgagattccgtctaaaaaaggccgggcgtggtggctcatgcctgtaatcccagcactttgggaggctgaggtggacggatcacctgaggtcaggagctcaagaccagcctggccaacgtggtaaaaccctgtctctactaaaaatacaaaattagctggacatggtggcgcatgcctgtaatctcagctactcaggaggctgaggcaggagaatcacttgaacctgggaggcggaggttccagtgagccgagatcatgccactgcactccagcctgggcaccaagagtgaaactccatctcaaaaaaaaaaaaaaacctctggttttctttgttgtttatgctctctgtagtttaggggttagaaatgggggaggtatgtaccaagagtctgtggctgtcccagaagtgtggatagaagtgtgattactgaagtgcttgccagcttttgcatttagtgattctatcctcctttttttttttttatttaaatctcattctgctttgatttcctttgtacatatgacttataatccccattagaaattgagctcatggtggcaggggttgtatatgtcttttttttttttttttttttttttttgagacagtgtttcgctcttgttgcccaggctggagtgtgatggcgctatcttggcttactgcaacctccgcctcccgggttcaagcgattcttctgcctcagcctcccgagtagctgagattacaggcatgcatcacacctggctaattttttatttttagtagagacggggtttttccatgttggtcaggctggtcttgaactcccgacctcaggtgatctgcctgtctcagcctcccaaagtgctgggattacagacgtgagccaccacgcccggcctatatatgtcttaattcatctttgactaccttccccctgtaggctgctgtcttcgtggtgcctaacaaatgtttgaataggcagcaaataactgcagatttcttttttctttttcttttttttttgagacggagtctcgctgtgtcgcccaggctggagtgcagtggcgggatctcggctcactgcaagctccgcctcctgggttcacgccattctcctgcctcaggctcctgagtagctgggattacaggtgcacgctgccacacccagccaactttttgtattttagtagagacaggggtttcaccgtgttgcccaggctggccttgaactcctgaggtcaggtaatccgcccacctcggcctcccaaagtgctggggttacaggcgtgagccaccgcacccagtcctgcaggtttcatctctaggcagtaaagccctcaccctagagtacatgcttcagctctgtcacattttgaaatacaaagttgggacaaatttaatatgtctgaacctgttgtaaagctatcctggtgaagtttgagttgttcctggagaattgcaggactctgatgatgtaaacttagaattgtgacctcattgcaggcatcaacaggaaataggtaaggcatgggcaggaagccgtaactggggaagtttctgggcccagaagaaaatgtaggtagtcttagggttaggtagcagctgtcaggaacttgcccctgcccataagatcctaaagggcccccatttgactctcaccagacagttagaacttgtttcctcctccgtgtcagccatcaagaggtgcttggggggctgtgcccagcaggacctcactgcccagcagatcagcaggggagccaagtggcctagatctgctgtggagtacccgactgtttgcctgcctgtctgccctcctcttcacctcattctcatcactgacgtctaccattggcttggaaatcagaaacccatatccatctagatggtaaaccattattaaggagtaactatttgttttatagctattcatacttagtggaacttaaagttggtaaagtttgaatttaggggtacccctgtctatagaaatttaattttttctatgttgtttttttgtttgtttgtttgttttttgttttttgagacagagtcttgctctgttgcccaggctggagggcagtggctcaatctcagctcaatgcaacctccgcctcctggattccagcaattctcccgcctcagcctcgggggggccaggcacagtggctcacacctgtaatcccagcactttaggaggccgaggtggggagatcacctgaggccaggagtttgagaccatcctggccaacatggtgaaaccctgtctctactggaaatacaaaaattagctgggcgtggtggcgcatgcctgtagtcccagctactcaggaggctgaggcaggagaattgcttggacccaggaggcagaggttgcattgaaccaagatcgcaccactgccctccagcctgggcgacagagcgatactctgtctcaaaaaaaaaaaaaaagaaaaaatgtatttggattgaacaatgttgtttcattgaaacttttacttgctccttgcagattgattttgatgatgtggctgcaataaacccagaactcttacagcttcttcccttacatccgaaggacaatctgcccttgcaggaaaatgtaacaatccaggtaggtgcctgtcatctggctgcagccagtgcgccagagaattcactttgcttattgactctttgctgattgattgtctggcattttagcatagtacatgggcccaggatgggcccttgagaattgataagagccatatattgtgacaatttgatttgtttttcagaaacaaaaacggagatccgtcaactccaaaattcctgctccaaaagaaagtaagtggatttctactagcttactatcatggaatttgtgtcaggaattatgtttctaggactcagagttgtggaagctcctcttttgcaggtggtttctatgtgggttgagtcctgcctgtgttccaagcatctttctctatgagaaagaatccaatctacagctatcaggccaacctttaagagacctggtgcatttaggaaatttgctgcctggcctagaaaccttttctgtagaatccagagcctgatgctgaggagagtaggaatcagccattggtaggccttttttcttccctcggggctcagccccctcagtggaacagtatgccttggaaagagattttgaaaatgggagacactaggcctgtgggttgtttagaagtacagttggtggcgctatagagagggatggctggggctggagagaataacagcattgcctcgtggtctaggaggttgggagtctctctgcagaagtagtctgtgaaaacctactttgacaacatgatagactgtgactctagggggtaagcttcccaaaagatccagcttaaagccagttgtaccttgaaggctggtgacctgcacagctctccaggtctaggggtcatcattgccctgaaatgattcagctacctcagggactcacagaatacttggctggagcttcaggttctgggggccctgagtggaaggtggtgccattgcaagcttgggcctgactattgtggtgctggccctttcttgctgggtgtaccgtaaggtcatgcaggagagttgggactcgcagcagtcccattccgtgttcatgtcctcaaaggatattgccccagctttgttttgttttgtttttcaaaggcagggtctcacttggttgtccatgctggaataccatgatatgatcgtagctcactgtagccttgaactcttgggctcaggcaatcctcccacctcagcctcccatgtagctgggactacaggtgtgccccatcacacctggctaattttttttttttttttttttgtagagacaaggtctcactatgttgcctgggctggtctcaaactcctggcctcaagtgatcctcctgcttcagcctcctaaagtgctaggattgcaggcgcgagccaccatgcccagccaatagctttttttctttaggatggagtctcgctttgttgcctaagctggtcttgaactcctagcttcaagcagtcctcctgcctcagcctcccaaagtgctgggactacaggcacacaccaccatgcccagctacacagctcattttaatggaaaaaaaaatctttaaggccctgagcagtagctcatgcctgtaatcccagcactttgaggggccaaggtgggcagatcacctgaggtcaggagttccaagccagcctggtcaacatggtgaaaccctgtctctattcaaaatacaaaaaactggccgggtgtggtggctcacacctgtaatcccagcattttaggaggccaaggcgggtggatcacctgaggtcaggagttcaagactagcctggccaacatggtgaaacccctgtctctactaaaaatacaaaaattagccaggcgtggtggtgggtgcctgtaatcccagctactcaggaagctgaggcaggagaatcgtttgagcccgggggggcagaggttgcagtgagccgagatcatgccactgtactccagcctgggtgacagagtgagactcggtctcaaaaaaacaaagaaaaaaaattacagatcatttggggctagatgtgatggctcacacctgtaagcccagtgctttgggatgttgaggcaggaagatggcttgaacctaggagtttgagaccagcctgggcaatatagcaagactcagtcttattataaaaataaaaaataaaataaaatcattagggaaataggacgattgtaaaaattcaaaacatggattatatatagccatcagcctgaacttataatactcagaaactgggtagaagttggttttggcagaggttgcagtgagccaagatcatgccactgcactccagcctgggtggcagtgtgagactctgtctctcaaaaaagatgggctgggcacggtggttcacacctgtaatcccagcactttgggaggccgaggcgggtggatcacaaggtcaagagattgagaccatgctggccaacatggtgaaaccccgtctgtactaaaaaaaaaatacaaaaattagctgggtctggtggtgcacacctgtagttccagctacttgggaggctgaggcaggagaattgcttgaacccaggaggtggaggttgcagtgagccgagatcgcgccactgcacaccagcctgggcaacaagagcgaaactcctcaaaaaaaaaaaaaaaaaaaagattcataatactttttctcaaggacttagattaggtctctctctctccagaaatgttttcaggatagctataggttcctgtacttactcaagacagccgctctttgtgggagatatccttgccctcaggagctcctagatttgcacaatgtggacaaagaggttttggggttactggtacttggtctttctaatttttcctttctaaggaatatgggaagttggcgagcccctttcctggtagctgggacctatttcaccttgtacagaaacttggaggtttgcccctgaccaccctcgagatcgtgcagcactgactggctactgctctcggttctccaggtcttcgaagccgctccactcgcatgtccactgtctcagagcttcgcatcacggctcaggagaatgacatggaggtggagctgcctgcagctgcaaactcccgcaagcagttttcagttcctcgtgagtaacgaatgtgcccccaaccaccatgtttgaggccctggagcacattgcttggtccctgtgctagaatatcctgagattcatccattcccccagcttcagaactggtctgctcctgccctaccaacacggctttcttatttggaaatcatctcttttttaaaaaaacttaattgaaacattacacacacataaacacagacatgaacacatagcattgagtatttagttctgtgaatttttgtaaactgaacacacttatgtaactaacatgatcagagcattaccagtacttcaaatcgcctgagttcaagccctgtttgtcacatgggggcatgttttcctgtggccatggaatcagtcttttggaagaggtgaaagactaggcagaagccctctgagatagttgaggagtctaaggtctaagtacacagagcattgagtatatagttcagtgaattttcataaacagaacacactcatgtaactaacatgatcagagcattaacagaacttcaaaagtccctgttgggcatatttgcagctcctaattcccccaagggtacccataatcctgacttctaatagcattaattagctttttttctttctgtattttattatttatttatttatttatttattgagacagagtctcactcttgtcacccaggctggagtgcaatggcgtggtcttggcttactgcaacttccgcctcctaggttcaaccagttctcccacctcagcctcctgggtagctgggattacaggcatgtgccaccacgcccggctaatttttgtatttttagtaggggtggggtatcgccatgttggccaggctggtcttgaactcctggcctcaagtgatccgcccacctcggcttcccaaagttctgggattacaggcgtgagccacctcgcccagccctctttttgtacttttttttttttttttttgagacggaattttgctcttgttgcccaggctggagggcaatgacgctatcttggctaacctcaatctctgcctcccgggttcaattgattcttctgcctcagcctcccgagtaggtgagattacaggcatgtgctaccatgccaggctaattttgtctttttagtagagatggggtttctccatgttggtcaggctggtctcgaactcctgacctcatgtgatctgcccgccttggcctctcaaaagttctgggattacaggcgtgagctactgcacccggccctctttttataccttttttttttttttttttgagatggagtctcgctgtgtcgcccaggctggagtgctgtggtgtgatctcagctcactgcaacctctgcctcccctgttcaagccattctcttggctcagcctcccgagtagctaggactacaggtgcacaccaccacacctggctaatttttgtatttttagtagagacagggtttcaccatattggccaggctgatctcaaactcctgacctcgtgatccacccacctcggcctcccaaggtcctgggattacaggcttgagccactgcgcccggcctatattaaattgaatttttttttttttttttttttttgagacagagtctcgctctgtcgcccaggctggagtgcagtgctgcgatctcggctcactgcaagctctgcctcccgggttcatgccattctccctcagcctgcaagtagctgggactacagccgcctgccaccgcgcccggctaattttttgtatttttagtagagacggggtttcactctgttagccaggatggtctcgatctcctgacttcgtgatccgcccgcctcggcctcccaaagtgctgggattacaggcgtgagccaccgtgcccggctataaattgaattttaagattttttaagtgagtcagatgaggtgtggaaaattagtaaatataaataaaaatttgtaatgtgaattatttgtcagtctttaatagattatataaattagatgcaaattgtgtaagacacacaaccattatactttacatatatcaaattcagctctaatacgatgaaggtaaatgaatgggtcatgaccacgtatgggaagtaatgaggtgttgtggattggacctttctgtattgaatcaatctggttagttattgccccagttccctgtcaccctagattttcagtctttgctcctgttaaccacctgggttcctgaggcttgagagaagtcagaaaggcctggcttttctccctaagaccagacctggcctggcctgagaacccatgcttgggtgaagtctaaagagttcacgctctcagaggcttttcccttcatgtcaaagcccatactgaactgttcacataccctttaagatattttgaccccaggagccagcccttgcagaaagggtgagagtgtgggctgaggtgaagggaaaagcacaagctctgcacatactgtaagccttaccgagcaggcaggtcgctctcccggcccataaccagggccatgggctcaggtgagatgcctgtggtatacttgcctgcttctccagtgactcttgttcccctacagctgcccccactaggccttcctgccctgcagtggctgaaataccattgaggatggtcagcgaggagatggaagagcaagtccattccatccgaggcagctcttctgcaaaccctgtgaactcaggtagacacactgagctgtctgctgttctgcttctagtgaggcacagatagtttacatcctgtcctaaacctggcctaccttggcacctgagttcaagccctgtttgtcacgtgggggcatgttttcctctggccatggaatcagtctttcattatcaagacaaaacaagaactgtttcacttctgtggttgttgagaaagtagccaagatgcataggaagagcttgggttagaactggagtgcagttatcactatttgacttcatattggccaggccactactttgtggacttgtccatcccgagagtcacatctattacttctttttgcatatagtgatttaagagtaaggatctagagaaggcctctccctgggaaaggcccagtactcagtaaatagccagagaagagtaggctggcttaaactggtaacagagtgggcttcctttttttttcttttttttttatgttttcatagttcggaggaaatcatgtcttgtgaaggaagtggaaaaaatgaagaacaagcgagaagagaagaaggcccagaactctgaaatgagaatgaagagagctcaggtacctttcttgggagactagggtaagggtttttggacaggtgtccttaaccgaaactctacgggcaacagagatacagttgggccccagcatttctgaggctccagttcttgaggccccaattctttttttttttttttttttttttttttgctctgttgccctggctggagtgcagtggtgtgatctcggctcactgcaacctccacctctgggttcaagtgattcttgggcctcagcctcccaagtagctgggattacaggcatgtgccgctaattttttgtatttttagtagagacagagtttcgctattttgcccaggctggtctggaatgcttggccttccaaagtgctgggattgtaggcatgagctgttgcgcctggcctctgacgctccaattctgatatccaggaaatttaactggtttatcaggattcagagaacaaataattcagaaatgtttctgaaggccctcagatgaggaacatttcatgctgactgtctagtaagcaagcccatcacatgctcacatggcgtgatggccagaggggctgcagggcacaattggtctgctctctcctatcctcccccaagttgtacgtatttggagggcagggactgcagtacagtccccttatttgggttcattgcttctgggaagcccgatctgctgtgcctcctaaaatgtggaactggccctagttccagttcctagcgtgctttggcgtatgcttaggcccctctgccaatctcttccccagtgctttgtacctggcttctcaacccagagccagggcagggactttgacaactatgaagggtggtgagcaaagagctgttgctgctgccgcataggggtctgagagcacttatatcttaacagtctgccctttttcactctcgtctcaaaccaggagtatgacagtagttttccaaactgggaatttgcccgaatgattaaagaatttcgggctactttggaatgtcatccacttactatgactgatcctgtaagtacatccaaagaacttctctttcttaagtgtacaattgagagacagaaaacttctctttacaggaatgagggcatgcaggaatctttactcacctttgagggttttattattatttttttttgagatggggtctcactctgtcacccaggctggagtgcagtggtacgatcttggatcactgcaacctccacttccctgggcttgagtgatcctccccacctcatcctcccaggtagctgggaccatagatgcattccaccgcaccctactgattttttgtatttttggtagagacagggtttcaccatgttgcccaggccaatctggaacttctgggttcaaggaatccgcctaccttgacttcccaaagtgctgggattacaggtgtaagctactgtgcctggctgaggttattttattttacttttttttgagacagagtctcgctctgtcgcccaggctggagtgcaatggcatggtcttggctcactgcagcctccacctcccaggtttaagtgattctcctgcctcagcctccccagtagctgggattacaggcatgtgccaccacgcctaggtaatttttgtatttttagtagagatggggttttaccatgttggtcaggctggtgtcgaactcctgacctcgtgatctgcccacctcagcctcccaaagtgctgggattacaggcgtgagccaccatgcccagccgaggttattttttaatatcctttggtgggctgaagctagtgaggcccacatggggaggggtctgatctttataaactgggttccacccccataccataggttggctagattcctgcattagtaaaaatcatgaaagtagtgctgaaactcttgtaggcagcagagtgagaaaaatgggaacaaaatccagtgctcccttcttgtgctctggagtatctaatggaggatgcaggggtcctagtgttagatcttggcctctgactgggccagacatgggattggaaggggtgggagttctggacaagctcgcttttgaaattgctctgaccctttgctgttggttgcctcctctcatccgcttgcagatcgaagagcacagaatatgtgtctgtgttaggaaacgcccactgaataagcaaggtaagtcctgttcagtcaggaagaggcttcagactgactaatgggccttctgtttccagggagcaccccctgaaatactctccttctgcagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttagtcccttgcatccatttttccctccttgtgcccttccatcccctttttttgtgggacatcgtggtaacactactcacagacgtgctgaattctgaggctcttcctcgcttcttgtgttttctttgggtcacaccctttggcagcttagtggcccatccttgagtggatactgaatgaggtatcacccgttacgtgctgaggcagggctggccaggctccaggggttcttctgtgccttatgcagccacaccattgcccactggggttcacagatttggggaactccagatctgctctatctgctttttttttttttttttttttttttgagacggagttttgctcttgttgcccagactggaatgcaggggcacaatctcggctcactgcaacctccgcctcccaggttccagcgattctcttgcctcagcctcccacatagctgggattacaggcgcctgccatcacacctggctaattttgtatttttagtagaaacagggtttcgccctgttggtcaggctggtctcaaactcctgacctcaggtgatccgctcgccttggcctcccaaagtgctgggattaaaggtgtgagccactgcacctggccccagatctgctctttctaatacagcacccagtaccctcatagggatatttacttattttatttttatttatttatttgttttttgagacagagtctcagtcagttgcccaggctggagtgcagtggcgagatctcagctcactgcaacccccgcctcccaggttcaagcaattctcctgccccagcctctcaagtagctgggattacgggcacgtgccaccacacctggctaattttttgtatttttattagagacagtttcaccatgttggtcaggctggtctcaaactcctgagttcaggtgatccacacacttcggcctcccaaagtgctgggattacaggcgtgagccactgtgcccagccagtagtgtctcttctgctggaagctggatgctgagcttaggcttttatgctgtgtctccagggtcagaggaaaggtcagatggcttagagtatgggccatcagcttgcttctggttagtcggcccagtgatcccccaacacccatcccactgccagtttgctaggagtatttcagatttgtaaagtggggttggggtcaggtgggaccactgaggcaggagaggagtgctattcttagaaggaggaatcgaccctagaactctgcagtggaagggtggcaggacatgttccagggagcacagtttgggaacagatacaaatactctacccctcttctaggttcacagcaaggccactggtacagacaatctttgaaggtggaaaagcaacttgttttgcatatggccagacaggaagtggcaagacacatgtgagtattgaggcctggcggggaaagagcctttcccttgtgcacccctggctccctataaagggagacaatgagtttgttgagaaaggccccttgttacagatgccccatcaccagatagccttgccatgtcagatgcagggaggggctttaggtccagccttctggctttgttgtggcccactgtagtgaaggagccagtagtgctctgctctaggccaacagcccttttccatggtcttctaccccttccctttgcagactatgggcggagacctctctgggaaagcccagaatgcatccaaagggatctatgccatggcctgtaagtactgtgtactgctgcttcagggttgggcacagaaaggcaggttgtttgcttagcaaagttctctccctcagcccgggacgtcttcctcctgaagaatcaaccctgctaccggaagttgggcctggaagtctatgtgacattcttcgagatctacaatgggaaggtagctggcaggaagccccttgtttacactgttggggcccagcactttttaaaaccttgaagctggctagaagttgaggccaaaaacctattagctgattagctgtcaagccactgatgggccattctgccctggcatacacatgtaggtggtttaatctgatggtgagatggcacctaagttcaagaagtatggcaagaatactcctcagggcgccctttcaggtgcaaggtttgcctgtgtgtgtcctgacctccctcggccgacctccttcatcccttcttccccgattgtgcacgttcagtctcatattcattctttccctgcccgcaccaccatatatctcttccacccctctctctattcactgtgtgcttctgcagagttgctttccttagagtgggatctagataataaaaatagctaatatttatcattaataagatattaggggccaggcgtgatggctcacacctgtaatcccagcactttgggaggccgaggcgggcaggtcacctgaggtcaggagtttgagaccagcctggctaacatggtgaaaccccatctctactaaaaacacaaaaaattagctgggcatggttaggggcacctgtaatcccagctactcgggagtctgaggcaggagaatcgcttgaatccaggaggcagaggttgcagtgagccgtgatcgcaccattgcactccagcctgggcgatacgagcgaaactccgtctcaaaataataataataataagatattaggagctatgcactattctaagcactacctgtctcacctttacagatgagatgcaaggctagagtggttattaacttgcccaggctcacacagctagtaagttaccagagtcacagcaaactgaggcagttcggctcagatcccaagtatattgacctctgctaggctgacatccatcagttcgtattctctgcctttcctgctgctggctcttgtccgagctgggcaggctagtaggaggaagcagtcgggtggggtgccgggtgcccagtggccttagcctcattccccctgcctggcacagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcaggtgagagtcctggtgaggggaaggagcgaccttctcatgtctggtttatgagtaaagtctagctctgagcacatttctgtttacccagagtgctgctttgcccagtttggtaagggctgcgaaggcctctgctttacggggtctcaataagacatatgaccccagggccagaggcttatcagaaccaagtcaggtcaggcacagtggctcacacctataatctcagcagtttgggaaaatgaagcaggaggatcacttcaggccaggagttagaggttgcagtgagctgtgatcgcaccactgcactccagtctgcatgggcagagcaagatcctgtctcaaaaaaataaaaataaaaacaagtcaaagtgttaccccaaaggcatgcttcctggcttctttgggttctccttgctcttccctccctttgtggtggaagtcgggagctctgggtctgttctgggctggaagtaatgggttcataccccctctgcacagaattaggggagcacttttccactagggctgtagacattggtacagtggggcgctacgcagctatagaggcccagggagggggctgccctctacagggtcctcaagttctggcaggtggttcatgacagcttcccccttccctttgggccctttagcagagggaatttatccttccccgtgtccttctagggctccaggtctgacaaaggccctagtccagaatccagtactaatttggctgccaggaaaatgtattaggtccagagctggagggagaattgctacccagggagggcaagatggaagcctgggacaggaaaacaggactttttcgcctcctaacctgtgtccctcccttcctagagaacttctgtggacttgggtgccatgggggctggtgaccacagaatctcataacctttctttaccacagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggtagtggggcagctagagctggttggccgggagagctactgggaagggatggggagggatcagtgcaaggaaagaagggacctcagttgttcctgctgcccccacaggagtgcatcagggccctgggacagaacaaggctcacaccccgttccgtgagagcaagctgacacaggtgctgagggactccttcattggggagaactctaggacttgcatggtgagtagggtcactttgaaggtgatggtacaggaggagacagagttgctttccacagagacacttagtcctgtccctgggctggaagctcagcactgctggctgcctgggtttccaggctgtaccgtgactgggcttccagaccctgctttaatgcacgagactccttgtggcctaaccaagcgtggaggaaaggatctattccctttaagatgtgtaggtgcagctcttggtttgggagaggtcattcctgcattacctgatgaaaagggggttccagaattcggaagatgggcctttgggtcagcaggagagggaagtccttgtcttttccatggcctccctcaggttcactggctcccagcctagaaaatagaaatagcctggatcataaggctgtgtccttgaatgacgtcctctttcctgttttatccccaagcccctgtatgtgagatctgccatccttcccctcaagagaatattctcccctaccctttgggtaggagtcctttcatgaggaaggtgggattttctgactaagctctacctaaggcattatcctttggcctaagggaactgaagtttccagcagaagccacagagctttaagataggaccttgggctgggcgcggtggctcacgcctgtaatcccagcactttgggaggccgagaggcaggtggatcacaaggtcaggagatagagaccatcctggctaacatggtgaaaccccatctctattaaaaaataaaaaaaattagccaggtgtggtggcaggtgcctgtagtcccagctactcgggaggctaaggcaggagaatggcgtgaacctgggaggcagagcttgcagtgagctgagatcgcaccactgcactctggtctgggcgacagagtgagactccgtctcaaaaaaaaaaaagaaaaaagaaaaagataggaccttggtagcaagactgtctcagtgaaggaataatgaagcaaaagataattagatgtgtctttgaaagcaggaaaccaatgtctgaggcaccttaatttgcagtgcccatggggcaagtggcctagcacagcgcggtgctaaatgactcctcccaccaataccatgtgggtctccaaagcttgaagaaacaccctgactggaggcccctcagggacaggctatatagcatcctcaccgtgcctctcagcctttaatcacccacccctcttttgcagattgccacgatctcaccaggcataagctcctgtgaatatactttaaacaccctgagatatgcagacaggtactagtacctacagctaggtgggatgcggaacaggactgggcaagggaagggcagtgatgagaggggaggaggctctggggcctcagggcctactgtatactcctctgtgactctgaacctgaggcttgggagttccgccgtgatgctaggtctgtcccaatcctctccgggccctgctggagagtcagctgggtgaggggcttttccagtccagctttagttttctctctccttggctgaaggcaaggttgccattccatccccttggagcctcaagcctcgaagcctgggcggtgccacattcctctggtgagtaccaagggggtgctgtgggatctgagacctccttgtttcctcagggtcaaggagctgagcccccacagtgggcccagtggagagcagttgattcaaatggaaacagaagagatggaagcctgctctaacggggcgctgattccaggcaatgtaaggaccaggatgcggccaagcaagacagaagtgtggcctgctgaggcggcacctgggtcacataattgtctttctttttggccctctcagttatccaaggaagaggaggaactgtcttcccagatgtccagctttaacgaagccatgactcagatcagggagctggaggagaaggctatggaagagctcaaggagatcatacaggtaggcagctggccctggacagggagctggatgcagcacggccctcagtatgctccacaccattcccagaacatgacctgggccttgttcccacaggtattcacatagcaagaagcagccctctacaccagcactctttaattctttgcctgttaacccagctgttcttctaattatcacaaccccttctgcaggttggcacacataggctttctgacatcacactagccagagctagtctctcctccacgctcctgatagaggatttgaagggtgatccatatgcagggatcttgtcttgtgttttggtgaatgttgcaactcttgtgctgaatccaagggccaaaaaacatgaagtataggtaataggccctaagggtatgacttgagatcaatcctgtctcttccattcacaaactgatttccttgtgaaattcatttagcctcactgggcctcagtttttgcatctctgaaatggtcaaggtaggatggttgtatttgagcgttcagtaatatgcttataaagtgtcagcacagtacccagtgtgtggtcagggttcagtaactggtaggtgcccctgctactgtaatccctactgtggaagagcaagtgactgggaggcaggaatttacgtcccaatggtggggcgctcagaggattgcagagcaggaaggaagaacttggggcaggtgtaactgaggagggactgtgaagggtaagtgctcaggcctctcctccccttcctggagtgctcaggggtacagagttttgtaagcacatggcactttcaggatgaatgagaggctcaccgtggtcagagcaaaaggagtgaacaggtgatggagggtagttaaggctgtggacaggtcaacagggatctgatgctagagtcttctagatggttcatctcacaggcctggactgcatcatgaggaagcctttggagggtgttaagcagagtggtgacatgggcatgtcagagctttagatatatcatatggccaccatgtggagcctggtttgggggcttgagaaaagcaaaggtagaggcagttaggagattgttggaaagggttcaagaaaaactattgccagccaggcgcggtggctcatgcctgtaatcccaacacgttgggaggccgaggcgggtggatcatgaggtcaggagttcgagaccagcctggccaacgtggcgaaaccccatgtctactaaatacaaaaaattagccgagtatggtggcgggcgcctgtaatctcagctacttgggaggctgaggcaggagaattacttgaaccagggaggcaaaggttgtagtgagtcaagatcgtgccactgcactctagcctgggtgacagagcaagactccatctcagaaaaaaaaaaagagaaactagtgcctagaccaaactgtgtccgtgttcatgggattggaatgaggacatgagattcatgaaccatttagatatacaagcatgaaaatcttacaaggtaccccccaaaatatgtactctctctctatatatatatgtttttgagacagagtctcactcgtcacccaggctggagtttagtggtgcaatcttggctcactgcagcctccgcctcctgggttcaagcgattctccttcctcagcctcctgcgtacctgggattacaggtgcgtgccaccatgcctggctaattttttgtatttttagtagagatggggttttaccatgttggccaggctggtcttgaactcctgatcttaagtgatccgcctgcctcagcctcccaaagtgctgggattacaggtgtgagccaccatgcccagcctatatatctggttggtttttgtttgtttgtttgtttgtttgttttggggggggatggagtttcgcttttgtcccccaggctggagtgcaacggcaccatctcggctcaccacaacctccacctcccaggttcaagcaattctcctgcctcagcctcccaagtagctgggattacaggcatgtgccaccacgcccagctaattttgtatttttagtagagacgggatttctccatgttggtcaggctggtctcgaactccctacctcaggtgatcctcccgccccgacctcccaaagtgctgggattacaggcgtgagccaccacgcccagtcgtatatctattatttaaaaagaatcatttgaccgggcgcaatggctcacgcctgtaatcctgtcactttgggaggctgaggcggccacatcaactaaggtcgggagtttgaaaccagcctggccaacatggtgaaaccccgtctctactaaaaatacaaaaattagccaggcatggtggcaggcatctgttatcccagctacttgggaggctgaggcaggagaatcacttgagcccaggaggcgaaggttatagtgagccgagatggtgccactgcactccagcctgggcaacagagcaagactgtctcaaaaataaaataaaataatcatttggccaggtgcagtgagtcatgcctgtaatcccaacactttgggaggtcaaggaaggaagatcacttgagctcaggagttcgagaccagcctgggtaacatggccccatctctacaaaaaataaaaataaataaatatcccaaaggtggtgtgtgcagcaaaaattataataaaaagaactgagggtagggatagcattaggagatatacccaatgtaaatgacaagttaatgggtgcagcacaccaacatagttcatgtatacatatgtaacaaacctgcacgttgtgcacatgtaccctagaacttaaagtataataataaaaaaagaaagaaagaaagaaaaaaaccatttagggagcagaattgaggaggatttggtgacaagtacggtgaaagaataaagtcactcgggctgggcgcggtggcttatgcctataatcccagcactttgggaggccaaggcaggcagatcacaaggtcaggagatcaagaccatcctggccaacatagtgaaaccctgtctctactaaaaaataaaaaaaaatagcctggtgtggtggcgcgtacctgtagtctcagctactcgggaggctgagttgtatacctattatttaaaaagaatcatttgaccgggcgtgatggctcacgcctgtaatcctagcactttaggaggctgatgcaggcagatcaactaaggtcgggaatttgagaccagcctggctaacaaggtgaaatcttgtctctactaaaaatacaaaaattagccaggcatggtggcaggcacctgtaatcccagctacttgggaggctgaggcaggagaatcacttgaacccgggaggcggaggttgcagtgagccgagatcacgccactgcactccaacctggcgacagagcaagactccgtcttaaagaaaaaataaataaataaataaattagctggctatggtggtgtgtgcctgtagtcccagctactcgggaggctgagacaggagaatcacttaaacctgggaggcggaggttgcagtgagccaggatcgcacaccacttcactccagcctgggtgacagagtgagactccatctcaaaaaacaataaaaataaaatcactcaaatttctagcttgggcatcaggaccaatgatgttattcatttgacataagagatggggataagcttgggataggaggccggaagtggtggctcaagcctgtaatcccagcactttgagaggccgaggcctgcggatcacctgaggtcgagagttcgagatcagcctggccaacatggagaaaccccgtctctactaaaaatacaaaattagctgggcgtggtagcacttgcctgtaatcccagctacttgggaggctgaagcaggagaatcccttaaactcggggggtggaggctatggtgagccgagatcacgccattgcactccagcctgggcaacaagagtgaaactgtctcaaaaaagaaacaaagaaaacgaaaaaaacaagcttggggtaggaagagggtgaattcaagctaaggatttccttggggagagggtgaacagccagggtatgggtcagggaccagaggtaaagcatcttactcaggtgtctgcattgcagttggtaggaccccaggaatgatttgctaaatggttattgaactgacaaggtcctccctgtgttgtagcaaggaccagactggcttgagctctctgagatgaccgagcagccagactatgacctggagacctttgtgaacaaagcggaatctgctctggcccagcaagccaagcatttctcagccctgcgaggtgggtgtggctggatggggtgcaggtggacgatggtggcctctgctggctcttgggcagctgcaggtgatggcagctctgccctgagtgaatgggggctcctcagactctcactaaccccatatgtaccgctaccctttcttccagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaa

SEQ ID NO: 581 - DNA, 30936 bp, Homo sapiens
atgcccgtgcttcgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtttttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccaggtgagtgctagcacctgcgggcagccacgagcaccgggccgccgggggcacttcagcctttgcgcagggcactcccatatttcagcctatgcgagctgaatagagacccgctgtctctaacctccccccacccttatcagtaaattagcgatctgaatttccaccctctctgctctccccttgccttgcatcttttccctggtggagtgggttgggagcgtctaagcgaggcccgacctatttatgtgtaactcaggaaaattctcaaggtcaacccttcctccattccttcctttcctctcctgctgtccccgggctctgcagtctgggggcacctttctgccttccggagaccacccgaccttgccctctgctgttccggcgcagaggatggcgagccggacactgccgggggagtggttgtgcaggcctgatcagtaacactggtttcagaagtggcctgtgagcaatgcacccgctgcggtggggatgtgttgctagggacggtcgggagagcctctgaaggaattgtgtttgttttcctcctgcctcttagaatcgtttgtccatttgtactgggaaggtggtcatttcctaccgctgacttagagcaagagacgcctctaggcgggtgggggactcttcaggttcttccttggatttcagaaaatgccccttctttatgtggggtggcagcacggagccgtagggctacagtagtggggcagttgcagggcggtggaaggcgctggagactccttagtgagtcattccccgaagttgtggcttctgctgatactttccttgagagtcacgagtttacaagctacataatagcgtcgggggcaagtaagtgtggaagacgaggtaaaggaaaagcagatactaggatgggtagaaggagaggcaggggttagaactttaattccttccctggggacaggagatgccctggaggggaaggcgcttccggctctgcaggtatgtgctgttgggcctaggtgtggtcctgcggaattgctgcagattttagattgctggtgggtaggagctgcagcgcttctcttgggaaatctgtagatcacctggagccagcagttctgggaggcaccccaggttattggtcagagttacaggctatattttatttcagtgaattcagagagcacattgagtcagatcaagaatgtttattctcataggagatgaatttaaggagttaaaactaacatataaaatagaaacaaatactttcatccctgggaagactttccgttaagcttccctcctgacacaatgttacggaaatagaaaactttgtcaagtgattttttttaaccaatgttactatatataaatctgcagggagactgtcgccaactatagaaactgcgctacaggggcctccttagattaaggaacaaaactggagaagggcagccttccgctttatttagatttcttcctgttggcttagagttctgaaaagacacaatcctggaagagatcctcctcgcctggagattagcaccgagaaggaacatacaggaaagaagggctttacccactattcagagaaatgctaaaaagcccctggagcagtctggaatgaggtggatgtcaaatcaatctgtcaaaagcaattcagtgcctactgcacatctatctgtatttaaacatattgtgccctatgtttatacttaaatcttctgaatctatatttagaacaccattaccgaccacaattgaccatgaaccatctagcattttaaagcaatatttgtttcgaagaatatactgctacggtttttgcagctcaatttattaatgctactgtaagcttaccatcttcctgaacaaaaaatttagcagttagcagcaagtagattatcgctatgtaaaataaaattcctgagtttctgtcactcgctcttacagtacctacctgcctacctgcctctgaggagaaacgctgtaattaggcaacaggaaaattgtactatctttcaaatgcatttgcaaatgcctttaaggattttatcctttagaatcatagatcttgctgttaccttctgagttatttctagagttgatctgttcattaactggaacttgcgttctacgatttagttgccttatttccacccttcatttttttttatttttttaaagcaaaaattaatttttttatttttttattccaccctttaaaaataagtaagtgatattttattttataaataaatgagcaagcaatgggagcggttgtaccacagcttcattctaagtgtagacaggcatgaaaaggtcgaacccctgtttcaggcaaaagccagcagcctaggtggttccttcctttggggtggttggtaccctaacgggcattcagcagctgctacaaattaactacagtctgcctgcatttcttgtaatagaaaattaccaagtggtgtcaatgtgactcattcgagatttttttttttccttctggaagtcatagcttagtttctcaatgactcttggttcctatgtaatgccagttaagggacagctatatgacatgatatataaatgaagtgccagtttctgtgttactttgctccttgcaaacctatatgcctgaaagattggaggaagttttttccttctcgtaatctctacttcttttgtcatactgcagtgctgacactcattaaaaagaaaacattccttgtttggaactttcccaaagttttttttttttttttttctccttccaatttgaaacatctcaggctttagtcagtggcaaaattgaagttaattgtttgctctctcttcttgttaatgtattttgtactcaggagagggtctggggacatagaaatgtttcaaaagatgtcaggtgtggtcaaacttgcttttcaacctcattgagagacaatatagcaaaaggctgagagcacaaactggagccagactgcttgggggtgtggggatctggctgtgctctgtgatcgctgtgtgaccttgggcaggtcacttaacctttctggtactgcgtttcttcatctgcaaaatgggagtaatatcatagggatgctgtgaggatctaaatgagttaatactgatgaactaactgcttagaacaaggtttgccccttactaaatactgtgcacggtggtaataagtaataataattgatttctcctacttttcttcctctagtctatatcactacccttcagacacactggactcttttctctccttcatacaagtcaagcctttttctgtctccaagtctctgctcttgctgttttctttacctgtgttctctctcacatatcactttatgctcttcagatcctttgtcgcaatgtcacccttatgttttatggtatggtcctgctgtgtttttgtcttccctgactgcatgctcactcgtgctctctctcaatcatgcgctctctctctctctccctccctccctctctctccctccctctccctccctccctcccccccactctcaactgtgtattctagagagtcaggaccttccttctcattcttgatcattctcatagtagccctgccccttgagtggaacatggcatttagtaaaggatgaataagggaaggaatcattctgagaaaatactgaagatgatagctatggacttgaggcaagcatcccatttaggtaaaatgctttgtccgacattgaatttatcatatcagcttcatttaatgcattatgagatgttgtctttatttttccttctgtatcccatggcttctcaccattcccctccccctccaccccgccctctgaggttgctgcctgcagaccatgggaaacatccagtgggttgtccctgggatcacatctcttgggaagctcagctccaaagggtctagcaaagcccagggcttctaggttaggtatctcccacagaaccttctgtgtcaagaatctgggaaagtttgtccttatacctgcaggggaacctggaatttattctgtcttgttataaatctagtattcttagattcctgaagaacagaattaccagttttttctcagaggagatttcatcaggcatgtgtgtttagtgccttattacacagaaggcacactccagagaagaagaaagcaggtaatttgcttatttggctttaacagagtttcaacagagttcgtgtgagtgcaagcttgtgctctataaccaagaaccattcactggaacttgagcatcctgctgatcttccctcccccactcccagccagtgcagccatgtattaagcaattgttttcagtaccaacagtttaccaaagtgttggaataaaaacgacatctaaaacttgaatattttatatggccaaactatggctatttaactatacagttgaatatatttggattataacatatttatctcttaaagggacagatcttccatcctcctaacatatagttagcttccactctccaaatattccaccagcaacattgatgaatattgaagactatggactgtgaggtactgtgaaagacccactctaggacctgcttgctgctatttgccttacttgaaccagtaatcaagtgctggataaataatatgatttctattcaactttttgtttttagcccttagggaacaatctactgaatatgcaatgcaattgtcgggggatagttacttttcattacctaggtttctgttccttcttttaagtgtaatttaaatctggctgtcatgaaggtttggcgctcaaacagattttagcatctgtttaatgtagaagtggactggaactagcattctgaaaatgtagtctgaacccaaagaaatcccatgactctccttttctgtcctatcatagaaacagataattacatttttaaagtttttgtgtgtgggtgtgtgtgttgtcattttgaggtggggtttcaccatgttgcccaggctagactcaaactcctaggctgaagcagtcctcccacctcagcctcccaagtagcagggattacaggtgtgcactactgcacccagcttaagttttactttgtttctaatagatatataatattggatatatttatgagatacagtgtgatgttttagtacgtatatacattgtgtaatgagcaagaggattgcgtttatgggccaggcacggtggctcatgcctgtaaccccagcactttgggaagccaaggtgggtggatcacctgaggtcaggagttcgagaccagtctgatcaacatggtaaaaacccatctctactaaaaatacaaaaattaaccggggcgtggtagcacacacctgtagtcccagctacttaggaggctgaggcagaagaatcacttgaacctgggaggcagaggttgcagtgagctgagatggcaccactgcactccaccctggcaacacagtgagactccgtctcaaaaaaaaaaaaaattgtttttatgttacttccctctaggctctttaatttctccattgagcattgtgtgagctccgctgagcattgtatggagggtcagctgccctggctggagatggttttgaggcttgttccttcgtggaaacatctggatgcagaagttaggctgtacaactatccaggggagctttaagtgagccaagtggaccctcagcaccacctcagagtgttctaagctaccgtctggtgtttgggactcagggaagtccttttggtatgatcagactagccctttatgtgactatccttgtgtgttactctcattaaaatattgatttttgccatgtaaggaagattggaatagcacaggcagccgaataaggattttaatgaaacattggagaatggcttcaagttaatctgtgaatgctttgtcattgtcccatccctggacacattaaaaagaaaaaaaagagcagttgagaaattgcagtacaatttgaggagagcaatatcatacacagaagtagggactacttttgtcaaagctggattttatttatttgggagcaaagagagagagctgaaagacataatcttctctcccttaagaatctcattgtcatttagtaaaataaaaggtagtgtcacttcatggctcagaagtggtaaattatttgaggcaggtacccaaatccataaagcctgccttttgctttgtttgtggaatgctgattgtgtgctggggaatttctgatgggcagccaagaggaatttgggaagtagtgaaggagacctttaccccaggagtgttctattggatgtagttcaggaagctttctgggtaagccttgcaaccaaaggaaccctgccccagtaagatacgtcaaatggtggcagaagcaagaattagaggaaaggttgagcaacattttggtatttgaatagctgtgttcccaggaaactctgtcagtaaaatttctagaggttaagtaccttagccagatgtcataatgaacccctgtgttgctaactcaaatgctggaatggagcatgtgttttaggagttagaccaacactgcctcatcttaagcccaagtctgatcactcctaaactgaaactttgcaaatgtgtgtgttgtagcttacttaaaacccattgggtgtctgctaactctggctacactgaaaagtttttgctattctaccacccacggacgtcagagccctgctgcttaccagggcatgttagtctcctaatctacccctgaaaacctaccatggcccggggcttttctgctaccccccacgtcctataccctgcttgcttcaaaatactgttcctagttttcttcccctaacttgataatgtactccaaaacaatcatgtttggcaagtaatacactgataaatgtaaaagttacaaatagaagtgctgctgtgtttttaaaacattatagggccaggagcagtggttcatgcctcttatcccagcactttgggaggctgagagaggcaaattgcttgagctcaggagttcgagaccagcctggccaacatagcgaaaccccgtctgtactaaaaatacaaaaaattagctgggcatggtggcacacacctgtaatatcagctactttgaggcagaaggattgcttgagtccagaggtcaagcctgcagtgagccctgattgtgccacttccactccagcccggatgacagagggggaccctgtctcaaaacaaaaacaaaacaaaacaaaaacccagccaggtacggtggctcacacctgtaatcccagcactttcggaggccaaggagggtggatcacttgaggtcaggagttcaagaccagcctggccaacatggcgaaaccctgtctctactaaaatacaacaattagctgggcatggtggtgcatgtctgtaatctcagctacttaggaggctgaggcaggagaatcacttgaacccaggaggtggaggttgcagtgagccaagatcgtgccactgcactctgccactcactctagcctgtgggacagagagagactccgtcttaaaaaaaaaaaaaaacccacattctagaaataattaggtttctaaagtattcttaaaaggggcatctgtggaaaccagccactaataacatatttaaaggagagagactgaatgcttccccctaagatgaggaaagaggcaaggatgtcggcacttgccactggtattcaacattgcattgcccctaaccaggacaatcagtcaagaaaaaaaaataaataaaagacatccacattggaaaggaagaagtaaaactgtctctctttgcagatggtatgatcctctatgtaaagtattccaacgatcgtggatctgtctctccctcccctatgctcttgggccctggctctgtttctctcctggagtagaagcctgtggtgcagcaggattcaattgccttcaattgaacgttgcagaggactttcccctcggtgcttcccgtactgggggaagaggtgatttaacttctgagtaagggacaaacccagtagtgtgttagtagcaaaaagcatggacactggcatcagtctgcctgtattcagacaccagctgtgcactcatcagctgtgggaccttaggcaaattgttgaatttctctttgcctccatttcctcatccatagaatggggataataatagtaactatcatatgggattgttgtaaggatggaaagtgttaaaatatctaaactctgttacagtgcctgccataaaagaagcactctaggcctggcgcggtggcccatgcttgtaatcccagcactttgggaggctgaggcaggtggactgcttgaggtcaggagttcgagaccagcctggccaacatggcgaaaccccatctctactaaaaatacaaaaattagctgggtgtagtgacatgtgcctgtgatcccagctactctggaggttgaggcatgagaattgcttgaacccgggaggcagaggctgcagtgagctgagatagcacccctacactccagccttggtgacagagcaagaccctgtctcaaaacaaaacaaaacaaaagaagcactctatgggaccaggtcttatagttaggtattatatatgtagtagtgatattttcagttttgctgtttctgccagatgggatgaaaaattccatgagaagttggctggaagtcctactgattcattaaataggcctttcatttgaagtcatgtttctaatcattcagaagttgaggtatgcctgatccatggtattagaagggatgatcccagagaggtcattctgtagcataatgagcattacttttgaaggatggagaacctagaactctgactcatttgactatgggaaaatctgatctggtgagtgaccatgaccatgaagtgagatctggtaacccaatggtggtcacaggatagagactctgaagatactgagctggcttacacacttgctttgttgtctcgaacctctgttaaagctgaaagaagaagtcagtcttctgctgggcacactgttagtgtgtaattgtgaagagcttagctggagcttgctcttcacaacagtctctgatctcatcagccccattctgttttcaggggtggtacagaaggagcacctcaggagcctccaaagatagtagtagaatataaccaccaagacaagactgtgactgtggttttgaatcagatagaatcaccacctcctgcaaattttgtttttgctcagaacagtggttcttaaaatgtggtccttgaccaacatcatcagcattacctaggaactagttagatatgataatactcaggccccacctaacatgactgaaccagaaactctgggactgaggtatgttttaacaaactctccaggtgattttaatgccaccaaagtttgagaaccactgatctaggatatagaacagcagcattctactgagtttctgtcttcatgcaagttgctataaaaaatataagcaaggagacacgctctctgtcctcaaagagcacatagtccatctagagaggtatactatattcaatgccacacaaaggaggccttcccagccgggatcctgatgcaacagccctgcccagtctctatgccattgccgtgtgttttccccagaagagttcccattcttggccaggtgcctgtaatcctagcactctgggaggctgaggcaggtggatcacctgaggtcaggagttcgagaccagcctggcctacgtggtgaaaccccgtctctactaaaaatacaaaaatgagcctggtgtgatggtgggcacctataatccctgctactcgggaggctgaggaaggagaatcacttgaacccagggggcggaggttgcagtgagcctagatcgtgccacttcactctagcctggggggaagagcaaaactttgtctcaaaacaaaaaaagagttcccactccctgaagctgttttttgtttgcatgtttgttgtcagtctcctgtcatcattcgaaggtcagggccttgagggcaggaccctttcttgttcactgctgcatccccacccctcagcagttcctggcatagacagcaagtgctttatatattctggttgaataaatgaattaagtgttctttgattcattatgctgtctacggtaggaaactctattttgcaatctaattagaccagccttttgccaaatttgaattattttaaacaaaatcagaactattgtgtaagagcatacaactgatttgtagaaaaaccagtatatcctcatttaggaactgttgcatatgtggacagacatgtacagttaccagtatttatttcttcatatttggaccaacatttattgtttataccaggtacatatctagtttatctaatttaattcttcaaaccacactgtgatataaatgggtagtattttccctgttttgtagagaaattagatacatcctaaagcttgcaggggctatgtatgaatacaggtctgtctgactcctcaattcctgctatctctagtcttgtagatttcccacaggaaaagatgaatcataaaacagtattgaagtccactaggagtaaaaacatttaggatctctacccttaaataagtgacaaaaactttctaatttaaaaaaatagataattcaaatttcttttaaacctttaatgttctcttgactgatctattttgacttaagactgccaacaaacagttaactaggagcagctacctctgcaattgctaataaggaaagtaagaatagaaactctttcatcctatttctgtctttccctacccatttattttgtttttgttttattgtgttatacctagtttgtgattattgctaggaagggaaaaatctggaattgggtacttgtttacttatttgcctgtgtcccctgctagaaaatgagtttcataaagaaccaacctctggctgttccctgttcgtctccagcactagcccagtgagtggcacatagtgggcactcagtaagcctgaataagtaaatgaatgcacgatcaccctcatgcagtgctgagcagtgtctggctgcagcaagagtttgaatgactgcagcttccggatgtccatagtcagtgctaaaatcctgcttccttctggctgcttctgcctttcacatgatagcatatattttaacatggctggctgctgagagttcagaaaaggaagaggatatatgtggttctaaactttgctattttaaaatggcagttataaattctaaaatgtatattcattatcatttagccaaacatccccgttgagtcaggtcaaggacagttaaccaaacattagcatatgtaacgtaacataatatataacatttactgagtccttcctatgtgtcaggcatcatgatgaatgtttatagacagtatgtccatctaatcctctcaacaaccttccaaggttatattagtatctccatttaacaagtgaggaaactgaggtgctgaaaggtgttaagtaatattcccaaggacactcaactaggaaatatgagaaccaggttctgaatgcagacaatttgattccaaaactgcattcaactgcaaagctgtctcgtgaactgcacttagcagataagtggtggtactcaagccagaagtcaggtctgatctttcggttccatcattccatactgcctgttcctctgtcttctcaatgaataatgattgtcaagccactctaagtttttttagatatgtatttgctcattttggaaattacagaaaattacaaagaaaaatctataatctagccatctagaaataactatgcttatgattttaatactttcttaatttttttctattattaagaaaaccaagattattctacatatacttttattttcttttttccccactcaacctgctgtatattgagcctgttttaacctctttaatatttgtacacaccatttttaacagttgtataatgttctatttaacgggtatattatttatttaactggccctctattattggacatatgtagtatttctggttttgccatcataaatattgctgaagtaaatatctttgaaccaaatttgtttgcatttctgattgttacctcaggatagatttctagtaggattaatgagccaaagaatattaatattaaaaagaatattactggccaggtgctgtggctcatgcttgtattcccagcattttgggaggctgagatgggaggatcactagagcccaggagttcgagaccagcctaagaaacataggaagatcctatctcttaaaaaaaaaaaaaagaaaaaatatacataggctgggcgtgatggctaacacctgtaatcccagtactttgagaggctgaggcagccgtatcagttgaggccaggagtttgagaccagcctggccaacatggcaaaacccccatctctactaaaaaataaaaaaattagccgggtgttgtggcgggcgcctgtgatcccagctatttgggaggatgaggcatgagaattgattgaatctgggaggcagaggttgcagttagctgagattgtgccactgcagtccagcctgggcgacagagcgagactgtctcaaaataaataaaataaaataaaaaaattttaaaaatacagaaattagctgggcatgtcaatgtgtgcctgcagccccagctacttgggaggctgagttgggaggatcacctgagcccagaaggtcaaggctgcagtgagctgtgatagcaccaccatactccagccttggcaacagagaccctgtgttaaaaaaaaaaaaaaaaaattacctattgccaggctgtcctctagatggttctatcttatacttccctcaacagtgtagaagagggaaaactaggtacttttaactacagttatgtgttcactcatgatggagatatgttctgagaaatgtgttaggtgattttgtcattgtgagaatatcgtacagtgtacttacacaaacctagacagtataacctactacacacccaggctatatagtctagcctattgcttctaggctgcaaacatgtacagcatgttactgtactgaataccataggcaattgtaacatagtggtatgtatttgtgtgtctaaagatatctaaaaacttagaaaagatccagtaacaatatggtataaaagacaaaaaatggtacacctgtagaaggcacttaccatgaatggagcctgcaggactggaagttgctctggatgagtcagtgagtgagtggtgagtgtgaaggcctagggcatttctgtacactgctgcagaccttacgtacactgtatacttaggctacactacattcattttttaatattttatcttcaataataagttaaactagattactgaagcttttttactataatttttaaacttttgaatcttttgtgacaatacttagcttaaaacactaatacattgtaactgcataaaaattgtttctttgttttttgttttcttttgtttttttcttgagacagagtcttgctgggtctcccagcctggagtgcagtggtgcaatctcggctcactgcaacctccacctcccggattcaagcagttctcctgcctcagcctcccgagcagctgggattacaggcactcatcacctcgcccagctaatttttttatatttttagtagaaacagggtttcaccatgttggccaggctggttttgaactcctgacctcaagtgatctgcttgccctggcgtcccaaagtgctgggattacaggtgtgagccaccatgcccggccaaaaattgtttcttcatatccttattctataagatttttttttctatgttttaaatactttttttatttttaaagaagcaacaccattcagttcagaacacccatactgactttgagctgatggcctttgtaggtttctaactggaagtgaaattttttctatttttaaaactttctttttatttcatagttactttttaagctttttttgttaaaaattaagacacaaacacacaccttatcctaggcctatacagggtcaggatcatcagtatccgtcttctgcctccacatcttgccccagtggaaggtcacatggacacacctgccatgtgtggagctgtcctctcctatggtaacaaggccttctggaatacctcagggaggacctgcttgcacctgttttacagttaacatttttttttaataagtagaaggaatacactataatgctaaaaagtatagtatagtaactacataaaccagtaactgtcacttatgatcattatcaagtgttatgtgctgtacataattatacatgctatacttttatatgactggcagcgcagtaggtttgtttacaccagcatcaccacaaacatgtggatgatacagtgtactacgatgttacaatggcacagtggctatgatgtcactaagcaataggaatgtttcagctccattacagtcttatggggccattgttaaatatgcagtccatcactgaaacgcatggctgcatgtggtagaaggtttcaattcataaatattaatttatactgctggtttatgactaacccaggaaactgcataatgattaacaaatgctacgatataaccaagtgaattgcaaagtcatctacacctgtattaaagttcagctcagaaaggactgtttggactgtgtgtatctagcactacgtagaagagaaagtcaagggcaaagttcccactctcaagaactttatcttgttgggttcatgaaagggtttctggtgacacagagtaggtatataatcagcaaaatgtggtctgcggttcaaatgagtgctcatgccagagattggttgggtgccagctatcagttcttccaccctgtccctggaagctatctgctacctctggggctggcacaacccagggtgtggctgcgactgcctagggtgtggccactgtgaactgagctgcatccccttcctggtgcacacccgcacacacaaaagtcactctctaaggagtgggaatatctatctcttcgccttggaatcttcagaaaataatgatgtagcaaatgatagtttttttgaatgttgatttaattaagctgattctttctttgaaagagaagatttaatgatttttcactccctattgcatttatgttttccacaactacgacaagagttttctctgtgttctgaattcttctttcttaagatttctctttctggattagtcataaaccagtctttcttaaatacattcagtttcttccctggtttcaatagatattgagggaagaaacggaaacctgaattggttagatgcatactttataccagacactgtgccagatgatagagattatttcaggtgtgtattcaggggacggggtgcgtggtggtggtcattctgaaagacacctgcagttgcagctcaaatcatttattccgtaagtatctatgagcgtgcacactgtgcttgacatggaagatgccagacaaacgtggtcctgctctgttttaagtgaaggttgttatggtgtataaagcaggacacctcacttggtaggagtgcaaggaggtatcagggagggctgttctgctgcccttctcgcaggcagcttttcaggcattgctcctgcacctatgcagacgtgtccatggctcgtgcgggggaccctcagggagaacagtcacgctgctgccccaggcacttgcactgtccctatgactgagtatgcatcctctgcaaaccactgctgtagcatcagactctgggtacccttactgtgaattcactgcctttccaaggtcctaactgttgctggctctgcttgtcatcatccagattcataacgccatacataccttaacaaagtgtgaggagagtaactttcactagggtgcaaatgcccatcaagtttaacctcacagattgcatttatactttaaaagaggagctcagtagtaaatattaatttgtaattatagattctaactgtggattgtagagcagttgctttgctgtgacaggcatctatgcaagaggcacttctcttatcttgccatctacctaccctagcctcttaaaattaagaaaaatagaagtcagtgactaagccaccaaatttgaatgtgttacctgggctagctggagtgttttgggggagaattctaaaacctgctctggtcttagctctgccctcatttactgagcctctatttccttttctataaagtggagctaataggagttttgtgaagagtaaaagtgagctgaaaagtgctgggctgacacaaggtagccctgcacatagccagggagcccagcatcctgtccaaagattagagtctgaaagctcactctactgatttgcaaactttaacctaaagcaaatatgcttaattttattgtccttacatttattgcttctgagagacacctttttttttttttaaggcaaggtcttgctctgttgccccatgctgcagtgaggtggtgcaatcatagctcactacagcctcagcctcctgggctcaggtgatcctcccacttcagcctcctgagtagacatgagagtctccctgtgtggcccaggctgcctggcctcaagtgttccttccaccttggcctcccaaattgttgggactgtaggtgtgagccaccatgcttaggtggcagctttattttaaatgacctgtttgccccagatgtgttgaatttaaggataggctggaggttcagtcatttttatttattttcaaagaggtgttcagaattcacactctgtttttcttttaataactactgtggcttcctcctcatgctgactttctacacttgggaagagaatgtgggcaaggaagcttggagggaagccagagactccttgctctctgcagctgcacagacaggccaggatctgctgacctgtggaaccagcccgctgcagtgtgtgccccccagcccccggaggggcagcgggcatgcctcagagagcagctcagagtgaagacggtagaaggggaaaactgatgagaattattgtgaatcatggtggggaggaggggttttaagaagttaggcctgttaggctgggtgcggtggctcacacctgtaatcccagcactttgggaggccgaggtgggtggatcatctgagctcaggagttcaagaatagcctggccaacatggcaaaacctcgtttctactaaaaatacaaaaattagctgggtgtggtggtgcgcatctgtaatcccagctacttgggaggctgaggcaggagaatcacttgaacccgggagatggaggttgcagtgagccgagatcgtgccactgcactccagcccgggcgacaagagtgaaactccatctcaaaaaaaaaaaagcagttaggcctattttgctgtgctaagagaaacttacttttaatgaactgagctgcatgcctatcccaaattctgttttaaggaagatgctctgaccacagtgtcagtttggctctaaagtttcaagggatactgaaagggaatattggaaccaaatgaatctgaatgggaatcccaggtctgtcactgtctgttttagaccttggaaacattacttaacctcttttgaaaataaggatttaccatcttgttggttggtttgttaggatgattagatacattccagatcagggtaactctcctaggttaaaagcagggactgaagccaggcaattaccagggatggaaattttaaagctgacggcagaacacacaccagagctgctggctcgtggaagcctttgaagtgatgatttgatgggcaatctgagttcctcaggagctgcccaaagcctcataggctcaggagccatgctctgctttcagagtactcaacctgggccttcccctacctgtgtgagatgtctgctgctgcacccgcacgtgccccaggatcgaagggaggcctcagagtcctgccctcacagtgtcccccatgtctgaaggcaaaaaacttggaatcactgtgcatatactattttggatgctcgctttcttgctttctcactttcttgctttctctctctctctctctccctctcctccctccccactccctctctctccctctccatccctctccccaccatgtcctgctcctctcactccctccctccccctccctatgtaatgtatactttagcattttaccatgttaaatattttttcaataatgtgatttttgttggctatattattctacagcaacgactactgcagtggtgtagataaatctcataatgttgatcagaatctcccaggcacaaaagagaaaaaaagatacatgactgtatacttttctgtgtatagactgcatagttgagtaatttttaaattattttatatggtactgtctttgatgacttctcagaaacatcagattgattcatacctttttttggtctctatttactcatttgccagtaataaagcatcttgctccctaaggcttcacaccatgaaatagccacagtgctgggggccgtcccaacgtgttctttcttccacagacgcaagatggctgtcctctctaaggaatatggttttgtgcttctaactggtgctgccagctttataatggtggcccacctagccatcaatgtttccaaggcccgcaagaagtacaaagtggaggtaagtgggaacacaagctggtgcccttgtaggcttgtctgggggccacaggcttagccaagaacttattttcagccatggagggagaggcaaggagctagttgtgagaagtggcagtttcaggactgtgttagcgattctgcttcttcatggtaggaaagaggcaagaaatacagggccctgctagggagtagtttccatcttgtttgactttgtctcttcggtagaaagaccaggaatgctgggattccaatagtacacttctgcttggagctatttgctaggaagagagttactgtattttccacagagggttaaatagcaatattgtttcatggtgtgccactttaaaaatgatgtcttatggtgattttcctgttttccaagtagaaaagaggtatgtggtgttgagattagcctggacttagacataggaaggtggtctattaaacacttcctttagttttaggtgatctagaagggataattaccaaagttgtccctggtgagtggttttaaatgtctgtttctgtttagcaacttaataattaaactcccttactagagcttcttttaagtttttatatttagtttcttcttttttttcccttccagtggacacttccattaagattctcacacactcaatttctgttcttctattaagggaaatcttaaaaggatgtggtatttgatgactcttaggaaggctctatttccctacagtatctttgtaatgcatctgaaatccaccattgatgcttaacgtcaatgaaaagcacggagtttggcgcaaagctgcctctttcccttgtgcaactacagcgcagacatacattcttattcctggatatttaatagaaacattgactctgcttctgagaattgagacccttgtcaccataaatatttaagcagaaattgaatggtcatctatcaagggtgtgaaagaagatactttggaatatattgtttttaaggttcattttaactttcaacactgaatgctcctcttgaccatctgatcagtatgtgctttgttgtgacagtatcctatcatgtacagcacggaccctgaaaatgggcacatcttcaactgcattcagcgagcccaccagaacacgtgagtgtcggccctgccgggcaccaaagacatctgcagagtgggtgttttctgtctaacacctcagcccttagtgcgctgtatttgctgagtcatagtgatggtgacaatcatgggcacctcattaaaagtattcaaaaattatgtatgtgaacacattgactattaagcaaacttaagagtggttggaatggtgggatttcgggatattcttttcaaaaaatgtcttcatggttgcattacctactacagttttgcagcatgacccatctaaaccgatgttgactctcccaggcctagggagtgaagaggttttgaatgctgtaaggaaacccactctgactcaccaggaccttccacttccatttgttagatgtgaggtccttttactcagcatgttccaagtgacctctaatcccatgcagagcaaaggagggtggatgatagtgaccaggtcttctccctgcggtgaatgtttatttttacccccaagcttctaacttggcaaggaagatgtaaagattcatagtgctggctgggtgaggtgggctcacacctgtaatcccagcactttgggaggccgaggtgggtggatcacttgaggtcaggagttggagacaagcttggtcaacatggcaaaaccccatctctacaaaacttagccaggcatggtggcacgcacctgtaatcccagctactcaggaagctgaggcatgagaattacttgaacccgggaggcggaggttgcagtgagctgagatcatgccactgcattccagcctgggtgacagagacactccgtctcaaaaaaaaaaaaaaaaaaattcataattctacacaggcatacttaaaaagggcactttttaaaagtttctttctgtcaattccaggttggaagtgtatcctcccttcttattttttctagctgttggaggtgtttaccacccggtaagttttccaggaggtgttcatctatttggatagtagttcactgagctattatcagggacagaagaaggaaataaacatttaatgaatatcttcagtgtctaggcactgcatatttaaaaggattttattcaattatttcttacagagttctttaaaggagatgggattttcctcatattttacagataaggaaaagcctctcatatactatttaaacttcacaaggtcaaatagctacagagtagaaggattagaatttgaactcaggtctgtctggttctaagtttcatgtctataagagttcatttgttatagtaattcattcacacaacaaactttcactcaccacctggggtaaagcagtgatcaaagcagacaaagacccctggtttcatagagcttgcctttttgttgtggggtgtggggtggtcacagagaagaagcaacctaagtaaattacatcatgtgttaggaggtggtgagtgcagagaagaaaacaaagtggggaaggtggaaaggggatgtggagtgggataattttgaatagggtggtcagggaggggggctttgctgagatgatagttaagcaagtataaaaggaggtgagggagcaggtgctgcacgagtttccccaacctccagccagaagacaagcaaggcctgaggcaggcacctgtctggtttgtttggtgagcagtgagaagccaatggagccaggagaggggcagcaacagagggcagaggggtgatgaggcaggtcactggggacttgcaggcctctgcagtatagatagccctgtgggatggagatttagtctgcacttaaacatatctaaataaagcaagtttatcagcctctaattaattgccatttgggtcttgtcttagacagaagtgttccccttttctgaggacagattatctcctgaaaccaagttctgaccagagtggcccttcagacttctggttctaagcctttcctaaccatctggttcatcctgaatgccttgtacttttgttaaaaagctgccagaatggcatatctactgcttatgaccttgaaggcctgcatttttttcaaagaaacatctactgctcttgtatctcttagaaaatgtatctttctggtgcctctaaagatccccattcctagcaagtgactagactagctgatctgaatagctcaggtctctagattagtcctcatttggtgtccccactccatccccattcctatcacacatccctggatcccattccttatgggtagttctgaaaaataagagctagtttggggacaagcacctaacaattgttcctaggttgccagtcattaggcaacattatagtaaagaagggcctggcagagactagagctgctatatcgtgacttgagggactggtgttattttcatttgtttcaccctcctgttgacatttaatgttacccaaaatcaactcaaacaaacaaaaaccctgatgcagtaaccttatccctaacagtagcactgctgagtgggaaagacactggggaaggcggccttctcacatgctgtcttctgtgttctctccttgcttattttaaccaaggaagtcaccccagcatgacagccaaagggatggatttttcatctaagtttttattctctcttctcaaggacattgggaacagggagacttttccctcgaagaccatgtattctgggagaagcgctccccttctttctagtggagctacacccccagtgtagcctgcagaaccacctgagcccagccctgccagtgactgacttcacatagaacagcagctgagtcttcagtcaatctcatgctcagaggcccatttgagaaaacggcatttcccctagtcctgactttggggcagttctcttttctggcctgccctgagaccggctggcccacatgtccttctcttgagctctgacacaagttccccaagatgcccagggcaagtggggggattccttctatcccacctgtctaggagaaggccaatactcatctcccaggtccacaagccaagccattcatagaagaatcacagatattttattttcccgctgaaactaacttaattctacctaatttgcgtggggagtagttggccaaatcatcaaattgttaactttttgctaacatattgtgtaatcaaccctaggtgttaaaaaaggtttgcttgtttctttcatgcaaatactaatgtagcccttttttcttagcgtatagcttctggcctgggcttggcctggattgttggacgagttctttatgcttatggctattacacgggaggttagtatatattgacatttgccaaggaaacaactttaaaattttaaatcctatgctggccaggcacagtggcttacacctgtaatcccagcactttgggaggcgaaggcaggcagattgcttgagctcaggagttggataccagcctgggcaacatggtgaaaccctgtctctacaaaaaatacaaaaattagccggatgtggtggtgcacacctgtagtcccagctacttgggaggctgaggcgggaggattgcttcagcccagaagtttcaggctgctgtgaaccatgattacactactacactccagcctgggagacagagcaagatcctatctcaaaaaaaaataaaatcttatgctactatattttttttcttgggaatttgagaaaaggggaagtcacctgatatttaggtgaaaggtctgttttctttttattaatctttcaattgtaacgaaacttatttttattgagcattttctatgtgccaaccactactctaagaactttgcatatgttatttaaccttacaacaattctgtaatacagatattattgcattttacaaattaggaaactgggactcagcatgattaaagctgtaggtcacagagctactaagcgtaaactagtaaactaggaatcaaacccatgcagtccgactccagagcctcaccattactatacctcctatatctgagtaaggaggaggaaaagccatttttagctgtacttctttgaaacagagggaactccttccaaaggtcctagagcaaagttgctgtaattattatcccataattttctaagatccaagcaatactactgtggcacgttacttggcatgtggtatctgacttgccaacagcttcaggctaaagagttagttaacctcctaaggccagtttgtctaatgtacaacctcagatgcgatgatagaatggcttgcgaatgttgaaagcatcataattctggagcactcctggtaacttctgttctttcttctttttcagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaactcctgactcttaccactcatttccgtttgagtctgtatctgaaatcagtagcctagtcctactagatgagaaaggagccacaagtattgtgccctctcctcacccttccagcagatgcttctgtagtatgtgaggttgagaaaaagtctgattgtggtgatgtaggtatagtcatgccacagtgatgaaaaattaaagaaaaatcttctagctctcaggatatgcattatcacttgctacagatactccaaggccaaaggaatgcttgagcctaaaagttcaagaccagcctgggcaacatagcaaaaccccatctctacaaaaaaatatacaacagttagccaggcatgatggcacatgtctgcagtcccagctacttgggaggctaaggtgggaggatcacttgagcccagggtgtcaaggctgcagtgagttatgatcacactgctgcactccagcgtgggtgacagagcaagaccctgtctcaaataaataaaaattaagtttctattaaagattgtttctgttgcttaaaaactgaagcaatagactaaatgtaagatgaaggttaacagagatgaatgtaacttgctacatttagaaacaaagatctgattgcctacgtacaaatgaggaagacttagaagatttcagttggtttagagaacactgccaagttggcagaatgagatagttactccaaaacactgatgtggccataaactaccttaataggaaatatagtgtctagacctgcgctgcccaattggccacatgtggccatctaaatttaaattaatttaaataaaaaagcagttcttcagttgcactacccatttttcaaatgctcaatagcctgtgaggatgagagacagtatttgaacccagtcctgactctaaaatccatgcattttccattgtaccagtttattgcttaagctccgaagatgaagcatttaaggatagaatgccatggccagccattgaagatggtcagccttggccaaatggccacctggagcccttggggcatttgatgaggaggctggaccagtttagcacacactccagtgttagttcatgagaaagtttcaccagtggagagcaaaataaggaaaatgagggactgtttttcataaagctttgacttgtactttttacattaaaatgttctttatgaaatgatggtgacgatgaatggtagggatttttggtcctggcttgaaaaaatgatataattgagaatttacaataagacagggttttggtttttgcttcataagaaacacatctagagaggccagagaacttgccgaggtttcctttctcactgcagagaacagcaggcatcagtgaagcagggcagggaagacctggagatgaagctggcttttcacctttaaaagtcttaacagggtgtacttttcaaactacagatggtccccaacttatgacagttcaacttaacaatttttcaacattacgatggtgcaaaagcaagactcaggctgagcatggtggctcatggctgtaatcccagctctttgggaggctgaggcgggcagatcacctgaggtcaggagttcgagactaacctggccaaaatgatgaaaccccatctctactaaagatacaaaaattagctgggtatggtggtgcatgcctgtaatcccagctacttgggaggctgagtcaggggaatcgcttgaacccaggaggcggaacatgtagtgagccgagatcacaccactgcactccagtgtgagtgacagagcaagactgtctcaaaaaaaaaaaaaaaaaaaagcaatattcattcagtagaaatcgtactttgagtaccaatacaatcattctgtttttgactttcagtattcaataagtcatatgagatattcaacacttcattataaaagaggctttgtgtcagatggttttgctcaactgtcggctaatgtaagtgttcggagcatgtttaaggtcactaggctaagctatgatgttcagtaggttaggtgtatgaaatgcaatttcaacttacaatattttcaacgtgtgctgggtttctcaggatgtagccccatcataagttgagcatccgtaatgtgatcccagtttgtcattttgctattgcgcactgggttcagatggagttttgtaaggaagctcggtacataaagggcgctgtggttgaagtgcagaaccgagagctctgcctttcagtgccctacttccccactcactgcacttccagggaaccctagggcttggcagaatccagttggtaaagactgcttagagaataactcttacaagctagtcccttgtcttgtggagaaaaacttggcataagtatttctaccattaactatttaatactaatctgttggcagtgtacattccaaagagtccatttatttgtataagggaaacacattctgaattttgctagatgaaaatcagacagccataccagcctataaatgcctaattgatccatagtgaaccttaagtattcccaccttcaggtgcctgtgtgcccttgggcaagcttattagcctccctaagcctcagcttacacagctgtaagttgggaatatgaaaatacttttatcatataaagttcatgaggatcaaacaataatgcatgcacagtgcctaccaggggtcttgtagccacacaaattgtggtaggaagcacgagagccaactgctgatgtagcttgttcagcaaaagtcagcaaccgggttatcttctttatgttctaaggacccacagagtttgcccagctttctatttcatccctaatagcactcgcctccaaaggtgctctcctaacttaataaaaaactgagtagtctcagttccttccctcttaagcagcactatccaacagaaccttctgacatgatggaaatattctgtctgcactgtccaataaagtataacccctacccatgtgtggctgagctgaatgtggctacagcaactgatgagttgaatttttaattaatttaaatgtaagtatatacatatggctaaggctactatacttggatagcacagctcttaaagcagcagttttcaaccttggctgtctgttaagctcatctgggtgccttttaggagtccaggccgggtgcggtggttcatgcctgtaatctcagcactttgggaggctgaggcaggtggatcacctgaggtcaggagttccagaccagcctgacgaacatagaaaaaccttgtctctactaaaaatacaaaatatacaaaattagctgggtgtgggggcgcatgcctgtaatcccagctactcgggaggctgagacaggaaaatcgcttgaatccaggaggcggaggttgcagtgagccgccaatgtgccattgcactccagcctgggcaacaagagggaaaagagagaaactccatctcaaaaaaaaaaaaaaaaaaaaaaaatccagatgcccagatcaattaaatgagaatcttggtatttttaaagctctcactgggcaattctaatgtgcagtgaaagtggagaaccattgctgtaaaagcagtgcttgagagactcttgtgcttatgagtcacctgaggatcttattaaaatgcagattcagattcataggtctgaggagggaattgagagtcttcatttctgtttttggagacaaggtctcaccctgttgcccaagctgagtgcagtggcatgatcctagctcactacaactcaaactcctgggctcaagtgttcctcctgcctcagcctcccgagtagctgggactacacatgggccgccacactcctttttttttatttgtagagatggggtcttactatgttgcccaggctggtctcaaactcctagcctcaagcaattctcccaccttggcctcccaaactgctgagattataggtgtgggccctaaatgtcctttaagtgttcttctaagagggaggcaaagggaagtttgactacacagagaagaaggcagcagggcagggagagattctgaagatgctaagctgctggcatctaagaggaaggggacacgagcgaaagaatgcaaggaatgccgctctagaagctggaaaaggattctctcctacagcctcttcaaggagtgtggccctgacaacttcttggttttggccaagtgaaaccattttgggacttctgacttccagaactgtaagataataagtttgtgttgttttaagctgctaagttggtggtaatttgttacagcaagcataggaaactaatatactgggttcagttctaggaaacagagagggtagcagaaagcacaggaattggagactcacacctggcttgaagttgccagtcaacttatagacttgctgatgtggaagacaaactgtttttcctctgctctcatacaacaatcaacacagaagacttctgtgaccaaatgttggagttttctgttcacacaccaagcaggcaaatcagttctgcagtggacaccagctgggcatcctccagttcaattctgacactatctacctggagatagcatcagatcccacaggttgagggctcagtcccacaagactgcccgtgaccccaaccaactgcaagtccaggcttctggaacttgatcaactggcttcaagttgagggtcggttaattcgctacagtgactcacagaactgagacatgcatttactagtttattaaaaagaatatcctaggccaggtgcagtggctcatgcctgtaatcccagtgctttgggaggctgaggttggaggatcacttgagcccaggagttcaagactagcctgggcaaaatggtgaaaccctttctctacagaaaacacaaaaattagctaggcctggtggcacatgcctgtagtcccagctactggggaggctgagaggtgggaggttcactcgaacccaggaaggtcgaggctgcagtgagctatgatcacaccactctactttagttcagtgacatgacagagcgagaccccagatgatggagtgagaccctgtttctggggaaaaaaaaaaagagtattttaaaggacacaaataaacaactaaatgaagggatacatacggccaggtctgcaagggtcccaagcacaggagcctctgttcccgtggagttggggtgcaccaccttcctggcacatgcacatgttcttattcaccctcctataaacctccacatgttcagctctccaggagctccctgaagcccgtcctcttgggcctcttagacttcattagagaggcatgactgaagcacagacaccatgtagaaatgtgactggactaaaggggtatgatctaatacaaaggaggctgagcggggaaacccagcaagggtcttcagattcctggcttgtgcagcatttttcctgcagggcagcaggcaggaccccttctgaaatgaaggtcttatgacccataatcagaaaagtggtggaagattagagcccagccttgggcaggtaaaaaggagggcagaaggtcagagagggacattctgttttctgaggcctaaagtgccccaacattgtaacaaaaaaccgtaccaagggacttatgagccaggaaccatggatgaaaagatacataattttatatataggcataaaatatcacacttgcctgggaccaagatgtctccaaatctgtttcttcatttgaaaatcagagataatccctttcttaggcttagtgtattaaatgagaaggaatgtagcagtaggaacagtgagtacttaaatgttgcttccctttcccctgctgttttctcttgcagaggtgtccaatcgtttggcttccctgggccacactggaagaagaagaattgtcttgggccacacataaaatacactaacattaacgacagtcgatgagctaaaagaaaaaaatattgccaaaaaaaaaaaaaacccacgttttaagaaagtttacaaatttgtgtttggctgcattcaaagctgtcctgggctgcatatggactgtgggctgcggattggacaagcttgctttagagggactatcagaaacttatcttctcccaggcagctcctactgcttaaggtgcataggatccccttggacacagggtaacgctattggctttgtccagtatcacatatgtgtcctctgtgcaaagaaatacca

SEQ ID NO: 582 - DNA, 89189 bp, Homo sapiens
aatgcttattcattcttcaagattcagctcaaaattcacttttctctgtgaattcgtatgtcactccatctaccacacagcctctctcagcttcctcaggtagaatgagtcattttattttttgtactaatagttttccttgtctggacttatttcactacatctttgatacttcactgcatttagcatttatctccccctcttgattgcatggaaagagaaagcagaggcatatcttatatgctcaatacccactatagtgcctggaaaatacctagttctcaataagcatttttaaagaaatggtaaaggagttggaaacttgaaaagtgggccttgaaaggtgagtgaaataatatcatattataaaaaatagggttgaaggtgctccagagagaaagagggaaagaacagttgtaaaaattgtgcactccataattctaggaagtgccatgtatatggtgttatggagtgaatgtttgtgtcccacccaaattcatatgttgaagccctaaccctcaatgtaacagtgtttggaggcagggtctttggaaggtattgggattagataaagtcatggggatagggccctcacagtgggattagtgttcttctaaatggagatgccagagaacttgagggtgtacatgctttcaccctctctctcttttttcctgtccatgtgagaaaacagaaaacagccatatgaaagccaagaagagagtcctcaccaggcaccttgaacttgcacttcccagactccagaaatgtaagaagtaaatgtatgttggttaagccactcagtctatagtgttttgttatggcagcacaagcagataaagacatgtgagggttgtgatttgaacattgagcttctttggtaattttaactcataagttatttttccatcctatgcaaccctctcatgcctttcccctcatgtctatatgtcatccaaattgaaagcatctggatgcccaggattgagtctgattataaattgtgccccctacagttgagcagctcacaatctatataccacacatggcactcctattgtgagtctgctccaaagttgcaatatatacagccaggttagtgtcattgggagatcatttgagttttataagggttagagagtgggaatacaaattcaaaggcataggtcataaatagaaatcagaagtgaaaatgacattttctgaactttttttttctgtgttgtggatggtagtctgaaaagaatacttcttaagttacctaagtgatgcctacccttcataaatttcattcattcacagatgtgcttgtaaccatatttggcaaattattcaaggagctgaataataaattttctccaattaaaataatagcttgctcccaggtgatttataaataactataccttatctgacccaactggtttgcattcttttagcaaatatgaatgagatttggctgacattttccccacctcctaaggtttctgtggctttactagataactcaaacattttatctggtcagctcctaataaggaaaaaaatgtgtaaatgagacactaaacattttgctggtagggttattagcccatctcctttttaaaatacacagttgttccagacacaaacaataccctccttattgggacagagcagtgtttttactgtagcaattactcactggcataagaagaagcatgaagcacagaacccagagccatgggattcttccctatagccagagacatacattagaggtgacttcattcaatattttcattttgcagactagaaaacaggtgtgagagttaaagtgacttgactaaaatctctgttgactatgtcttattttctgtattcttgatgctcttgcatttaaggccttgatcctggagagactgttccaccgagggctagctaattcctagagaaagcaaactccccagcatatgtgccttggatatttaaacctaccaatccagaacccacatccccaactctatgttttatcaaactctcacatgccaaaccaatattccccctgtcctaaatcacctcaggaccacctacctgacagctaggcaccactactacagcccacaacttaccaaaattactcaaactatccaatcttaaagtgtttccttgcccattcattcctgagaaaacaccagtaaaggctctgggcaatgctctcccctctcttccttctgccttctgactggtctaggtgttctttcctgtggccctgcatggcatggtgtatctcttatttttaggaatttgttagtatacttctttctcatgacaatcatttccatgtctgctgtcttaccataatctgaggtacattttgaataaggtcaaatgggttagttgtaaaagttaaatgggtaggaccagagactccagatcgctagacctctatgctgtcgactactcccatgtagcatcatctcctgcagtcctgaaaggaataaagaccagggattgcatctctggagagaaccaaatttgcttacaaagataaattgctcttagaaaataattttttaagttctatgcaaatatagtatattacaactgtttgtggggctatctaaagaaatctaggaaatatttacaagtgtacacatatatgaaaaggggttaataaaaaattgggctggaactagagaagggcacctcagtttgcccatctgtatttatttcttagctaatgggtgtctgtgtaaggcatggtgctaagcatagctgcaaacagaaggtcaatggatccagttactttctatgggggctttcagcttagataacacatatgcatctctccaacatagcagggccagaggggtttaagagaaaagacactacaggattcagtggggaaaaaaattctggttgggacaatcaaagaaagttctatgttcatttttatgcactctagggttggttatggggcctggagacatgttatttgagattggctacatattaattttcttatcttatcatcaaagtaggaccatgcaactattatgttattactaaatccatttaatatatgaagagaaacagggaattaaagattttaaatgcctagaatttaaaaatcacagttattactaacaaaacaagcttcagttttccgacttctgatctactattcacctcatttggttttgtttttaaactattatttggaagacaaaagaataatcactaatctgcatgcatataaaattgaattgactgtcttttctagaatgatctctttccctcaataaattgaatgaatgaaccatttattttgacattatacagaatctgtcaaatctaactggaaaggcagacataaacttaaacatagcaattaaatagaagatctctattattaaactctaaagaattcacagctcctgttaactcattttttttcttaagactaagtctcactgtcactcaggctaaagtgcagtggcatgatcacagctcactgcagccttgacctccttacataagtagtatataactatttacaacttcatgaatatagagtcggcatatatgcacttggggtcacttcctctaatcgctcagagatgtttgaattcttgacacagttctttttctttgcctgaagagttcataaagggctgggcatggtggctcacacctgtaatcccagcactttgggagactgaagcaggaggctcgcttgagcccaagagttagagactaacctgagcaacataggcagaactcatctctattgagaaaaaaaaaaaaaaaaaaaaagccaggcctgttggtgcacatctataatcccagttacttgggaggctgaggtgggagtattgcttgaacccagaaggtcaaggctgcaatgagccacaattgcaccactgcactccagcctgggcaagagagagaccctctctttaaaaaggaaaaaataaaaataaaaaagagtacacacggaccttataactctgtagttaattcaatttgtggaagccagaaaatgaatttacctgttgagaagacagattactgagaaaataaataaaactactgacaatccatcctacaaaagtatttttttaattctaaagttttcattattaatgaaattcatacatctgttatttggatgtttctcctccaacgataacagaaaattcaaaatcctctagggagttaggcatctaaatttcccatgaacttttccttctgaaagtagaattaatcaagtcagacaatgaggaagaaaaataatcactctacagctcagtctaaatatgcagagccagacctgaccagaggccttggtctttcccattccttggggttttttaaagctttttaaaatagatacagctttgttgaggtataatttaaatattttatccactgtaagtatacaatgcaatgatttttagtagagttatagttttgcattatcattaccatccagttttaggacatttgttattgcctccaaattttcctaaagcccatttgcagtgcaccataccctctgtctccaatcaagcacttctttctgcctctataaatttgcctttactggccattttataaaaatggaaccatagaatacatagtcttttgtatctggcacccttgacataatatttttaagggtaattaattgttttggactgcatgtttgtgtttcctgcaaactaacccccaatggaatggtactaaaaggtggggcctttggcagctacttagatttagatgatgtcatgaaggtagagcccccatgatggaatcagtgttcttaataacgaaaaagagaaagagactcgggctcgctgtctctgccatgtaaggatactagttgatggccatctgcaaaccagtaagaaggccctcaccagatagagaatctgctggcatcctgatcttgaactctgcagcctacagaaccatgagaaataaatttctgtggtttaggccacccagcctatggtatcttattaaatcagccccaattgacatcaatgttgtagcatgtgtcactcttttacttttcattcctgagtagtattttgttgtttggacacaccacatgttaatcactcaccagttgatggacatttggattgtttctagttttagcctattatgaatactgctgctatgaacatttgcatttaagtccctttgtgggcatatgttttcgtttctcttgcttagattcctgggagtagaattgctgggtcatatggtaaatttatgtttaatgtttttaagacactgcccaactgttttccaaagtgactgcagcattttatattttcatcagcaatgaatgagagttccatctgctccatttcctcaacaatgctttgtattgtcttatttatttttttattttcctaccttccttcccttccttccctttgttccttccttcctctctctctgtctccctctctctctctttttctttttttcttaggtgaagtctcactctgtcacccaggctgaggtgtctgtgtttattattatagacattcttgtgggtgtatggtggtatcttggtgtggttttaattttattttccctaatgactaataatgaggattacattttctttcatatatcttttttggtaaaatgtctatgcctaccttttgcctatgttttagattgtttaccttctttatattgagttataaagatatgtatgctggatacaagtccttttcagttttgtactttgcaaatatcttctgctagtgtgaagtttatcttttccttttcttcatggtatcctttgaggcacaaaagttctcaattttaatgaaataaaattcactaatttttttcttgtatggcttctgctttggtcatcttatgtacgaactttttggctaacccaaagtcacaaagatgtcctcctatgatttactcttgaattttatagatttaacttttatatttagctctatgactcattttagttaatttttgaatagaacataaggtaggggcctaagttttttttgttgtggtttatatttaattattccttcatcatttgttaaaaaagaagttatcctttcccctttgaattgtcttggcactgttgctgaaaattaactaaccatagatatatgggtttatttctgggctctcacttctgttccactgatctcaactctttttcattgatctatatacctatctttatgctagtaccacactatttttattactacagctttatgataagttttggaatttggtagtataaatcaccaattatttttctttataaaaattgacaggtcaggcacagtggctcacactcgtggttttgtttccattcattcacaatattttaaaatattccattgtgatttcttttttgaatcatgaggggtttttttcataagtatgtcatttgatttccatatacttgacattttcccagatttgtttctattatgatctccaatttaattttgttgtggtcagagaacatacttcatatgattaattttcttcaaaaaaaatgcattgagacgtatttagtggcccagtacatcatctatctgcagaattttccaaataaacttgaaaagaatgtgtattctgaactctttgggtggagcgttctataaatgtcagttatattaagttggttgatagcattgctcaaattttctttaccctagccaatttacggtctaggcattctatcaattattaagagtgggtattgaaatctccagctattattgttgtctatactttcaattcttagtttttttgcttcacatattctgggacactgtttttaggtgaaatacacttaaaattattatatcttcctgattatttgatcttttatttttatgaaatattctagtatattttaacttcagaacttccagttggttcttttatatgatttttatctctgctgaaattttctattcattcgatcattggggtcattgctatcatactttcctttaattatttaaacatcattttcattagttctgtgaatagtttctttgaagactttttcttctaaatctaacatataggaccactcagagacagtttatatgaactgttatttttcccagagtatgtatcacactttcttgtttctttctatctgtcttgtttattgaatataagacatttcagataatatattgtatatcagtatcttgggatctttattttctcctctgagatttgtagttaatgttttgcttgtttagtaacttgcctggactaaatttgggaaatctgattctctggaatgtatggttgataatgtctttgggttttttcttgtttttatagttaagcctggcttactaaggtcaccattgtgcctgcatagcttaatgtttagccaaagattggtcacagccagtaaggtgtctagtctttgctgatggatttgtgtgtgaattggcatggaaataaaaatacatttggtcttggcccctggttcctgacatagagctcctaaacccttaaaatttcctgagtgataggagtgcctttgtaatcataatgagcccattttgataatgacacctgagtgtatgctaatcaggtgacagagtgggactaccagatagcctcagaatagggctgattaccagagagacaagaaattagagggttggaactttcagccccacccactgacctcctgggaaaagagaagggagctggagattgaatctataaaactcttgagcaataagatacagagagcttctacgttggtgaatgcattcatacgccaaaagggtagcagaccccaagtttagggaaaagaagctcctgtgctaggatccctttcagaccttgtcctatgtaccttttcatctgcttatccatttgtatcatttacaataaactggcaggcaaatataagtagagtgttttcctgagctctgtgagctgttctagcaaattattgaacctggggatggatgtgggaactctcaatttataacttgtttgtcaggatacctggcctgaaacttgcaactggcatttgagttgggggcactctgtgggactgagccctttaagtgagggaactgaagctagctccaggtagatagtgtccaaattgaattgaattgttggacatcaagttgttgtgagaataagataattgaattggttagtgttaaaaaacacctcagagctagagatgcattcaaagttcaaggtggcctggtatcacttacaaggtgggtcacacttgtaatcccaacacttttggaggccaaggtggaaggatcgcttgagccaacgagttcaagaccagcctgggcaacatagggaaactccatctctacaaaaaatgaagagttagcggggcatggtagtgcacacctgcagtcctagctactcaggaggctgagttgggaagatcccttgagcctgggaggttgaggctgcagtgagctgtgatcatgccagtgcactccagactgtgagacagagcaaaaacctgtctcaaatacaaaaacaaaaaagtttaggctgttctcaagtcttctctggtttttattaacccctaacttttcacacatctcctctgtctttgtgcatggctctgtattctacggatgtatggtaggcttgagcccattccagtccctgctacccatggtctctgatcaacctaggacattcaataaatcttcttagtgcccccaggtttagctcatgtccaagatttcactgttaaatgtctggcaaatctgctagtccattgcatggtccccaaacagggctgtaacatcagcctagtgaagatgctgactcatcctgttcactcttaagcatatgagatcaacactttaaatgactaaagtccagattaagggggacaccttctagcagtggcagctaagttgttgattttcacagcctgtcctactctggttgaattactatgccaacaaagctgatatagtaattttcaagaataaatgtcaagactaaatgttattcagtttattggaaacttgggttatttccagagaactgaaatggttatttttttacatctcttttcagctttataattgctttttcaggagaggatatgttaatctccctacatcatggcagaaatagggctaatttgaataaagattactttaaagaaaatagatgctcaggatatataataagtaagggagggaggaagaaaggaagtaaggaaagaaataagtaaaattttcaaaccatgtatgtggaaattgtaagggctggttttgagggatagaattagatcaggccctcagagcctccaaatcctccaaatcaagaatgggtacacagatgcttaaatagctcgtaaaataagagtctacctcctgcattattctgtggcacattcttttttttttcagagtttcactcttgttgcccaagctggagtacaatggcgcgatcttggctcactgcaaccttcaccttccgggttcaagcaattctcctacctcagcctctggagtagctgggattacaggcatgcaccactatgcccagctaattttgtatttttagtaaagacggggtttctccatgttggtcaggctggtctcgaactcccgacctcaggtgatctgcctgccttggcctcccaaagtgctgggattacaggcatgagccaccgcacccagctatgtggcacattttaatccatcccaaccataaagaatttcctgcttcctgtagtattaaaaaaaataattactgagaggataaagatactcatgacaacatttactgggtacaatactctcagttatgagttgtttagatagatagatatttaaatttttttcataacgatgcttacgttcgtatatctaattgctataagtctgtaactaaaaccaagattatagtagatcaacaaatagaagttaaagataagtcaattttgtagatttgccttgacttttgtttgttggtttttatattacttaaacatttttaaaggttaatgaatggctgtccatgtccattactgtctgacctagaacatttaaattggctgtcttctgactctaagtctcttggccgtaagcatcccaacaagggacaagatgaatctgaggccagcagctatgccaccctggcaatgctacaagacaaaataaaaatttggtggccattaatgttgactctgacaaatcttggccagaaggggaagattgtaaaccaaaaataaaattccagccttttgaacctacccctcctctcggccaagggcattccaaaattaacctgagaaactagtacaggtcatgacaggaattgggagtcagacatgcttcattatatcctcctcccttttggacttcagaaaaagctgaccaggattaacatcaacaaagacctttagtctgataagaaacatttacaatctattgtctctgaagcctgctaccaggaggcttcatctgcatgataaattttggtctccacaactccttaccttaacacagacattcctttctattgattccaggtctttagataataacttaactctttcaaccaactgccaatcagaaaatctttaaatctacctatgacctggaacctcctgctttgagttgtcccacctttccagagaaaaccaatgtacattttacatgttttgattgatgcattatgtctctctaaaatgcataaaagcaagcagtgccccacccatcttgggcacatgtcaggacctcctgaaggctgtgtcacaagtgcatccttaaccttgccaaaataaactttctaaattgattgatacttgtatcagatactttttggttcacactattaatgacaactaaacccctggctcatcctttaaaatgtaggacatacaggggattaaggccttttgttttgggttaaatgggtgttgctaggtgaagaaagctaattgaaaatgttatataaactgggtgatttttataaatggtagtggttcttctgtccagcccataaccactgtacccttaataaagtccaacctagtaagtcctgtgtctcattcattgtctctgggtctcttctttggcctctgagacatggtgccatccctctttgaatcaacgggggtccaacatgagaggaacacaaatagataattcaaagaaatcaaggaaacaattcatgatccaaatgagaaattcaatgaaaagatagatatcactaaaacaccaatcagaaatcctggaactgaataattcaatgaatgaaattaaaaatataattgatagcttcaacaatagactagatcaagcaatagaaagaattcctaaagttgaagagagatcttttgaaataacccagacaaaaagaaaaaataaataaaatagagaaagcctacattctgaaattttaaacatttgcaaaaaaaatgcaaatgtttaaaatttcagaaaaagaagagatggaaaaggacatagaaaacctatttaataaaataacagtagaaaactttctgagtcttgcaaaaaatatagacatccagatacaggaagcttaaaaagtcccaaatagattaaatccaaaaaggtcctgtctgaggcacattatggtcaaaagtcaaagacaaagataaaattctaaaaacagcaagagaaaagcattaagttacatataaggggatctccatcagactaacagatttctcaccttacaggctgtgaaaagtgctgaaagaaaaaactgctggaaaaaagtactatacccaacaaatctatccttcagaaatggagaaataaaatttttctcagacaagtaaaaactgagaacattcatcattagactggccactaaaaatgcttaagggagatcattttcaggacctgaaaataaaagaatgatctctattatcatgaaaacacagaagtattaactcactggtagagcagatacacaaatgaaaagaagggtaaaaaatcaaatgttatcactaccaaatcacaaagacaaaaaattagagtaagaaaggaataagaaatatatcaaacaattagaaacaagttaacaaagtgacaggagtaagtcctcacctatcaataacaacctggaatgtaagtggtttaaattctccaattaaaagaaatagactggctgagtgaattaaaacacaaaactcaaatatatgctgcctacaagaaactcacttctcttgtaaatatacacatagactgaaagtgaaggaatagaaaaaaacatgtcatgcaaatggaaaccaaaagcacccaggagtggccatacttataccagataaaataaacttcaggttaaaagggacaaagaaggtcactatataatgataaagggggtaaatcagcaagacgctataacattttaaatacatgcatccagagatataaagcaaatattattcgagctaaagacagagctagaccctaatacaacaataattggggacttcaacagcccactttcagcatttgacagataatctagacagaagatcaacaaagaaacattagacttaaagtctactatagaccaaataaatttagtagacatttacagaactcttcctccaacagctgcagaatacacatccttctcatcagcacatggaacattatacaggatagaccatgttaggccaccaaacaaatattaacaaatacaagaaaatgaaataatatcaagtatcttcttggatcacaatggaataaaactagaaatcaataagaagaggaactctggaaactgtacaaataatagaaacagaaaaaaatatgcttctgaacaacaattgagtcaattaagagattaaaaagaaaattttaaaaatgtattgaaacaaatgaaaataaaagcacaacatataaaaacctatggggcatagcaaaagcagtcctaagaggaaagtttatagcactaaacaactacatcaaaaaaactgaaagatttcaaataaacaaggcacctcaagggatcagaaaagcaagaagcagccaaccccaaaatttgtagaagaaaagaaatagtaaattcagagcagagctaaacaaaacagggactttaaaacacaaaacaaaagataaataaaatgaaaaattggatttttgataagataaagaaaattgacaaaccattagcttgactgagaaagaaaagagaagacagaaataaaatcagaaatgaaaaaggagggattacaacttgataccagagaaatacaaatgatcattagagagtattatgaaaaaccacaccaacaaataagaaaacctagaaaaaataaataaattcctggatacatataacctaccaagattgaaccaggtagaaatagaaattctgaacagaacaataatgaataacaaagttgaatcagtaataaaaaatttcccttctccctgcaaaagtccaagactggatggctttactgatgaattctaccaaaggtttaaagaagaactaataccaattcttctcaaattattcccaaaaattgaaaaggagagaatacttcctaaatcattttaggaggccagcattatcctaataccaaaaccagacaggcacaaattaaaaaaaaacaagcctacaagccaatattcttgaggaacacagttgtaaaaatcctcaacaagttgctagcaaatgaaactcaataacatcaaaaagataatacatcagggccaagtggaatttatcccatggatgcaaggatgtttcaacatatgcaattcaatgaatgtgataaatcacatcaacaggatgaaggccaaaaccaatataatcatctcaatagatatgaaaaaaaatttcataaaattcaataacttttcatgttaaaaactctcaaaaattagctatagaaatcaaaaaaggaatctcatttgtaatagctttaaaaaataccaagaaatagatttaactgaagaagtgaaagatctctagaaggaaaactgtgaaacactgaggaaataaattaagagcacaaaaaaagtaaaaaaaacttcccatgatcatggactagatgaatcaacattgttaaaatgatcatactagcaaagcaatctatagattcaatgcaattcctacccaaagtaatctacacattcaatgcattcttcacaaaaataaaaaaaatcctaaaatttgtatagaactgaaaaagagcctgaatagccaaagcaatattgaacaaaaagaacaaaactggaaggatcacactatctgactttaaaatatactacaaaactgtgttagtacatttgcattagtataaagaaatacctgagactaggtaatatggtttggttctgcatccccacccaaatctaatcctgtagctctcattccgatgagttgtgggaggcagcaggtaggaaatgattgaatcatgggggtgggtctttcctgtgctgtccttggaatagtgaatgggtctcatgagacctgatggttttaaaaatgggagtttctctgcacaagtcctctctttgcctgctgtctgtcatccatgtaagatgtgacttgctcctccttgccttccaacatgattgtgaggcctccccagccatatggaactgtaagtccaataaacctctttcttttgtaaattgcccagtctcaggtatgtctttatcagcagcatgaaaatggactaatacattgggtaatttataaagaaaaaaaggtttattttggctcatggttctgcaggctgtacaggaagcatgatgctagcatctgcttctggtgagagcctcaggaagcttacaagcatggtacaaggcaaacaaggagctgcatatcacatagcaagagcaggagcaagagaaaagaggacgagggggccagccaggctcctttaaacaacctgctctcatgtaaactaatgcaagaactcacccatcacaaaagggatggcactaagccattcatgagggatccatccccatgagtcaacacctcccactagatcccacctccaacattggggatcatgtttcaacatgagatttgcagggggcacacaaccaaaccatatcaagaactatagtaaccaaaagatcatggcattagtataaaaacagatacattgactaatcgaacagcatggagaacccccaaataaatccatgtttgtacagtcaacttattttggacaaaggtatcattaacacacattgggaaaaggacagtgtcttcaataaatcatgctgggaaagctggatatccacacgcataagaatgaaactagacccctatttctaaccatatacaaaaatcaactctcagagtgaattaaagaattaaagacctgaaactataaaactactagaagaaaacaaaaggaaaatgctttagaatattgttgtaggcaaagatattatgggtgagacttcagaagtgcacgcgcgcgcacacacacacacacacacaaacaaaaatagacatataggactatatcacactaaaaagctctgtacagcaaagaaagccatctatggcatgaagagacaacttgtagaatgggagaaaatatttgcaaactattcatttgacaagcgactatcaatatccagaatatacgaacaactcaactcaacagcaaacaaacaaataaaaatctgattttaaaatagaaaaagatttgaataaacatttctcaaaggaagacatataaatgatcaacaagtatattttaaaatgttcaacattactaatcatcaggaaattaaaaccacaatgagatatcatctccccccagttaggataactatcatcaaaaaacaaaaatatgccagatgtggtggttcatgactgtaatcccagcactttgggaggctgaggcaggaggattgcttgaagccagaagttcaaaacaagcataggctaagtgagatcctgtctctatgaaaacattttttaaaaattagccaggcatgtttgcacttgcctgcagtctcagctacttaggagtccgaggtgggaaaatcacttgagcccaggagttcaaagctgcagtgagttatgatggtgccactgcactctagcctgggggagagaatgtgaccctcctgtctctaaataaacagataaataaataaaaattgaaatattatattttccaagaatcctactactagatgactgggtacatatccaaaggaaaggaaattagtatatcaaagagatacctgcacccccatgtttattgcagcactattcacaatagacaagatatggaaccaacctaaatgaccatctacagatgaattgaataagaaaatgcggtatatatacataatggaatactatccagccataaaaaaatgacctcctgtcattcatggcaacatggatgagactggagtacattatgttaagtgaaataagccaggcacagaaagacaaatgccacatattgtcactcatttgtggcaattaaaaaaatgagctcatagaactagagaatagaaatgtggttattagatcctgggaaggaaaatggggagaaaggaaagggggaggttggttaatggctaacaagttatagctaaatgggaggaataagttttagtgttctgtaacactgcagggagaatatgattaactatactttagtgtatgtgttcaaaatcctagaagacaggatttgaatgtttgaatgttcacaacacaaagaaatgataaatgttcaaggtgataaatatactaattatcctgatttgatcattacacattgtaaacgtgtatcaaaatatcactctgcagcccatgactatgtacaattatgtgtcacctaaaatggaataataattatctctttacttatgattatgataatagtacagattctgtgatgtgcaggctctaaggtatctcccctatcattcctgtatcctgatttcatacctccatgaaatttccactccgtgagtgtatgtagaatccagtgacttgcttctaaacaataagatatggcaatggtgatgggatgtcactctcataattacattatttaagacttgatcttccagcaggctcactctagagactctcctaattcatctagaggcttgatgaattaagctgccatgttgtgaaagctcaacattgcaaggaactgaagacagcctttaggagctgagggcagcctccagctaagagctaataagaagccaaagccctattttccataactgcaaggagatgaaactctgtcaataatgagtgtatttggaggtattctttttccaggcaagctttcagatgagaaagcagcctggccaacatcttgagcgcagtctttgagaccctaaacagaaaattcagctaagccatatccagactcctgaccaacacaaactatgagatcataaacgtgttatttaagttgctgtttatggtcacttgttatgtagcaataaaaaattaacacagcattccgcaatgggcttaaaaaatgtcacgatgtattttggatctttttctttatgattaaatagtagcttgaattcctgttttaagagaatctgacctataactcttttgttgttacataataagtgaaatccttggcccaacatttcacttaccggtttattcaccaactgtgcccattagatttgttagcccatctcttgttatcattcagcaactataggcctcattcataaagtccctatttgattctttttcatagctatctattcatgctcatggctacagagtcacctactctaagtcttaagatactgctcacttatttagatgtgcattttaaatgtttgttgtttcagtttcacagtgcagacactatttaaatatcttttttttcttactttgagcatatcttttccactgagattaccagcatataaaattcatgaatgcatataaaattcttaagtcttggtttctttctctcagaccctttatggactgctactatgttctcataatgaatagagctttagagaatcctggggccaaccctatgctttttgctttgtaggtaacttttgtttctgctgtgcaggtaatctatgtcttctggatgggcaagacatcaagtatctccaataggatctgtcttccctctttcctttcctcttaccctctccagctccctctctttgtccctccctctctcctcccctccctccccctcttcccctctctgtttcattatttctttcaagttcaagttatttcactaggatatgtcccatggtaaatgtattagtccgtttttatgctgctgataaagacatacccaagactgggtaatttataaagaaaaagaggtttaatggactcacagttccacgtgcctggggaggcctcacaatcatggtagcaggtaagaaagaatgagagccaagtgaaaggggaaaccccttataaaaccaccagatctcatgagacttactcactaccatgagaacagtatggggtaaactgccctcataattcaatcatctcccactgagtccctcccacaacacatgggaattatgagaattacaattcaagatgagatttggctggggtcactgccaaaccatatcagtaaattattctgtattaacttttcctttgacaagttcccaaggacaatcccctttaaagtattgatatgggctgggcacagtggctcatgcctgtaatcccagcactttgggaggccaagacaggtggatcacttgaggtcaggagttcgaacccagcctggccaacatggtgaaaccctgtctctactaaaattacaaaaattagctgggcgtggtggcaggcacttgtaatcccagctactcgggaggctgaggcattatttgaaccctggaggtggagactgcaccattgcactccagtctgggtgacagagcaaggctctgtctcaaaacaaaaacaaaaacaaaacaaaacaaaacaaacaacaacaaatatatatataaaaatatataaaaacatggttcagctctgtgtccccacacagatctcatgtggaatgtcaattcccagtgttggaggaggggcctggtgggaggtgattgaatcaggggagcgaacttaatccttgctgttctcttgatagagttctcaaggaatctggttgtttgaaagtttgtagcaccttccccttctctctctctctctctctcctgctcaggccatatgaagaccgtgcctacttcccctttgcctttgccatgggtaagtttcccagcgcctccccagaagcagaatcctgtacagcccacagaaccatgagccgattatatctcttttcttaataatattacccagtctcaggtatgtctttatagcagtgtgagaacagactcatacaagtatttaatttatgcacacacacacacacacacatgcacacagacacaccccactatatatatatatacagtcagtcctccatatccatgtgttccgcgtctggggattcaaccaaccatgaatcaaaaatatttggaaaaaaaacccccaataaaacaatgacaaaataatgcaaataaaaaaccagtacaacaattatttagacagcatttacattgtattaggtgttataagtaatctagaggtgatttaaaatatataagaagatgtgcataggttatgtgtaaatactgccattttacataagggacttgagcattagtagattttagtatcctcggggagtagggagtagggagagtcctggaaccaatctcccacagaaactgaggaagaccatacacatatatgaatagatcatgtaattacatatgtaaattaatttatgcacataatatacagtatacatgtatatgtaaagtctctcattattttttcctattttatctttttcttattatttatatttgatgtcattcgtctattttataaaatgattatctccctaatctcattttccttttattgtttcttgttttattttatggtattttatcaagcatactctttttatcaatgatcatattttcaaaaacaatttggatactttctgatgcttcttccctgactttctttttggtaatgttttatttttatcttccatttttttctgtaatctctgccagctcaatactcattgtctttaacttcttatttttagctcatatttgcagtaccatatgcaaattctttggaacatctagaaaaaaaaattttaagtttttgttcctttgagaggggataatgttattctatcctttactttcattcctttcttcagagtaattatacatattccctgtgctgtttatagcttatctttgaacaggaaatatattttgtgaaagcaaagtgtgtgaagtggggtcaatctgagaaagataaaagcttaaatgtaggtactatttcagaacactttttcacaagatcttcattgttcctctgctctcggaacatatctctcagttttcatttatttcctgtgcaataagtaaaaaattagtaatattgttcatactgaaactatgtatgccaaagttttcctatggagaaattttctgatttttggtcaacaactgcaaaattgtttgtgtttcccttcttacctttactttgccttaacactagacagtttctctatgtagaatgctaggacaaagaaaacagcagaacagttccccctttgagccttactctccttatagcctttatctggaaactgggctttgtagagatactcccaggccttcacctattcccccacccctactactcatgctccttcatacactcacattcctggctctcactggttcattaaagaatcaccatgagcttttaggaccatgccattcatttcctaagtaaatttatacactggcagatgtctaaaataatggttatccactctcagcctgtggaatggacttgtttggcccatgccattggattgtatgttacaactggtggctaaaagcatgaagtttctgagataaacttattagtccttttgggccaaaggtccacctgccaaatttcttctatatgctttctggatgggtaagacattatgtttctctttaatatgactcctccaatactacctaaattaacagaatattcattcaacctatttacatctttgggtaattctactggtggtgtcatatttgggcagccactttgcatgaactttattacatttcaccacagctttctcattaatttgtcctaatgttccagcattgagtggattgcctttatattttaaggtttccttacagacttttcttcagttatgctacaatttagttgtaatttgcactgcattccctgaagggagacctttagtctgtcattgtaacttggaagtcccaaaactgatttttaatatttctaataatctcgatagttgagcatattgtaaaacatacagccagaaaacgtattaattttttttctagaaattagataaatttaaaagcacacaacagtttttacaaggcctttcttgaccctggtacttttcacttttttttttttcaggtaatggatactgtagaacctacaaatttagatccaaaaaagtactgaacataaagctctgaagttacattcaataattctctattgtatttaaacaaaaagatataataatctgccaatggacttcaggtagttgggagagagtagagagggaagagtttaagacaaagttttgacaatgtggtatactggaaagagctctggattgggagtcactgtcagtcatctgttgttccactgtgcaacgtgttgtgcagcacatggttctgcaagattaccaaacatgcccctatgatcaaatccaactatgattttcaaaatctttttggacctctccgaagcatttgatgttaactactcacttcttgaaattcaattctctccttcagcataaatacaaatgctctattgattctttttttcctctctgatcatttctcaataagtatgtgtttgtgtatgttttacaggcttttagcagggtcaatagtcttcattattataaccttttagtgatctcattcactctcatcatttcaactaagttgctgactcccatatatatcaccctagtcttactctatcaggaactttagcctcacatgtccttctgcacatatcaacttggatgacacacaggtatctcaaactcactgtgttcaaatggaatttattgttttattacaaatgcaatctattttgctccaatacttaggcaacaccatctgtactcaattagaaacctaaaagtaataatagactcctctgacaattctcatctttctcgaatcttccccttcttggtatatgttggtatattccagtatgaccactgttctagatcatggcctcatcacctctttcctgggctaccctagttacttcctaagcagtcaccttttctccatattgcaaccagaatatcaaataaattcacatttatattctcagttttgaaatcctttgaatgtcatatattacttttctacagaataaaacccaagtgcctgtcaatgttgccctgtaagacttagttcctacctagcaaagctcttgccacttcctgcctccacccttttctgcttgtttgttcatatatacacaatacccctacacctttgctcctgcagttatctttctctgaaatgcccttcctacctttcttggtgtgtccaactcatgtgccacctcctccagaaaggattttcagaaatagcaaatcagatactttgtatactctatcattgtactataataccatactaagttttcaaatctagagaacgcatgaaatgaatggctgtctaatgagacagtaagatcaaaggtaggattcacctttttaaatatctttgttccctgaatttctaagaacctgtcacatagtaagtgctcaatatatttctgttccattaaactgaattgtgatattgactatgacccaaactaatctgactttgaaaaagtcaatctttctgaatcttatattttatagtttaaaatgctatgtttgggttaatttatcttttaggtcccttcctgatataaaattctgattatataatttcattatcttctagctcagtgcaactatacgccatctcatattgatacaggagctagaaattatttaggcagatagtgagggtaagagagccctcggtaaggcttccattttataaaaagcagcccccaaataatttcttttctaacaaaaagcagcctgaaaaatcaagctgcaagcataggtaagcaagctaaaagcctgcataggtaaatgctggcagctatgccaatagaaaagggatacttggaagccaggaatattcaacatggaggttccctcttccattttctttgttgccacatgtacagtaaaaaagcaggcaacatgagacccctatctttataataaaagattagggtgggatagccagcttctttgtacgctatgcaaacagcacacctggactgaccaatctctcatgccctgtgtaaatcagacaccacctcctcaggctcctctataaaaccccacgcatttcaccacaaagcagaagacacacctgggagcacttctctcactgcaggagagagagcttttctcttttctttcgcctattaaacctctgctcttaaagtcactccttgtttgtgtccacgtcctcgatttccttggtgtgaggcaacaaaccttgggtattaccccacacaaatgacgcctcttcaatatttaatcttacaaacaatatctgaccattgttgctttctgtataattcttgccaaaactattgcataacatttcttcattgtttactaagccatctcagtgtgtttatagagaagtttctttagagtaatctaattatgcctttatttgttgccagcaggggtttatttattctcttataataaaccccacattaatatcacattttctctctcatggcaaccagcccatatttagggatcttgtccagaagacatgtgcagctcataccaaaaaaaaaaaaaaaaatgaatatttcaaagatctcacactttagggcttccatagttagaagaaaaaagatcagatttcaaatatcagaaaacgtgcttctcttgattcctctttcatatcttcactaaatagaggatacatttgatattatatgagatcaaccagtctaaagtattttatttataacacaatcctaaacttggtggttataataagaaatattatttgaagtaaattctttggatttagcatgagagagaaaaaggccaacattatttgtaaatgccaactacaggagtttaataatttaaaataacagaacagtttagtcaaactgttctcctactacatagactttactggtttaattaactgaatcaaaagattttgtttatatcatgtgaatccccagtactgcagatagtttcatcatttcagggcatccattctaagaaagatacataagcccacttattaaaaaaaaaaaaaaggttctctgtagaatcataaaaactctctgctacttcatgtcaaatctctaatgaagcttccttattttatttaatgtgttgtgaagttttgcgtttgcaaaaattgtaacagtgagaaaattatggcggcgggcaggggggtatctatctagccaaccccatcatgcctttacccttcaagctgcccttaagtattcctgggtttatggcaagctaactttgggagccatttagtttatagtttaagtggtaatagtacttaccccaaactcaaccacctttgtgaagttaatgacagactaccaggctaggaagggagaggagccagaattctgctaatgtgtagatataaatgacagccggccatgattctagaggtcacaagatatgcaacttccccaattacttcagcaggtaacatcactattatagaatctaagattggccttttgagatagcatttcagtttttttgcatgtctgacaaccgatagttccatctggatgcaccaaccactcctgtggccccacccagaagtggctcagtgaaagaggccagcttagactccctatgatttcatctctgacccaaccaatcagcactccccatagcctagccacttgctcaccaagctgtctttgaaaaactctccaagtctttgaggagattgatttgagtaataactccatttcctgagcggtgtggccagacttgtgttaattaaatttttcttcactgcaatgacatgatctctgtggcaattgattctgtttgtgcagtgggcaggaagaactcgttgggataaaaggcatagatgtgccaatataattacttttcaagcccaaatagaaatgattttttttttaattttcaacttttaagttcaggggtacatatgaaggatgtgcagccttgttacacaggtaaacatgtgccatgatggtttgctgcacagatcatcccatcacccaggtattaagccgagcatccattagctactctaccttatcttctctctcttctaccccccaccctctgacaggccccagtgtgtactgttctccaacatatatccatgcattctcatcatttagctcccacttgtaagtgagaacatgtggtatttggttttctgttcttgcgttagtttactaagaataatggcctccaactccatccatgtccctgcaaaagacatgatctcattccttttcatggctgcatagtattccgtggtgtatatgtaccacattttctttatccagtctatcattgatgggcatttaggttgattccatgtttttgctattgtgaatagtgatgcaatgaacacacacatgcatgcatctttataatagaatgatttatattcctttgggtatataccagtaatgggattgctgggtcaaatggtatttatgcctctaggtctttaagaagtcaccacactgttttctaccatggttgaactaatttacactcccaagaacaatgtaaaagcatttgtttttctccacaacctcaccaacatctgctgttttttggctttttagtaatagccatcctgactggtgtgagatggtatctcaatgtgcttttgattggcatttctctaatgatcagtggtattgagcttttcttcatgtgtttgttggctgcatgtatgtcttcttttgagatgtttttgttcatgtcctttgctcactttttaatggggttttttggttttctggtaaatttgtttaagttccttatggatgctggatattagacctttgtcgaatggatagattgcaaaaattttctcctattctgtaggttgtctgtttactctgttgatagtttcctttgctgtgcagaagctctttagtttaattagatcccatttgtcaatttttgctttgttgtaattgcttttggtgtcttcatcaagaaatctttgccactgtctatgcctgaatggtattgcctgggttgtcttctacggtttttatagtttggagttttacatttaagtctttaatccatctcaggttgagttttgtatgtggtgtaagcaaggtgtatttgttcattttcacactgctataaagaactacctaagactgggtatttataaataaaagaggcttaattgactcacagttccacatgactgggaagtcctcaggaaacttacaatcattccagaagatgaaggagaagcaaggcacatctgacatggtggcaggagaaagagcgaggggaggaagtgccacacttttaaactatcagatcttgtgagaactcactatcatgataacagcaaaggggaaactgtccccatgatccagtaacctcccaccaggtcccttccttgacacttaggggttaaaatttgaattacaatttgagatgagatttgggtggggacacagagacaaaccatatcattctgcccctggcccctcccaaatctcatgtccttttcacatttcaaaacacaattatgccttcccaacagcctgccaaagtcttaactcattccagcattaacccaaaagtctaagtccaaagtctcatcagagataagggaagtcccttccaactacgagcctgtaaaatcaaaaacaaattagctacttccaagatacaatggaggtacagacattgggtaaatgtttctgttccaaataggtaaaactggccaaaacaaaggggccacaggcactttgtttataagtctgaaacctggcagggcactcattaaagcttaaagctccaaaataatctcctttggctccatgtctcacatccagggcacagtgatacaaggagtggcctcccaaggccttgggcagctctgcctctgtggctctgcagagtatagcccccacagctgctttccatgggctggcattgagtgcctgtggctttttcaggtgtacagggcaagatgtcagtggatctaccattctgggggctggaggatggtggccttcttttcacagctccactaggcagtgccccagtggggactctgtgtggggactccaaccccccatttcctttctgcattgccctagtagaggttctccatgagggctgcccctgcagcagacttctgtcaggatatccaggtgtttccatacatcctttgaaatctaggcagaggctcccaaagctcagctcttgtcttctgtgtacccacaggcccaacaccacatgggagctgccaaagtctggggcttacgccgttacgccatctgaaacatggcccaagctgtaccttggaccattttagtcatgactggagctggagcagccgggatgcagggcaccaagtcctgagactgcacagaacagcaggcctctgggcctggcccatgaaaccatttttctctcttagacttctgggtctgtgatgggaggggcttccatgaagatctctgacatgccccggagacattttcccatttgtcttggctattaacatttggctcctgattacttatgcaaatttctgtaataggcttgaatttctccccagaaaatggggttttcttttctattgcatggtcaggctgcaaattttccaaacctttatgctctctctttcctttttaaacataggttctaatttcaaaccatctctttgtgagcacatgtaactgcacactttcagaaaaaaacgggtcacctcttgaatgctttgctgcttagaaatttcttcctccagataccctaaatcatctctttcaagttcaaagttccacagatctctagggcaggggcaaaacactgccagactctttgctaaagcatagcaagagtcacctttgctccagctcccaataagttcctaatctttatctgagaccacctcagcctggactttactgtccacatcactattagcattttggtcaaagtgattcaacaagtctttaggaagttccaaactttgccacattgtcctattttcttctgagccctccaaactcctccaatctctgcattttacctagttccaaagtcacttccacattctcaggtatctttataggagcaccccagtctaccagtaccaattaactgtattagtctgttctcacactgctaataaaataaatctttattagcagtggaggtattcaaactgaaaaagatgctttaaggcaaacatttagaaaccttcttgactggctgccctccaaactaaaaaactaggttataatttattctaactattaaccttttccttttgttttcataaaaatggcctaggtcatgggataatccactaactcagtttctcgattgtgaaacttcttgggaaagtttatacccttaaaataattatttgatgctatgactattatattcctcatttaacaaggtggctgattttaaccttggccatctgattccagagaagctgacattaaccactacacaatattggttcccagatgagtacatgcaaattgttctctcttcctacggtcttcctctctctttccaagattctttatactttttctaccatctgtttaccccacacccaatgccaagtacttgaatccatcctgaagtggaatcttcaaaggcatcaaggttttaagcaaatatcctggcttcagtttgttgggtgacatcagattgatattgtgaatcttcaagtgaggctttgaagccttaatttcttcaaaacatggtatttataagaccaaaatcccttactcttgctaatactgactgcctgttattatgctaagtatcaatctttttttttcaatcaactctctgttttcacagaaatgggcagagtacagacaaaggagtgagaggaaaaaaaatttatcaagctacaatatctgatgacaagttcttaggttggcatcttagccttatgatgctttaaaaagtccaatctgatatttcttattacagttccagtgaagccaacttaaaaagagcctttatggttaatcactactattgctacacttatgtaaataatcaggacatgatgacagtagacttattttgtaaactattcttactgcaactatctttggcagaagtaggggtggctgtagagagaaaaattatgttccaatagaaaactatagtacacctgttattagactctactcctgtttattgtctttgaggttttgcgatctacctgtaaactttaactgaccccgaattcttctaatatttggctaagactttgcaaacctcttaaaactaacatttcaaattttcttccacctttctgacatggaatcactaaaaataaagactgcccctttactaaagccctgtgagctaaaactggactacttgatataaactgcagataaatcataacagctcatgtatggacaaccttcatgcttgttgctgtgggccactcagccatcactggaggtattcaaactacaaaagatgctttaaggcaaacatttagaaaccttcttgactgcattccaaactaaaaaactaggttatagtttattctaactattaaccttttccttttgtttacattaaaaagccctaggtcatgggataatctacccacacagtttctggattgtgaaacttcttgggaaaattttaaacaggaatatggcagtgctcaaggtacactaccccaaaatatgactgtagaagaacagaatatgccaccctaaatctttgacatattattttgaatgagttattttgagaaacaccagacacaggattggccctaaaaagttacttttttagagagagaaatttacatctgtaaaaggaatctttatttgcaagagtctttctccctgcatcaggaagaaaaggacactaaatcactaatgactcttaaacaaaatggaaaaggtattgacttaaatttgcataatcatccttatctgttgcagatggtgactatctggggccggtgtcagatgggtggttaaaataatttaccaagacagttggaggtaaagaaaggcagatttattagagaaggtaggaaaatgcatcctaagaaagccacaggcaaatcagcaagagaggagctgactacaaagagacaaagatttgttggtgattttatagcatggtgcttgtgctgtgtgctgaagagggctttgtgcaatacagataatgcgtcaaggtttcagttagctaacttgcattttttgatcagtaaagagtccagtgatagctggacacacgaagattgtgagttatttgtgtaggagagctatgttttctggaccatgaagaaaggtagacttataccttatctgctttttatttttgctttctcttggtcccaccagcctgactccctttccctaattaggattccccattacctttgtttaagatacttttcctagccatctcctcttagctgggtctttccctacatccttctttcttgtttcaaaaaacaatggcatttatcctaaagtttaaactttctttgagatttgctccacagttgtactcatttctctgtatcttctcccatgtaacatgtaacatgaagtatacattttaataaacttctgcttgttaacctgtcttttgttacaaggaatttcagttaagaactacagagtagagagaaaattagtttttcttctctacaagaacaagaaacaaaatgaaatatattcccaatagtttcacaaaacaattaaatcataactaaatttataataaacaaattatttttgaagacattcgtaacaataaaggtaatgtattgttttatctttttaaattttttgagctgggaattgttgactgccaagtcattagggaatatctccaagactgcttttgtttgaaaactgttgacttgtttctctgaaagaaaagtacagccactattgtttactattgataggtttgtaggacttttcattctttaatttccttgtttgatataacaaatatttatttgaacactaacaatacacaaggcaaaatgcaagggatggagggaaaacaggacatataaatatgaaatatgtattttatatatatatgtgcatatcacttcatttggagtgatagagaagacatatgcatgtatacaaataaagataactaatcatataaaacaacaagtaaaattccaaattactcttgtaattgtttaggggagagaaaatcttctatcctctgaaggttcaataattgaatctatgaaataaactgacagtagacagtttagtaggagaaaagctattttaattacacacaggagtcccacaaagtagaggacttgaagaggggccagatgatagaagtttttatagcatcctgagctaaagaaaggagtaggggttggtggtttatcgggggtggtgtctatacaagttgcaggggagtaagaggagggaatgcatggagaacaaaggttgtcttgttatacagataacatctctcaggtaataaaagttgtctccaaggatctcatcagaagaagaggtaatggatagtttgtgacaaagtctttctggagtgtggtgtctcctgtgagttaatcttccttcactgatgagattcccagggaggatacctatgacaattgtgtttctttttggaggctctatcttcagccacttaagggagttcagagagagccctttcttgtatttgctgtttcccaagtgccctcagtttgaaataattagcataccaaaatgctacattttgaggtttactgagtctcaacaactgctactatgcaggttaagtagataattaccttgaagatgctggaaataaaataaaatccatgcttgcctttagagaacaatcaaatttctgtgatagaagcacatacatgagaggatggccatttgtgtttctcacagccctgcctcttaaattcaaacactgtttcatgggaattgttaagccagtagtatgttgggggtaggcactgcagagatgagaaaaggagctgaatagtatagacatgtgaaacatgcaatttaagtatgcagtgcagttttacaaccttataagaacaaattatactattatacaggaggagtaaatttgagcaacagttcagtgtttaaaatgttagtcttctgttctttattgctgtattttatatattgggaggaaaaggctgtagagaagccagttgaggaatgacaatctaagtgcctatcttgtacttgcttgtcttttccaaattttgagggcttcagccataccacaaaagagcaacaatgaaaaactcagggagtccattgaagacaaatggaggtagtctttggcaaggacttttggttttgccttcgttctgccaccgtaagctaaatatattgtgaaggtcccttaatgtctgaatctgagctgcctcatttgtgaaatgaagataataatgtcaacacagggttattattgtaataaacaattgagaaacaagtgaaaatgctttgaaaagctggaaacacattatatgtgaacgtgctgctgctttgtgttgatgacaactcgaaaacaaacactgggatattttctcatggagggaaaccatctttgggtcatggagataaaacattctgagaaataatagtttaaattctctgttttctagtagccagtaccacagtttctgaggaaaaaaatcatttcgatcaagtagatattattctttcctgactgaaagacaagaatatacagttttctttcaccaatggtgcccccagtgttttgtcacaatttttctctccaattattctgagaatattttggaaaggtagcagaaattaacctttcttaaatgacttgtgtgttttcttttaaaaaggagtacacattactacagggtattaggtcctactttcaactttatagctttcaatgcttgcctcatctatcatttacatttatcattaactttcatgtttcccgaggtaaacagtgaaattatctcttttctagagaggcagaaagatgagcagaaaagaggggctcactctgatatatcactcctgaagtgtgaatgatgttagtgaatcccatgatggtctaaggcttggagaaaagatgagatagagggcagtggtcttgtgattctcacctcagtctcactgggacggaagagtgtcctcttgcaggtggaggttaccaaaacaaatgagagctaagttctaaagcagcctaatcttctcattgttcccagacattgagcccaagatgtttctgttctgaatacgattgatcgtatttctatcctctgtgatttagcttccatcactttctccatcttactttaaattcaaaatatctttcagtgctcaagtactaaccaggttatcaagtcctaaaccaaatcatttgataaaaacgtgtgatatgcctgaccattttgttcttctttcatgttgcagccttaattttctagcagctcttttaagactgaaagtactccaacagttaacaagtgatagctgtaattggcctcaagaggattcatgagtctcatgggagattctgcttggcgaaggggaaggtcaccttcatctaatctgaaataaatttgagagtctcacaaacatgaatccagaacattaataaaaacaaagaaagaagcactgccaaaaatgttacccaagcaaatctctcaagggctagtcttctgggactgataaaatcacgtacatttgcgtaaagcctgtaggaatcctagtgtgtcacagctgtgcacttaccaagtgtattgactctgaatacaaagtgagaataaatctaagatacagctcacgttgtgttgtgcataggaataagtttgaaagcaggctacaggcctggtatgggaagacaagggaatgagtagttcttcagctgcaaatctattttagatactcagcaatgaggttgaggagaaaatatatgaataaaggcgggtactggtgataattcatttttgaaagaaaaatgccaaaatagggaggcattatctataaacacataatttcagcaatggtggttatttcagcctttgacagggcacaggacactttggataactgttcctctaggtgctatctcagagaacaaatttatcatcaatcattgtggcctattttaatggacaaagacacaaactgagatagaggaaaaaatcagaattctagaggaaaaaaatcagaaacgggcaattatccagaatgagtcttttttttttgagacagggtctcactcagtcactgaggctggagtgcagtggcaccatcttagctcactgcagcccaggcctcttgggttcaagtggtcatcccacttcagcttcctgagtatctggaactacgggtgtgtgccaccacacccagttaagttttgtattttttgcagtgatagggttttaccatgttgtccaggctggtctcaaattcctgagctcaaccgatcctcccgccttggcctccaaaagtgctggtattaaaggcgtgagacaccacgccaggcccagaatgagtctttataaagaaaaaaaatgagcctattactgctcaattctccccttcactctggctttcacaggccataagcccccgtgctttgttattcctttaagtacacaggatccgtgagactccctggttcacctgctgagctaaattctatactatttggtcagggtgtaaataattaaatagaaattcttgctttcacttcataattatcaaaagataccccagcttttcccagggttcctggtttaaccatgtgatatttcaattaggaagaaaatctaactttctctagtattgaagaaatcaatttaaagtgagtatttggaccaaattttccaaatattggcttcttaatttttcctgtttttttttttttagttcagatagatatgctgttttttattttaagaaaaagtttttttcatataaagaaaaatattttgaaaaacatttttttaaatctcttgggagcatcttcacctgctacaataaaataagatactctgaagactagagaagaataagtagtaagtaaacaataactcatgtggcaattagtctttagtgagctcccaaaatgtgccaggtatacagtggtacttataacttccaagcataatgagagcatttgtagtcttttgtatatgcaaggaaactgagtttcagataggaaataacttaagatcatacagaaggagaatgtggatttgaacccagaatcttttcatacctaagcttgtgattttcccacttacctatatttccttttcacctaatatgtttcttaagctatgtgttaaaaacaacactaatagcccaagtttttcttggaagtgatttgtttgggatgattctttacactctcccttgtcgctactggtatgcattgtcaccctggatcagaaaccttcaagcatcaaatcaaattcttttgcttattcagatttctagccttcttccctcctacctctggctcccttggtatggtcctgccttccctttctaatattttctgctttaatttccctttacccaatcaaaccacagtcaaaccaaatgactagctgtcctctcttcctctgtgctttcccatctccatgcttttactcaagccattcactctaccggaaatgaccttaccccttcctcacaccaaattcagaagccttgatcctgccatctttctcaggccagctcaagttcttctcttgcttttgtggctggaagtaatttctccctcctgcaaacctttatagcactctcttagtatatttctcatgaactcatcactttttactttgtaatatcattattaatatttgactctcatttgctcctctagactgagtgaaggatctatgactgattcaccattttgtcttccacagagcctagcttctaactgaagctaacatagatgtaagaatgctagattttgaaagaacacatagttaaattttaatttcaaatggagaaaaaataatttttaagtatatttggatacttttacatattcaaatattatatgaaacatacttacattaaaaaatcttcattctttatgtaaaattcaaatttaactaagtgtcccatattttatctagcaatcctcccaacaaactcttatcaagtagtttttaaataagtgaattgcatctcagtggttcaaatctgcaactacggtatcattagcactggctgaagtaacttcaaatagtagtaaattaagatagctttgaaaagaatcatagtggtaatttagtccaatcttctagcttgtggattatttttttaaaaagagatctctcagagacttgctccaaatcacacaactaacactcaattacacacctctttaaaattggaacttaaaaatacaaagtagaatcatcaaaacgtcagagagctataaggatgaagagagcttctgtatacttaaactgtacttctgtatttgctcattcactcatttgagactggcattagcagctctatcagtccttgtttttctggtatacaatcaggggttcccaaacccccagctgcagacaggtaccggtctgtggcctgttaggaaccaggccacacagcacgaagtgagtggcggtgagtgagcattaccacctgcctgagctccatctcccatgagatcagctgcacatttgattctcaaaggagtgtgaaccctattgcaaactgctcatgcgagggatctaggttgcacactacttatgagaatctaattaatgcctgatgatctgaggtggaacagtttcatcccaaaaccaatccccccacatatccaacgcccttgacatccaactcctgctcccccaacccatcccatggaaaaactgtcttccaaaaatgagtccctggtgccagaaaggttggaaacccgctggtctacatgtctctctatacatttgtacacactgtttcaaattgtaaagtcttaagagtcagtgactgtcctatctggtcactgattaatcttgcctggttaatgaaatgtgattataaaaggacccccaagatatattcatagaaccagggaagacataagtaaaatgatctaggtcagaatttttatttcctgcacttctggcagcaattttcttccctaaatcgctggtacttctccttaggatactcaggggctcctgcctgtcaggcttctttgcttgcaaggccttctctctctggcacttcttcctttcatcagaactttcctgtcctgctcttatctgctcaccaggtgggaaaacagctcgagaaactaatctgagcaaaggtgttaaaggctgacatggatttaataggtttaatatgcatcttctccaagaagcaggtcaaatgtcatactttctgtgaagattactcatttccaaggaggctaactgcttcctcctgcaagctaccaccacacttctatcaaccttctagtaaagtacttctctggctgaagtttaatttgctgtatattaatatgcacacacaatgtctcttttcatgtttatactgccagcacctactatagcatctacttcataataggcaatcaatatatatttgttaagtaagtgttttgttaacttgatttaaacaggtgatccctagatgtttaatagtcaatacaatgattcttcaatgattaccagggccacacattgggaataatcagtaaagaagtttttaaggtcttggtctaacaagtagtcttcaattgtgtgtagcatttcagtaatagcattattattggttcaagagtgtttataagatagagcgttataaaacttgaactacttggtttcttctacttattgtctccaaccatgctatcttaaacttttctctctcattttctttaatgccatcctggccagaccatataactttctggttacttataataattaaaatatagatttgtctagtttaaaacagaaggggagaagataaagtatggcacgctttttcactccttccttccctctttctaggtctgtttctctgaagttaggggcaggaaggaggaacagaaaaatcataggtcatcttacaaaaccatccatatactggactgagatgtaaggcttttctggaatgatcctggtctggaattttggaatggctgtgtgctgtcctggtggcttctgttggtttggtggtctctgtaaggacagagtgctcactttcagaagtgtctagtcatcctaaagctactagctctccatccctgctgcaatctttttttccgtgtgggggttccctctctttgccctgtggctgtatgagctgctctagagattccgcaccccaccccaaccactgtatcttttcacacagagcttcagaaactattggtcctctttcaagtagtcattactttggtggcttgcagccctacacactacactagtaagctttctgcctgcagaacatctaaatgattaataagtactttcccccatgtttgcaaacacactcctcccccaaattccttgacaagctctcctaaggattctctcttcatgctccactgtactccaatgggagctctacagtgggcctgcaggttctacagatcagaaaggaacaagaagaaagactctcccttttgtttgcatctctatctactatgattctcttgtagcacattcccctcacttgactatcctcttagccaactgttcttaagtagggtcactagtcctcagctggtcagcttggagaactgctacaaaactgtgctccagggtgcaccttctgctgctggcatatagctaccttcagatctgctatggagtctataacacagattattaaaagttggctatacaactgtttcttattttttttaatcttttttatgactatacatcttaaacagtttcaccattagaaaactatcatgttatctgaaaacttggggcttgggtacattttaatcatttctacaatgctattccgttattctcatttcaattttatcttgtatattcactacatgcacagctttagaattcacaaacactgtcagtcctgggtaaatgaggataatcctctatgtgctgttgactgaaaccttaccttcctctgtgagagacccgaagtgtcaccaattcagttaactttctcctttttccctctgaagatatccagacagtgctttttaagcgctctgtttctaagaaaaataaaatgaatcgcatgtactcagcatgttgcactcaaagagcattggtaatataaaaataagtaattagtactcagttttcaaaggaggtaaaaatccaggaattgcattttgttctgaggcaagctggtatatttgccctggtttgagccatcaggctatttatatagatcctgcccaggaaggcctctggctcatgatgctgtgagccatgttttatgggttgaattgtgtcctctaaaagagatatgttgaaatcccaatcccaaatacttcagaatgtgaccttatttgtaaatagggtctttgtaaaggaaatcaagttaaactgaggtcattaggttgggtcttactctaatataatatgaccaatgtccttattaaaaaaaggaaatttggacacaaaaatacacacaagaatgccatgtgaagataaaggatattggggtgataaatctacaagccaaggaatgccaaagattgccagcaaaccaccagaagccagggagaggcatgaaaccgattcatcctcacagccctcagaaggcatcaaccttgctgatatcttaatctagtacttctaggctccaggactgtgagacaatgaatttctgttgtttaagctacctagttggtgatacttgttatggcagccctagcaaactgatgcattataccttaattctaatctcctaatttctgaattatatatattctgaatatataaaaagggctcccctcccacttgggaacaactcctataagaggtgagggctgaaacagagggaagacctactgagattctgatatgggataaggttcctcaaagcatggttttcctgcccttagatctctagctgctatctctctctaccacatccctcttctaagtcaaagagatgacaatgtcaagtaaaaattgattctagtagatcctctacttattttcttctctgaaatgaaataattttcttccacataaatctaggggtctacattgccaagtggtaaaatagttggagaacttaacaatgtcttctcaattttatgtgtgacatgaaagtgagaacttttttttttaacagaaaggaaatatcaaatcatgtagaaaaagtccctcattttactaagcaggaatcaatacccaaaagatttctagtccattaatccttccactgggtcccatgccggttaaggatgggagacagagaagcgtgcggattaggaaagtactgtacttctgcaacttaatggcaagtgagataactttggctttaagagtaataaaaaaaaaaggagctttagtaacacatgattggttcagtgatgagatctgcggccaaaagcaatgtctagtacatgaatcagaaattcttgatactactcatcactgaagtacaacggaatttcaaaggaaagaaaagaagtaaattaatatttattgaccaccttcattgtaacactacttaatatccattatctcatttaaacttcaccacagcagccttattagtaaccatattttatagaagaataaactgagacttaaagatgtttagaaaccttatccagaaaataatgagcagtaactggcagaaatgagatagaaacttacatctgtatcagcctgctaggatagcagttgttcttaactccatgaacaatctgcatcctaatcacttgcagaactactttaaagtgtgagtttaaagttcctaaacccagagatcctgattcagttggtctgtgggtggggtccaaaaatttgagtttcaaacaagttcagtatcacatttaatttttacacaagtcagcagtgtgctacatttaaaaaagttattctttgaaaatgattctcaagtgaatcttaatcttttacatattagttcagattagtcactataccatagaaactgtgccattctaaaatagaatgaaaataacccctccccatttcagtgtttaccagcatattgtgtgacacaataagtaataagttccaactatgagattatttgaataagtacaaggaaaagttagacactgacacaggatggacaatgttgtactttgacaaatagaaacatttaaaaattatcatctattataatcatctagaaaaagagataacacaaaaaatataggaaaggcataatattaaactgttttataagccaaataaatttagttttataaaaaacttacttcactgtccttatttttctcatttaaattaacaaaacttcatcaggaaccaaaacaggtcaatggattgagccatgccaatagttcactgtcatgagaataaaaagtccaaataagactcagtctttgactttaaaggtattgcaatttaattgagataatcaaatttacctgcatgaaatgactcaaaaccaatataaaatagtacataattatgtacaggcatacctcagagatattgcaggttcagttccacaccactgcaataaagtgagtatcacaataaagggaatgacacaaattttttggtttctcagtgcatataaagagttatgtttacactatagtctgttaaatgtacaaaaatattatgtctaaaaatacacaaatcctaagttaaaaatactttattgctaaaaaatgctaatgctcatatgagtctttagtgagtcatcatctttttgcttatagagggtcttgccttggtattgatgactactgactgatcagggtgatgactgataggctgggtgtagtggttcatgcctgtaatcccagcactttgggaggctgaggcaggaggatcacttgagctggggagatagaggttacagtgaactatggtagtgccactgcactcccacttgggtgacagaaaaaaaagcgggggtggtggttgctgaaggtttaggtggctgcagcaatttcctaaaataagacaacaaatgaagttggccacatcagttgacttttcctttcatgaaagatttctctgtagaatgtgatggtgtttgatagcattgtacccatagaacttcttacaaaattggagtcagtactctcaaaccctgccactgctttatcaacaaagttttgtaatattctaaatcctttgctgtcatttcaacaatgtttagagaatctttaccagcaatagattccatctaaggaaacctttttttttttcttatccaaaagaaacaactcgtcatccattcaagttttattataatattgcagcaatttagtcacatcttcaggtgccacttctaattctagttctcttgctatttccatcacatcttcaggtgcttcctccactaaagtcatgaagtcattcataaggcctggaattaacttcttccaaattcctattataataaattgacattttgacctcctcccatgaatcacaaatgatcttaatggcatctagaatggtgaatcctttccagaaggttttcagtttactttgccatatctataagaggaatcactgaagcaggtctagccttatgaaatatatttctcaaataataagacttgaagtttgaaattattccttgatccatgggctgcagaacagatgttgtattagcaggcaagaagcaatattaatctccttgtaaatctcaatcagggctcttgggtgactaggaacattattaatgagcagtaatatgaaataaatctcttttttccagtctcgacagagtctcaatagggagcttaaaatattcagtaaaccatgctttaaatagatgtgctgtcatcaaggatttgttgttccattgacagagtagaggccgagtagattcagcataattcttaagggctgtagaattttcagaatggtcagtgagcactggcctcaacttaaagtcaccagttgcattatcccctaacaagagtcattctgtcctttgaagctttgcagccaggcaatgacttctcttctctagctatgaaagtccttagatgggccaggtgcggtggctcacgcctgtaatcccagcactttgggaggccgaagcgggcggatcacgaggtcaggagatcaagaccacggtgaaaccccatctctactaaaaaatacaaaaaattagccgggcgcagtggtgggtgcctgtagtcccagctattcgggaggctgaggcaggagaatggcatgaacccgggaggtggagcttgcagtgagcagagattgcgcgactgcactccagcctgggcgacagagcaagactccgtctcaaaaaaaaaaaaaaaaaaaaggccttagatgacatcttctttcaaaagaaggtgttttgtctacattgaaaatctgttgtttagcgtagtcactttcatcatcttagcaagattttctgcataatctgttgcagcttctgccttagcacttgctgcttcactctacactttgtattagtccattttcatactcctataaagaactgcctgagactgggtaatttataaagaaagaggtttaattgacttacagttcagcttggctgaggaggcctcaggaaacttacaatcatggcggaatgcaaaggggaagcaaggcaccttcttcacaaggcagcaggaaagagaaatgccgagcaaagggggaagagccccttataaaaccgtcagatctcatgacaactcaatatcacaagaacagaaggggggaaatcaccccataatccaattaccttcacctgatctctcccttgatacatggggattatgaggattataattcaagaccagatttgtgtggagacacaaagcctaaccataacacacttgtatgttataaagatggcttctttccttaagcctcacaaaccaacctctgctagcttcaaacttttcttcttcctcctgtctgtcagccttcatataattaaagagagcaagtgccttgctctggattaggctttggtttaagaaaatgttgtggctgatttgatctatccagaccactcaaactttctccatatcagcaatatggctgttctgctttcttatcatttgtgtgttcactggacaagcacttttaatttcctccaagaacttttcctttgcattcacaaattggctgtctggcacaagaggcctagcttttggcctatcttagcttttgatatgcttttctcactaagtttaatcatttctagtttttattttaagtgagacatttgactctttctttcacttgaaggcttggaggacattatatggttattaattggcctaattcaaatattgctgtgtctcaggaaatagggaggcccaaggagagggagagagatgggaaaatggctggtcaatgaagcagttagaacacactcaatatttacttattaagtttgttctcttatatgggtggttcttggtgccccaaaacaattataatagtaacatcaaagattaccgattgcagatcaccataatagatatataattaaaaagtttaaaatattgagagaattaccaaaatgtgacaaagacacaaattgagcacatgccactgttaacaatggcactgacagacttgctcaatgtggggttgccacatacctttaatttgtcaaaaatgcagtatctgcaaatcataatgaagtgaagtgcaataaaacaagatatgtgaagtgcaataaaacaagatatgcttatatataattgatatggtttggctttgtgtctccactcaaatctcatcttgaactgtaatccccgggtgttgagggagggacctggtgggaggtggctggatcacgggggtggtttcctccatgctgttctcatgatagtgagtgagttctcatgagatctgatggttttataaggggctcttcccccttggcttccttcacttgctctctcacctgctgccatgtaagacatgcctgcttcctcttccaccatgattgtaagtttccagaggcctccccagccatgctgaactgcgagtcaactaaactgcttttctttataaattactcagtcttgggcagttctttatagcagtgtgagaacggactaatacaataattatgtgggacagatagtagttatatgtaatgggagactaaataaaagaaagatctgtatgaagtgaagtggaaactaaaggactggtgaaagaagtggtagctgaactaaatttggctaggttgaaaagagggcaaagggaatcctaaatggaaaaggagcaaggcgcacagggtagaagtaagctactgaaaacgacagtgatatgaaccaggattgtttaaggaaactagcctgattaaagcagagaatacattttaaacagtactggatgattaggttagataaaaaaggtagattgtgatgatgtgaaaaatggattagtagacaggaatctggactccagcagatataagagcattatattttcgcacacagggaagaatccaaagtgaaaacattattttgtactggtaagtaatctgtcctaacttttggttgtgaaaacacagggtctgacaagtgcatgtattcaatgaattctggttgatggcatgatggctattgtatttgtaatccacacaaaacctctgcaatacctgccaagtctgatttatcttgagattagaatcttagtttaaacttctactttctacttagctaatcacctgcatggtttaccattctactttctgtctttcaacctaaaataaaaatataacagggtgaaataaaatgtactaattccccatataacgttacacctgagctgtggtaaggggataaacagtgacttcagataaatagttcaatatcaattggggtagaaatgtctcttaacacaacatagtctggtttattctaaagaaataatgtcaaaattatgttattataaattcctcatgcagaaaaatagttattttctttaaaaaaaattaatcctcagggtagaatatgtggttaaatgtgttttgttttagttaatactaactctaggagaaaatcttcagaaaagccctagccaatgaacagaactagaggcaactgcaatcaacaaatcactaagctgtgaaatatttaacacaaaggaagaaaactgagagagaactttattctctctttggagtgataggagattctaggaaagaaagggatgggagagaccctagaggcttccagaggaataaaatagagtcaggaatgagacaatacatatgtagggcatctctgaaggcctagaaggtctgtgtaagactgccaacccacccaaaggcttatggagggagagagacacataatcccttgaacaacaaagcatagcaaagaaattcaaagtatccaaccaactaaacccttccccacagaactgaggaacccttcataggtctatatcttttgtgttgtactgtagggaagtggtagaatagtaggtatctaaggatacaatcctttctagaaggattcagggataaaatctgtagaacataaaaagggtctgctgcacaggttacaaaaattaacactgcctccaccagtgtaagcgtttgagattaggaagcacagtagaggagctagggacagagcttctaacattaattacttgggttcaacttttgtcttcctggtttcctagatatgtgaccttgagctagttgttccagttttctttaaagtaaataagatatatatgtgtgtgtgtgtgtgtgtgtgtgtgtgtgtgtgtttataaatggaataggaagagaaactacttcatgcagttgttgtgataattaaatgaggtaatacatggagaacacctggcatctggtacatcttctgcaaatatgcactatcattattataaaatattgtataaaggtgtataaatggaaattatcttaatggattgtcctaggaacaatattcaggtaataattttgaatatatatggtcaaactgtgtttaccaggttgaatttgcttaataaagagtaaagaaaaactggcagctgatttttccaaagactaaagatgaaatgagataatattacttggtacttatatagaaatgcatagacttagacccctttttgagaaaacaggatttgaaaaagatatagagaacttagaagtgattttctcctaagggtccatattagaaaatgtactctagacaatataaatcactatcataaagaattcatgagaatgataacatggcaccagaactgtgacaaaacaccaacaaaacaaaacaacaacaacaacaacaaaaaaaacctacttatccccaaatttttctgatttatgatagttattatgagtttcattttttaaaaattccccttctgctatggcatgaatatttgtgtctccccaaaattcatattttgaaattccaactcccaaggtgatattaggaggtggggcctctgagaaatgattaattcatgacaggggagccttcatgaatgggactagtgcccttaaaaaagaggtccaacaaagctcattcatgccttccattatgcgagggcacagctagaagatgccatgtatgaaccagaaagcaagccctcaccagacatcaaagctgccagggccttgatctttccagcctccagaactgtgagaaatacatttctgttgcttttaaggtacccagtttgtggcagcttgttacagcagcctgaacgaactaagacacccttctaaaatgtgttataactaactaattaaaaattagagtacaatcactgctcgggtgacagatgtactaatatctcagaaatcactaataaagtattcaatcatgtaaccaaaaaggacctgtgccccaaaaactattcaaataaaattagactacattaagatcagtatttttcctgagaatctcattaactcatttgaaataactgaaaaatagcactggatattgtaatactaatattgaaaatatacagaatataaaaattgaagttaggccgggtatgttggctcattcctgtaattccagcactttgggaggccaagacagtaggactgcctgaggccaggagttcgagatcagcctggccaacatagtgagaccccatctctacaaaagaaaactgaattttaaaaagtcacattgaccaaaaaattttaagaatatctaatttgtttcagctgataattcctaaggttctctatactaactatattaaaataatagagtttgctgtgaaagttggggaaatgatactagagaggttagagtttaatatagcaactttttgcttccttggatcttgtttagagctcatcacaaattagcaaagaataggtactttatagttccaaactaagaattccatgcgagtccttaacaaagatactgtattgcaaatgtacagctcagttctgaaatccactaataaagatgaacacagctgagaagtcaagtggattaacaggcttgtaatgatgaaagggtaataaaaagcagatagctattttgaattcaacgctatttttcttcttaaccctgggctctaaacatgtattctaatgccaataaatttagaatctaatttttttcatccagaacattgtgttcaatgtttatcactctaatttacttttatgaatgaaaatgaaataaaactttcaaactatgtaaggttaacactaatgcaacagcgccacccagtgaatatgctgtatattcaaaagtgttactagaatttaccattttctttaaatactagcgtactttcaaaatatctatggcctcaaccatttatataaaattatacactacaatactaactcaaaaatatataaaagcattacgcatttttacttacccatttataactacagttaagatgtgctttctgatatttgtgattaaagggttttgcatattaaatgctacctatgtcagcaagctagaaatgttggctgataggagagacgtatcattatttcctctcatatgaaacattaggcaggtataaaacaatgacacttgtttgcttttgcagattttgtatatatcgcataatacagtacatagtttcaaagattttgtctcatgcccttaatataaaatgtgtgttcataatttcacttcatcttgctattactgttcataattcatataagtgaattgaatgatggcatcaataatacaaccatagaatttgtaaaccaatcaataacgtaatgtggtgcttgagcacaggagtttgaggctgcagtaagctatgatgacaccagcctgggcaacacagtgagaccctatctcaaaaaaaaaaaaagctaatatgatataatatcagatagcattttaatattccactctatagtgactagaacatagttggaatattgctttcggtattaagtccacaaaaatctaatagaacactttttatgtcatctttttatttctcaggaaatagaaatacattggaggaaaaggcaaaaagaactaaaatatattcaacaaaaagaaaatttctttttcactctgacctgctagtttccctcctcagaggctactactattactttgttagacgcatcatgtctcaaaaggagttcagttcaacaacaaatactaattgagtgtgcagtttgtaccaggcatggtgttaggtgttggagcatcaaaggtcattaagaaccagccctgtataatagtggagacaggcacaaaacagatcatttcaatataacataaactttttttttgtaagtatgcaaagaatccatctcagacctctctttttgagtttcagaatcattcatccaattgccatgtatctggacattgtcatgtgtatgtttcacaggcatgttgagctagacatgtttaaaactgaatcaccagttacctcccaagtgagtctgcctctgtgttacctaaatcagagactggcatcccatttatctgggtactcaagccagaaaatttcactcgtacttatcaagcatctccagcgtataaagatttgtgctaagctgtggatacatgacagcaaatagggtagtccctgtcttcaccaaagcttgtttaagaaactctatccttgatttctcccacttctgccctcacaattcagtcaccaagttttgccacttctacttcctaaaattcttctgagatctatttctatccacactggcaatgccccagtataaactgccatctttctttccctggattactacaattatctcctaactggtttccttcttgctggtattgctgccctttgagttctttttctcagagtagcgattcatcatctaaatactaacctaatcatgttgaaaccattcaaagttactattagccttaagaaggagtccaaactttgtgacatcatcactaatgttcttcatgatctggtccctgtttacctctccacccctgtctagaatctctcagttcctagactgtgttcttcttcataaacattgttagcctctatctagaatacttgttttttaccctttcaattcctagctattatcaagcatggagccaataagactgaactgcctttttttttttcttttttccctatgagaatgtaaactctgtcaggaaattattagattggttattgccatatttgcttgttcattattatatttctagtatctagctcagtgtctggcacaaaataagggttcaatgaatattttctgaatgaacccacaaatgtcaagaaagcagagagaaaagtcaactaactcagactatggaacaaggaaaggcttcttgcaagagccctaaaaaattagtaaggataaggaagagtcagccaaagaaaataaagatagtccagacaaagtcaacaagaatgcaaaaggtctcaggtgtaaagcagcctcatgaatgcgaagtgggtaggatgggagatggtactggaaagggaaacaagactgggaaggaaaacagtggcaagataatgaagaccctagcacaccaggccatggagttggactatcttgaaggtgactgcagaggaagattagaaatttaaggaggcaagtgaaatagatttacatttgagactggtcattctggctgctacttacaagatggatttggcggtgtaggtgggggtggtagtagttatggctgaaagcagtgagatgagatagaattgggagtacaaatgaaagcaaaggacaaattagagtttgaagggctcgtgagcctcccgaaagtcggaacttcaaggaacaggtcaggaatagcagtagttttagaatccatgagcaaataggttaaaacaatgagtggacagtgctcacagggaagatacagacagaaaacaactcaaggttggaactttgggaaatactatttaatgggtaggcagagaaaaaaagacccccaagaagcatgagacaggtagaaaaagatgggagaaatgcaaaacgagtttcaaggagggtttaatcaatgataccaaatgcaaaagagaggtctagaacaagaaacagtggtcatacattggtggaggaagtacatttcattttctgagacagacaaataagacaggtggatatatgtggcattgacagaagtggagagggaggaagttatatattgtatgatggctttaattttctcaattaactgggaaaaaagtactgggattgtgtgtggcccctatggaatctctattcataagaatgggtgcctgatgggaagtagagtgtaggatccagtcttagtatttcacctattcctaccacattagaccaagtgaatcaactttttgtccctattgatctgttaaagtagaaataacaatttggaaaccctgtcacttaaaaaaagagatttgtttaaagcactagatatcacagcatcaccacttgcattaaagtcctagctgcaggctgccatggtctctttggaacacccccatcttgtcactcaaaggtccactcagtcctgataggtctgtcatccagaatttaaagtgcagtctagaaaaggaacatgaaattaaaattagaaaggcaatagacacaacaaattgcagatgcatacgaatgtgttatgtgcttgaaacacacctttaagaccactctggtcactttctattaaagagaggaatttaggttgggaagaggaatgaagaaagggtaaagtttgtgagaaatcactgaaagttacaggacagggaaattactgatgataaattaaaggattgtcaggaatcagggaaagagctgaagatggagactgacaatctgtcatatatcactttgtgtcattttctccagtgtttccagctaagaatttatagacaagatgcacggataagattttgacaggcacctgggtcagaggcatcagacacaggaagtttggatgctgataaaccatgcagtctaggctgtgaagggaggtattagcaggagggctgtcagggaaaatgaaatagtagggcaaatgtagcacatgtgagggtacaaaattatgatgctacaatcagaaagaatactaaagttttctgcaatagtctgtgtttttatgggtgataacaaaactcttagactaatgtctaggttgagaattctgatgttccaccttctaccttacactgaccagtatcaggcaactaaaagttttaaaaagtcagatttaaccttctaattaaggtaatttgaataaacactcattttttaaataaataatttacttctaatataactcaatttatcacatcaatagtaatattaacccccaaataaacaatatttattgttgatataacaaaatggttgtcttgctcttttcttcctttgcctcatttttctctttctccatggtccattctaatcttggctttcacataaatcgcttggttttttttctagattctcaacgacaatttagacatttgttgagcacttgccacttgcaaggtattttcctagggaccatgtataaataataatagtcaaaataacagctaatacttttcaagtactcacaattttgccaggcacttaattaagcactctacaggaactaattcacttaatcttcatgataccgtataaagcagatagaactgtcaccctattttaaagatgcagaaacgagctcagttaggttaaatagctcgcctaagtccacctaggtagtaaatggtgtgatcagggatttcaatccaactccctttgaccgtagagatgtgctctcagtcactacgctatggttcccttccctgcctctaaggacatataatttggtggaaattatgcatgtatcagtaatcaatttgatttggcaagtgtcaatgagacaggtctcttttttctgctttcctcactgactctaatatttttttaaaatctattttcttaatgtccttttgggtcttactagattccgactttgagacttacatcagtaaatagacattgaaaggaaagacaaaagccctgaactaatgatatgaaatgtatttttatttagaattggtatagacttcactatcaataggtttagttcttcaggacaggacaaagcagcggaatttgtgtctacattcaatacaacctttctagcacttttttcacataattcagttcaggttccccatccaacacacgactgtcaccagatgatgctctactctgtgaccagatacaagtcctattacgtcttctcctgtcccaaacctcaataaaacttaatggctttctcccctgacaaccaggcctgccatggcttcctaacttgtgttaaatgcagtgtttccactcttgccaaaacaaacaaacaaaataccatgtaaaaaaatacagatttcagggccccttatctgaagaatgcaactcactcaggaatgtgcaaatttggggaacagttcagaggtgaaaagcactgatcgaagagggagaagctaaaatcaggagacctggtttctactttacagtcccacttactgtataacttctaacaaatcacttctctctgagtccagttttcatatcggtgaaagcgagaggatttgaccagatgaactgttatgttccttccacctcttgaagtcgtgcttatgagcacagagtcagaggatgtgtgttcatatcccagctatgctacttgtgaactactgtgcgcagagaactgcattctctgattcagagccctcacctgaggggatgatagtatctctccactatcccttttctcccctttaatgaagtctaaatgagatgatgcttataagcatctaacaaaacccggcacataatcaatgttcaacaagttattattactctggaattctataaattacctctgtacttcctcccttgtcaccctgaacttagtgaagtttccttcacttggttttgctcttcaactcggaccccgaaaacgctctaaacgctggcggaagtcacgcagagatgggctagacgctcaaccccggtctcttccccgaaaccgcggtgctcccacttcctgcagtccgaggttccgactcgacgccagctccgcgagcaatggttccgccctgcgccctgccccttccatgacaactccagtcccacctgcctggcgtctcttgagcccaaccggcatccgtcgcggttggacgtgggcttggcggaatggggcgggacttccagtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggaggtgaggggcgggcccgtcgttactttttatttgatgttagtcccagaaacaaccagagctcagttcctactaaactaacgggtgttttctggtgcagcatagaccgaagaagacgagcttgagctgaaattgttcaagttaggcatacatttatgtgtgatttttggaaaggcggtggtaatgtggtttatttggctgcagatgcttgtcagctttttacacatctccgttgccaaacgtttcttaaccaaatccaaaaccatgaatgaaaaggtaaaaatatcacacctaatccaaaattcaaaggaaaagagcagcgcatatatagcactacgcatgcataacgccatcattgttccttttaaaagttcaaggaacgttttacttaattcattgaagttgggagccatttctgtttatttttgtttaatctctgcctcgtggaactgtgatgtccacaaatagtttattttaacaaaacgaagtgtgtaaaatttaacagagtacttttagtacctactcactctgctcagcatcgtggtgctgcaaataaatgagaaaccagatgagtaattataggttaatctttgctactcgttagacagagtattactgcatatatattaagtcatttatatactttatcccacctaggagctcaaactatgtagttggaaagtgtcttcatctctcgttaatgaataaattgtaactgaaattgtacttcgaaagaatgatagaatttggatattggaggaggttccaaaaggaaatactggaagtttgggaaagttaggagactaacttggagcagaaatttcattcaattattaaagggtttagaagcctagcagaaaaatttgaatttgatgtggtgggtaaggtgagtaattgaagtattttcatacaaatattatatgatgcgttaagtgtttttataaggattaatctgatagcagagtgccaaacattagagaagagaggaacaagtgataataattatgaagatactttacacctacgctttctattgcaatactctctaattcagatgcagcttttttggaaaagtgactttttctgaagtctttctttggtccagtccttttatgaacagtttttaaggctgtgacttagatgaaaatgtagaatgcatatttatgctgaagggaacatctaatatgtgatgcatcagaatctggattccaaaagatcccagctctgtggcctggcaaggtggcttatgcttgtatcccagcactttgggaggttgaggtgggaggatcacttgagcccagaagttcaagaccagactgggcaacatagtgagaccctatctccacacacacacaaattaacagggcgtggtagtgtgtgcctgctgtcgtcctggctacttgagaggctgaggcaggaggatagcttgagcctgggaggtcgaggctgcagtgagctgtgattgtgccacactgcactccagcctggatgacaaactgagaccctgcctcaaagaaaaaaaaatagacaaaacgtcctagctctaaaaggaaagcttgcaatcatgaaatttaatagtagaaagtacaaatccttgcttaagtttcaaataatcaatttatacaacaagaacacaagtgacacagcagatggtgaccaaaaaaaaagagagggaaagggggaaaaaaagaacagggagaagccgccttgatgcaagacggtcatgatgaagttcttggagtttcagttgatcagtaagtgctacagcagaggccattatactgtgccctagaccaaccatatctggagtgtcgtgttcagtttgggcactacattttaagaagacatttacaaaatagtgtgtgttagaggaagatgaataagatggtagtttctaaaacaatgtcatataaggagtattttgaagttacatatagccatacataaagaaattatacttactttaaagaagggagggcttagcagaggtgtaatagctttcttcatgtttttgaaaatggtgtcatgtaaacagagattaatatattctatttagttgcagtgactacataggaccaggaggtaaaattaccacaaaacatatttccacacactatgaggaagagttatttaatttggaaccataataaagtgggaaaaagttgcattgagagtgaattctgtgatgttgtcacatgttcaagttgaattgggaagttatttgttagtggttgtttagaattgcttccatttattagaggttaggcaagttgccaaagctcccctttttaaccctaaaattctaaaaaaattaggagcctaaagaaatagattgtcagaattgtggcccatttcaatttgtttgcaaaattgaatatattcacattgggtctccgagatcattttgcttcactggagagtaggggatctgaaggtaacacaacaggtatttaagggagtggctgagagcaataacagtggctgctattgctgctcatttctctcttgctgttactactgctatttttgtggttacagggagagatatgaagaaaatgaaaagatccttacttaccggaatctcacaatgtggtgtcagagttctttaaacataattccagtacattgtaacaagtattataacaggggtaaatgcaaggctctaggacaaggtttcttttcttttctttcttttttttttttttttttgacacagggtctctgtcacccaggctggagtgcagtggtgcgatctcagttcattgcaacttctgcttcccaggctcaagtgatcctcccacctcagcctcccaagtggctgggactacaggcataggccaccatgcctggctaatttttatgtgttttgtagagatagggtttcatcatgttgcccaggctggtcttaaactcctgggctcaagcgatccacatgctttggcctcccaaagtgctgagattacaggtacagggttttttaacatcagcatttattgaccttttgaactggataattctttgctgttgggggccaccctatacatcgtaagatgtttggcagcatccctggtctttatccactagattctagttgcacccacactcctgtgctgacaatcaaaaatgtcttcagccattgccagatgtgcccttggtgataaagttagagaactactacgctagggggacacaggtaggaataactcactacgtgaagacattaggagaaatggttttttgttttcttaaaattctcactctggtgataggatttcctatcaattatatcatctattcttactcagttttttttctctcttctatttgcatctacaaccttattagccatctcactatatatgtaatgaataggatgtcaaaactgaatacaattttttatgccctatattactgttgtttatatatagcttctgctgatgatgttgcctatatgccttgctttgagaattaattattaggattggtcttgttaagctccgtggccctcaaatgtaaaagagaagcacgtggtttctcatctatctattcaaccaaagtcctccttcccaaatgtgttgttctcttcctacaaaagagaacgacactagaaaattagcagaaaataactgtgtcaccttagaataaaagtaattttaggatacatatataaatacttgtatttatcttactaagatatttgatgatagttaacactactatgaatagttcaactttggctcattttgtcattatgtttattagtttccagataatgagaactactgatcatgtggtatttctcattgttttttcttccttcagattaacaggaaacttccaagatggaaactttgtctttccccagatataatgtagctgagattgtgattcatattcgcaataagatcttaacaggagctgatggtaaaaacctcaccaagaatgatctttatccaaatccaaaggtaaaaggtggttacgtttgcatgtggataatggtatttagggaaaaagtaagctactaggtctattgtgtggcaagaaagggatatggcctcctatttgatggagaccagtcattttcattgagagagaatctctcacctagcataatttaaaaataacactaagtttatatgtgtggtgacttctacattcccattaggattcaattctttaatatagtcgttttcttaaaaaaaaaaaagcttctaaaccatattaaagtatattaaattttttattattattattggaatggtggtctgagagtatcatttattgatagggcttcaaggaacttattccaagtggttttcaaccacaaaaaatgcttagaaataatcctctttggaagcctacagattaattttcatgcattatgccccagggggaattgacttgttttgacaggtattgttttttatatctttagttattaaatacaaaatgaactatttatgtgtcacagaaaatcccaaagtctccttccagtttcttgtgttggacttgaagtgataacgtagtaaaacctggtgtaatggtgtagaactcaaactttctgatgtcactaccctctttgattctcgaaaatggaagaaataccttagaataactgatgtcttcaaactgagtaaattcagctttcttaaaagattaccacgttttccctatatttcccgtcttaatgctcacccaataaacttgtattaatatatggatcagaacagattcacaggtcagcatttaggaactgctgttttagaagatccggtttttaaaattctatataaccctattacatttatacctcctgatcaagtgttcccttaaacttcaaatctaaggaaaccttaatatctatggcagcaaacaaggtttcctgtgttcacacacacacacacacacacacacacacacacacacacacacattttccatgtgccattatttctgccacatgcctgacagcctgttctgaaagattaactcttcttcttctatttcctaaggtggatgggttgcttggattggatttgggtatacttgctctcattcttaaacagctgatcccattgaccacttatatatgagcaaactaagcatcataaggtgttttaaaatttggaaaaattaaggaatatttcaagggaaatggaataattttgttgcctttttcttctttgctttcatcgattataatattgtatggtaatgatgatagtgacatagctttagagttatgcatcggagtattcaaagttgttttttgctgtagcctgaagtcttgcacatgatctacatgagagccttacaaatagtatatggaattcgactggaacatttttacatggtgagtttaagatgaggcaaaattatggggttttttttgtttgtttgtttgttttgttttgctgcagttctgcttacaatgcatactggcttttaggataggaagttcttgactttatttttaacaaattcaaagacatataaaattagtgtcacttacaatgggatcttatgcacaataatggtttatatccatagatttagtaagatgaaaaccatagtaaaagacttaaatgacacagatcattgatgcaatgcaattgttatagatttataggtttgttttcagagactacaataaacaatagctaagtcttcatattgttctcttttcaggaagaactcccaaattagagtagaagatatgcagtaagattgaaacaattgaaatgaggcaactgagcttttagcaaattatttgcataatacctgatatttagtaaatgctaaccttattccatttttaaaattcatttaaaaatctttattaagcacctactgtgaacctagcattaataatgatgaaaactctgcatttatactaggatatgtattaaggtttttaatttaatgatagtgagttaatatattttgatcttggttgaagatttttctcattttgtctaatcaatgtgtaatgtcgattttgtggtttattgcatttagatgccagtgaactctgaagtcatgtatccacatttaatggaaggcttcttaccattcagcaatttagttactcatctgtgagtaaagagtgattttattgtcttcgtctacattcgtatttatattacattaagttttcttaatgacatggttttctttggtaaggaatacctactatgttccttttcatttcatcccatatacattcattcaaactttcaaaattgtagactgtcatcaaacagaactgcctccaactgtgccactttctcagcatattttcaattgaacttctaagatactgtaagtcgaaaattgtttaccgtctttgtgaagaggtttgagttcttaaaagagtcttagtgtcaccaagtttatgtactatttattagaatctgtaactatactttagtattgcatgactacatgattaatatacagaaaaaatagatttcagtgctatagggttatacattatagtagaattctggcttcgtccactgaccttaagaaatatatccagaaatctctttctgaaaataagatgtttatatcctatagcttagcatttaatgtgcaaaatacttttcaatagtctttttgtacttcatcttcaagggactcatttttgcctatctgccgggtgaatgactttgagactgctgatattctatgtccaagtaagtgagaatttaaaacagttttaatgtctggcttcgatctaccatttcacctttccatcagtaaatgtaaaaaaaaaaaaaaaggaaaaaaacaacttcaaggaaattgcctttaaaaagtatatcccatttttaagtatgaatttttaatatcttgttgaatttctttttttccttttgagagccacagaaaagctgtttttctgatgtttttttaaaactccttccatttaaaaagtgttctataaatttgggaatatgactacaaataatatgtaagtatgattttgcatagtggattcatcataccaattttatcaaatgtaagaattactatttaccatatagaaattatcttttatcattaaaagaatagtcataatgttatattagaatgtaaaattctagctttaattgtccttaaattcgactttgatatttatccatcaagttactgtaagttaagagatttggtgtgtgtattaggctattcttgtattgctataaagaaatacctgagactgggtaatttataaagaaaagggatttaattggctcacagttgtgcaggttatacaggaagcatgatgctggcatttgcttgcttttggggaggcctctggaagcttagtcatgacagaaggcaaatggggagcagacatgtcacatagccagagggagcaaaagcacaatggggaaggtgccacacacttttaagtgaccagatcttgtgagaactcactcactgtagacaggacagcatcaaccatactcttaactttacaatccagcaatcatgctccttggtatttagccaaatgaatcgaaagcttatattcacacaaaaacttaaacacagatgtttagagcaactttattcataattaccagaatttgaaagtagccttggtgaatgaataaactgtagtacatctagagaatagaagttattcaacactacaaggaaattagctagcaagctatgagaagacatagaggaatattaaatgcatattattaagtgaaagaagccagtctgcaaagcctacacagctatatatcattctggaaagggcaatattgtggagacagtgaaaagatcagtggaaaccactggttaggggtgagggagggatgaataggatccctttagcactaaggatttttagggcagtaacaatactctgtatgctactctaatggtagatacttgtcattatgcatgtgttgaaactcagaatgtacagtaccaggagtgaactctaatgtaaactgaatttgggatgataatgatgtgtcagtgcaagttcatcagttgtaacaaatataccactcaggtgaaggaagttggtggagaggagtttgtacatgtgtggggacccaaggtatatgggaactatctacttcctgtttagatttactttgaacttaaaactcctttcaaaaaggaagtctattaaaaattaattgactgtatatttgtctatttttgagctcgctattctactccattgatctgtatgtctatctttatgtcaagcagtactttgattatttagctttacagtaaattttgaaatcagtgttactcctctttcttcatctttgtcaagattattttggctattctggtcctttgcatctctatatgtattttagtatttccagcttgtcactttctacccttcttcccctgaaaaagccattttgattgagattacttttaatgtattgttcatttgggggatatttgacaatttaataatattgggtcttctgatccatatgcatgctatatctctgcatttattaaggctgttaaatttctcataatgatgtactataaatttcagagtgcagaccttgtataataaattttgttaaatttatgcctaaatcaaatttttagtggttctgtaaatttaatttaaattttctgattagtcattgttagtgtagacaagtacaattgatttttatatattgactttgctaaaatcacttattatttgagtagatttttttttttgtagattccttaggattttccttattgacaattctcaatttttgtttgaggacaaaatttttttctaatagagatgccttttattcttttttttttttttttacgtttctgcactggctgggacttttagtataatgtcgaattgaaatgatgagagcagtcatcattaccttgtttctgatcttgggggaaaccatttagtctttcattattaagtattcgttgtaggatttttcttagatgttttttatcagaatgtacaacttttactttatttcactgagagtttttatcatgaagggtattaaatgccttttcggcctctagtgagataatcatgggttttctcttttttaatctaccaaattacattacttgatttttgaatatcaagccaaccttgcattcaggatgtgtcctgattggttatgatatatttttaatatattgctagatttgatttgctaatattttattaagtttttttgtctgtgttcatgatggatattgttctgtagtttttttgcaatgtcactgcagtgactgatctgaatatcaggatataccagtctcatacaatacatttggaaagattcccgcttccatttttgggaattgttttataaaatttgtattatttatttcttttttgaatatttggtagaatttaccagtggatctatcttggattgcagttttctctctgggataaattaagaattcaaagtctttaataggttaagggctattctggttgtttattgtcaaaactcctgagtgagctttggtgatttatttttttaaaggaatttttaggttggcaaatttgttaacataaaattgttcattatattcccatattattttaatgttattggggtaggtaataacatcttctctatcatttctgtcattaataatttgtttattctttttttttcctaaccagtctggttatcagcttatcacttttcaaagaactagcttttgacttaattgacttttctgtatttctggtttttgattattattgaattttgagcttattgttattctttcttcatggttattttgggtttcatttactctttttttctagttttgttttttttaaggcagtaagccaagtccattaattagatacctttcttctttcctaatataggtatttattgctgtaaatttccctctagcactgctttagctgcatcccccaaaccttgatatgttgtattttcatttttattgggttcaagatattttctaatttcccttttgatttcttttttcatgtatgggttatttataagtgtgttgtctgctttccaaatatttggggattttcccacaattttttctgttactgatttgtaagttatttcttttgtgatcagagaatatactttgtatcatttgaatccatttaaatgtattcacacttattttatggcccagaatatggtctatatttgttcactatggtggctgtaataaatcaccacaaacttggtgacttaagataacatacatttattctcctgtagttctagtggtcagaagttcaaaattggtttcactgagccaaaaccaaggtgttactaaggttgcactccttcagatggctctaggagagagtcagtttctttgccttttctagcttctagggttgcatttctcagctcatgacctttctgtctttgaagccagcagtgtagcatatttaaatctgtttctactttcatgatcacattgctttctattttctgtgtatagtccaatctctctctactttcctcttataaagacacttgtgattgcatttagggcccacctagatattctagaataattttctcatttcaagatcttcaattatacttataaagccactttgcaaataagataacatgcacaaattccaaggagtaggacctgaacatctttgggtgctattattcagcccaccacatggtctacccttgtaaaagttccatgagtgctgttgttgatgagtggagtgttttaaacatgttaattggatccagttggttaatagcgttgttcaagcctactgggtccttacagacttttttcctggttgttctttgaactgttgatagagagatgttaaaatcttcagctatgattgtgagtttgtctgttttgtctgttcttttaatttttgttttatgtaccttgaagctctagttttagaagtgtacacatttagaattgctatatcctcttgatgacatagtctttgttctgaaatatacttgattttatattaacatagctacttcaggtttcttttcattagtattaccatgccatatcatccttgtaacttgtgcctttggattcaaaacgggtttcttgtagacagcatatggttgggtcttgctttttaaattcaacatcactatctcggtcttttaatcggagtcttagaccatttacatttaatgttattattgatatgattgggcttaaatccacctttatactatttgttttctctttgtcctgttctttagtcctgttttctccatttcctgccttattttggtctattaaaataaattttattttatataatactatatatgaaaaagatattctaccttgtctgttattggcttatcagctatatgtctttttaaaatggtatttgctccaagtttcagtatacatgtatatatctttaacataccattgtctatcttcaaatatattataccttacaataatatacttttattttctccactactggtctttgtgctattgtgtcataaattttacttttacagatatcataaacaccttaatcgatattagatttgtgtgaaacagttatcttttaaaggattttctattttgacatttaaaaaatacatgtagtgggtacaagtccacatttcttacatacatatattgtgtagtggtgaaatctcggcttttagtgcacccatcactcaagtagtgaacattgtaccaaatcagtaattttccaacccttgtccctctcctaccctcccacattttgtagtctccagtgtctgttctactttgtatgtccatgtgtacccattatttatttcccacttataagtgacaatgtgcagtatttgactttctgtttctgagttatttcacttaggataatggcctcaagttccaaccatattgctgcagaagacattatttcttctttttagtggttgagtagtgttctctggtatatgcataccacatttttaaaatccaatcctccactgattgacgcaggttcattttatatgtttgctattgtgaatagtgctacaataaacatacaagtgcattaatctttttgatataatgatttctttcttaaagggattttttatatgaggaaaaatgtcttctatattaactcacattcttgtaagtacaccaaatttccatctggtatgatttttcttagacatgaaggattttatttaacacttattgtagtgctgttaaaaagcctttatttcactttaatttttgaaaggtatttttcttgaggccaggtgcagtgactctcacctgtaatcttatcactttgagaggccaaggtgagagaattgcttgagtccaggagtttgagaccagcctgggcaatatagcaagatcctttttctacaaaaaaaatgttaaaaatgagccagatgtggtgatgcatacctgtaatcctagctattccagcagcttagaggggagaatcactggagaacaggagttcaaggctgcagggagctatgatcgtgccactgcatcccagcctgagcaacagagtgagacctgcttctttttgagaaggaaagaaagaaaaatggataaataaaaggtgtttttcttgagccctcggtggatatgaaaagtcaacttttcaatccacagttggttaaatctgcagatgcagaatgcacagatatggagggctgactgtactatgccattttttgtgtgtttgtcttgttttgttttttttgtttttgtttttgagatggagtctcgctctgtcaccaggctggagtgcagtggcacagtctcggcttactgcaacctccgcctcccaggttcaagtgattctcctgcctcagcctcctgagtagctgggactacaggtgcatgtaaccacacccagctaatttttgtatttttagtagagaaggggtttcatcatgttggccaggatggtctcaatctcttgaccttgtgatccgcccacctcggcctcccaaagtgctaggattacaggtgtgagccaccacacccagccactatgccaggtgtaagggactggtgcatccacagacttgggttctctaggcatcttggaaccaatatctagcagatactgagggactacagtatagaattcttagttgacagttttttcagtgctttaaatatattgctccattgtcttctggcttacattgtttctgatgagaagtctattgcttttcttatctttgtttctctctatataatgtgttttgttttcctctggctgcttctaagatttttttgtcttctaagctagttgttagccgtttgaatataatgtgacttttaggtgtttgtttttggtttttttttgtttgtttttctgttctttcttccctccccctacacccctgcccgccatttacgtttgttcactttcttggatatggttattgtttttatacaatttggaaaatattcaactattctgtaaaagtctttttgtccctttttgtaggattccaattacacattagttatgctgtttgatattgtctctcagctcacagatattgtattcatttttttctctctggactttattttagataacttctattatgtcttcaacttcatgaatcctttttattttaggtctgaactactgttattcccatcagtgtaatttttatttcaggtatttttcaactctaaaagcttaattcagatcttttttaaaaaatctttgcttttatttcttcatattgctgattcttttctctatcccctttatttatttataaaggttgttttcacattcttatctactaaatctaccatgtatgttatttgtgttatgttttaatatgtttctgttgattgattgtattttcttattatggatcatgtcctttttcttggcatgtctggttatttttagcagatgccagacattgtgaattttaccttgttggttaactgagaacctgaggggattcctctacagatttccagaactctttctctttacagcttcctcatcttaatactcagttccataaatcctagttgctttggcttctgcaaactctaaactctgtcttcttgacccagcaagatgtacaagttttatttgtgttctctttctctggagtacagcctgtaaactcttcagtcatggactggtgcagtaatggaattcacctcatttgtttctcttggagattgctgtcctatattgccttttatccagcatctaaaatttgttgcttcatgtatttttgtttttctagttttttaatatgggagggtaattctggtttctgttatttcttcatgaccaaaagtggtttacctttttttttaaagttattaatacaaagataatttttacctttaagttagagcagattttctacactttgttatatcctatacagttttattttatatattatgagcagaatatatagtggaagaggatgaattttcattttcatattatgttagttcaaaggtttatttaaagagtcttgctttctattttagaagcaaaacggacaagtcggtttttaagtggcattatcaactttattcacttcagagaagcatgccgtgaaacgtatatggaatttctttggcaatatgtaagatttaaatatgttttggggttacatgccagatcagtaacattatttatgaacttataatctgttttgaaatgattgtcatagacagcaaattgctgtattgcctttagaattgaactcatttttatatttatattaacttgcagattttagttactggatagcatatctcagaatcagattttctttgaaatttggtaacactatggagaggctgagttctgtttgttttaaaatcttgtagctgaggcttgttttcctatattaggaaatgttagagaatattgatatgtttacatttttttctttgaagtttgcgtagatagtgtagcttttattaaataacggacatatttgaggtttatatttgccttttaaataatggcataattggactgtttgtggtggtgtttatcatgcttgcccagattcagtccaaggcaatctctttaacagacagaaactcattttcctttcatcaacaacttaaagaactgggggagattatgggtcatctgtgtgatttttcccatttgtcttcaataatggggtaccatactcttagaaaaacaccagagtaactccaaacacttagaccctaggcttcagctttactgagctatatagatccgtacttctttgcacaaatcatgctaaccttataactcctaaacatcatataatcttcaaagcttaccacattcatgtgccaacatacacacactctcataattttgcttggttaattactatctttaagacacacctcagacatctatcacctctatgatgtcctatcacccttcttcccagccattacccaagttgggttagatgtcactcttgttggttcccattatatgaaaaataacaagctattttgtgggtttttattcttgtatctggctcctcaaggaggcttagctacttaaggtcaagacctataagttagtcttcttgagaattctcagtaccgagctcagtgcctatgatgagaatccagcatttgtgttgagtaaagaaattcctaattcatttgtcatgaaggcctaactctatcttaaattttttatttctgatggttcaaactatagtatgagtaaacattttggacacactgattgtgttgaaatgcactaatatgagatgattaaaattgctttaatagaaatcctctgcggacaaaatgcaacagttaaacgccgcacaccaggaggcattaatgaaactggagagacttgagtaagtgggagatttacaagtaaaataaatgcaatttcaaaatgcaaaatgaattgtaagtagtattttacaaccctatattccaccttaagtctcttttatctcccttaataaatagcagagtatttgagtttgccttttcttaaaaaaaaaaaaaagaaaaaactagtttttcttctaactcttaattatataatacatcctttggcttttgttgttgttgttgttagtgtgttagcctgatttgtttaaagccattagcttactgtcctgatttatgtctggaatattgtcttatgtaggtgagcagtaactgcctggactatcttccttcagatcagttgattccatcaaatgtttactcctacaacaaagttttcatttatttgttttgtttttgacttataggttatgtagggaaaagaatcactcaacagttgtgatttcttggccttccttatatatatatattgattttgagcaggatttttaaaatctcttctaatttatagatgtctttgaggttatctgttttagatgagagattttctaacctgcccctggttaaaattgcctttacaggcagacattagaatataacagggtaaaagatgccaccaactaaatcaaaacaagaatgacaaagtggagagaatatttgcagcacatgccacaaagccttaccaactctaataacaaaacccatgtaatattcctaatatacaaatataatatgcagaactacaaagcagtcctgtaaactgacaggaaaaatgataactttaaaaaaatagacaaaggctttaaacagggagtttatataaaaatagctaatatatcagataggcaaaaactaaatttgaaaacgttcttatagaagagacttgaacacgtgtaagtgttgtaaggaaggactagtagcggaagaatggatggtatgggagtaagagttgtgaggcaatgatagccagtgcagaggtagagaaatcagcattaccagaaggcatacaatattcatgttattaggagtgaagttagaaaggataggtatgtgtgtggatggatccatagatttgatagtagaaaactgaaggagctcatgtgatttttattttctgcctgtagtagaggccagatcattcattttaaatgattgccacatgaaagggtgtaattcagaaacataaaagtagacaatttcttcatctcagttatttgaggacaggtatttcattttagcctttcaaaagtgaagagcagtattttaatctattttgctgtgttaagttctgttccagttgaagagcaagaagagttcaagcagctttcagatggaattcaggagctacaacaatcactaaatcaggattttcatcaaaaaacggtatctgttgtgaggcaccttaaactttaaaaaacaaaatttgtttgtagatgtggtgggacatatagtggaggtaacagcacattgctttctctattaccaaagaaacagaatatatttctgtgcccatttgtgccccttataatggatacatacttctctcaaccatctagaaccgtgatggtttttgttggcaaagttttttgttgtcttattgaatagaattttttagggttttcctaggtttaatttcactgcttccaaaccatgcactgtggcaccctggatactgcagtaaaccctcaagaatgcctcaaaatatcttaaattttcaagggaaccactgtagtactcagcatctgtcatatcctttttgaattcaaggtagttcacagtttcagtttttggtcacattcctttcatatccttgtgcagctgggattttggtatttgctgtgataaaagcaagtacaatgtaaaaatcactgtgacacaggaaatgagaatgtctatatccaatctgaaatatacgctccaacgtacgtgaatttatgcagtgcccaataggtacatacatctaattaggaagtactcgaggttatttaagaacaaaataaaaattttttctttcaacttatatgtattatttttcaaagggctacaatgttaggacataaatactaggccattatttggagttaactacttagtaaaggaactcttagatatttcttttggcttaggagcatcatgaacagagaaagtttgaagaatatctgatctaacacatttaactcctttcttaccttaattttatgagacagcagtgagtggctaaatctaaatgttttgaatcattataaaacgtgtttgctttttcccttagatagtgctgcaagagggaaattcccaaaagaagtcaaatatttcagagaaaaccaagcgtttggtaaacatcttttcttttcactagcatttaaagtttgaatatattgtgtggaggagtattttagctgtgtgtgttattatgggcaaatgtttctccctttttcccttcaaaatgaaacaatctttttcaacttaaatataatagatgactattgttttaaaaaatatcgaaacacagaaatgtatgaagaaagtaaacatcacctgaaagctcactatacaatctgatttatatcaaagattgtatttgctatgcaaatgtaaatatgcatgtgtaattttacataaatgatattaggctcaatacatcttacctgcttttttctccacttagcgatataatacagttatgaattttaaatagatcctcattatattaatgcttgcatctagttgagcattatatgtatgtgctgtcttgtagatccttttaatccccttctgatagacttttacatagattctaattttttgctattaaacagaaatatatgtatgtgtgtatcatatgcatacatatgtacatacatacatttctgcaacaggctgcttttatttaaaataaatttttttgtttaggatttctgggtcataggaaatacacatgtaaaattgaccaatgcagccaagctgatttctagaaagataccaatttatattcctaccagtagaacaagagactgtccctttccctatacccttgccaaaactggatgttttcaggcttttaaaatctttgttactgttacattgaaaaaaaaatctcattttatttgtacttattttattttttagtttttttgagacagagtctcactctgtcacccaggctggagtgcagtggcgcgatcttggctcactgcaacctccacctcctgggttcgagcgattcttctgcctcagcctcctgaccagctgggactacaggcttgtgccgccacacccagctaatttttgtgtttttagtagaggcggggttttaccatattatgcaagctggtctcaaactcttcacctcgtgatccacccgccttggcctctcaaagtgctgggattacaggcatgagcgaccacaccaggccaaaaaaatctcattttagtttaattgctttaattctagtgattttgtccatcttgcttagtgatttcttgttatttcttattttgtatattgtttgtgtaccttgtttatttattttatttatttatttattttttgagatggagtctcactcttttgcccaggttggagtgcagtgtggcatgatgtcagctcactgcaacctctgcctcccgggttcaagggattctcttgcctcagcctcccaagtagctgggattacaggcatccaccaccactcccggctaatttttttgtatttttagtagagatggggttttaccatgttggccaggctggttttgaactcctgacctcaggggacctgcccacctcggcctctgaaagtgccaggattacaggtgtgagccaccgcacccggccacttatttatttttcaagaaactccatgaattagggattttagctctccatttatttgtctgtcaaatttatatattttttgcccattaaaaggtttatgtttttatgtagtaaaatttatagatacggcctttatggtttttggctttaattgtgtacatagaaaggacggtcctattcgtcagattattttttaatactatattttctcattgtacttttatagtttccttattgttttaaaatgtatactttagatccttgagaaacttactctggtgttatatttcccttatttttctatctttttttttgctgggaaatgctttcatctgagtagtacttactatggctcaattttattgtttatttatttctgtctcatttaaatccaagttaaaacaagcactttgtacttattaagtttagaccttttataaagaggagaaaagtgatgaaagttaacactattgtaaggaaaataacctctaatcttgtagagcattaaaagagtagataatgtggtggtttgcagaactctaagaatgaaataacaaaatatacagaaattacaggaatgcattatatctaacattcagttttggcgtctgagttagctgatcaaaaagtaagaatcttttcttttaagttaaaaatatttagacaaattacacaacacagtaatacattcctgttatgaaatattctctctttacatacacacacccacacatacatatatatatatgtatgtatatagagagaggggagtatacacacatatagagagagacagagaagggtacgaaatgtgaaaggccttctctcagcccattttaccttgaggtaatactattcccttcctttttccaacatcatatgcatacacatatagaggcacataatcatgtgtcactgttttgttgttctgtttttatagaaatgtatttatgtgttatatgttgatctgtgaattggttctttcacttaatatatctggaaaatctttcctgtcaatacatagagtcatagagggtccccaaacaatgtaaatacaacttatcaacaaatatctgagaagaaaattcataggaattttttttgacataatttcagacttacaacaaactttcaagagaatttccagctacccttcactttgattcttcaaatagttacattcatttttgaaattcaggagaagggaatttgttttcattcagcaagcatgtagtgagcaccttctcagtgctatagctttgtttgggtactgggaaaaccaggatacattttcacaactccaatttgctcagtcttatgaaacacatattaagtacataattatagtgttgcatgtacaaaaattgtactatttaaagaagaaatgtagagaaaatgggagcaggattttcagggatcagtacaaatttagcaggcagaccggagtgggataatgatattctaggaggaccctactggtcaaagaaagatcacttatacttgtctaaacataagatcagaattaccagattgtagggtgcagtagggaactggtgggagatgagactagacaggaagagagttaagagccatgtaatgaaaggctttgaatgtcctgctaaggagcttgatctttggcctatagacaaatgtgagcaattaagtaggtaagtgatgtgttcagaatttaattttaccctcattacagagaacatggacctaatttctttgttctttcccattactagaatggtaaatcaccaagtttattatatctaatatataaaaatgttttctcaacagaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagagtgagttttctttttattttaatgcttttgtatctaaaaaaaaaaattagcaaattcttgtttaattatgtgttaatttttggatttctgaattatctatacttctcttcctcttaaacttttttgaccttatttctaatctgtagcttttctctagagtgaatatggggaaaataaatataatttcaagacatttgttcaattatgcaacaatttttcgaggcttttctctgggagatcaaaacagaaatgctgggtggtgagatttaattactttattacaagggaggaaagtattaagtaattttacaaacaattgtaattataaattacaatatatactataacaaagtataaggtatgcatgtgtgtaggtaggggtatacgagaaatctctgtaccttctgattaattttgctgtgaatgtctaactgcttgaaaaattaaaatctattaatggtatcagaaagaggaaagaaagtatagagtgctttgaaataatgtaataaggggagcccagtttagtattgggctggaagtacaggtggaagagggaaggaagaatgctaccattcttcagatcgtagcataaaaaaaaagacgcttttcattttaaacatagcagtaccaaggcccaattcattgtgtatggaagaatattaaaggcagagggaacagcgtatgtgaattctgtggggtagtggggagtaaggtgtgttcaagattatgggttactgtgggagatggattgacgtggtgcaatacaaacttagaagtgggtagacaatttaccatcttttgtgaagcaatgtttttaaactattaatttaaaaaacatatgtggtttgtgtttgaatttgttattcagttcattcttgacaattaagattaccacactagactagacaaagatcaccagaacagaaatgagaacccagaaatagatttgagtattaatgagaaaaggatgatttatttaagaaacagttctggctcaattagctattcatctggaagaaaagggtgttgggtctacactttgctcttttacaaaaataaattttgtatgtattgaaaatttaccttaaaaaatttaagttttacagattttaggagaacacttatataatcttggactgagatagatttttgaaattaagattggaaacagaaaatctatagagaaaagtagacacattagaacataattacggtgcatatgacaggtagagggattatatccatgatttgcaaagagtattttacaaattagtaagaaaaagaaaaaaataaggtagaacaaggggtaggctagtgaggacaagggaaggaatctttgtattgttaccatggttgtagtaaatatatgttcattttgtaattttagaagatgagttaatgtttttaaaagaattagctatagtagtcgttattatacaaatgaatgggaagattataaatgagtaatacgattgattgcccaggagtaatcagaaatagtttgagtattagcaaaataaactattttaatatcatcattattaacttttggaaggtatttcattgagtagtaaaattatggcacttttcctttgtttgaagatacttggcaattaaaaaacaattatttgtgcttaaacacatgtcagtaatagtgctgtattactgacctagaaatttaattgttccgtgctcttaaggtttcagtattaaatgtggaaattatttaagagcaaacaaattgatattactgcagcttcataaagaagaatatcaaactgtggtctctgttttttgtctttcaaagcaagaagtggtggagaaatatgaaatctatggagactcagttgactgcctgccttcatgtcagttggaagtgcagttatatcaaaagaaaatacaggacctttcagataatagggaaaaattagccagtatcttaaaggaggtttgtattgtatggaattttgatgtctttattatataacagcttactatagttccttgtattttgctttcactttttgttatgttttcctaaagaaaaacagggtcattctacagtataatagatgtggcaatgtatgctatgaaaaagacacttttctttttaaacatagcagtagcaagacccaatttttaaccttctgatgaaattaataataactaacccatcacattgctgtgtatattttggaaaatagtacagtagctcccccttatccttaggagattcatttcaggacctccaggggatgcctgaaactgtggatagtaacaaaccttatatatatatatatgttttttcctttatgtacatacctatgataaagtttaatttaaaacttaggcacagtaagagattaacaataattactaataaaagaacatttatagcaatatactgtaataaaagttatgtgaatgtggtctctctctcaaaatatcttattgtactaaaatcaataagtttagtacaatgatgtgagatgataaaatgcctacataaaaaattgaagtgagatattgctaggctactgttaatcttctgaccatacatcagagtaaggatcatctgcttcaggtgatcctagatcctcaaggcactatgatgtcgacagttggatgttgatgactaaagagcaagtggtgtatacagcatgaatctgctgggcaaagggatgattcacttccagggtcagggctgggcatggtggctcaagcctgtaataccagcacttcggaaggctgaggcgggaggaccattgagaccaagagttggagaccagcttgaacaacatagcaagatgctatctctacagaaaattttaaaaattagccagctataatggtgtatgtctgtagtcccagccacttgggagtctgaggtgggaggatcacttgagtcaagactgcagtgagctatgatcatgccgccacacttccagtctgagtgacagagtgaagccccatctgaaaagcacacacacacacacaaacatccagggtggaatggagtaggatggcgcaagatttaatcacactacttagaacagcacacaatttaaaactgatgaattttttatttctgatactttccatttaatatttttagaccacagttgaccaggggtaactgtaaccatggaaagtgaagccatggataaggggaactactgtcatgggattttaaatttgttctaccagttggaaatgatcttagcatcagaaagttccaacttagtgcccaacactgtatctaggacctatagagagatttaaagtttattacatagtctgccctgaagaaatgagagctaagggcggtttctcaggctacaagcttgaaaatccttttttgcttcttaacttgatcatcttcatccaggctgcgcctccaggataactaacattacatttgataaacaatttcttttttgagataagtagggattagaaggtgagattgccccaggtattctttcccaactacatagtcccctcatctgccattgtgttacccaaaaaagatgtgtatctactgctttgaattgtttctagcacctacccttttccctttatttgtactactttagttcagatcctaacccctcaactctagtctcttagctaatcttaacatgtctccctttcagtctgtactgatagaaaacacctctctagttgtcatgtcctttctcagtatctctgatgcctccttgttgtctcttctggttcatctgcatttttctgccggactttcaggttttaaagagttttgtctctttttaaatttgtgtttaattatagttcatcctagaaaatattctttcattttatttctaaatcctaattggttatgttgactttaaatacttcttataaaatacagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgagtatggagttgttttcaattttagtgtattagaaagcaattatgaaaaacaaatacatttttcccccaggatttcaaaacctcggtattttccaaaagagtttaaacagctttatctttatttcacctttagttgactaaaacagatgagttaattataaaacttatactgctagttctagatttagagatgtcttagctactcttttcctgggtatacagttccaattcctttgcatcattcttcagaagggttctgatgctactgattatttcattgcactttagagatagtggtctagcttgcatcagaattaactaaatggcctatcttatagtccagcttgtctgtagagttacagcatttgtgttttgagaaaaagtcatatattcaggtaagaagtaatactttcctaagtatgtaagtatgtttttagctggtacgttagggtactttattggtaaaatacccatcagttctaagaatgtgtttttaaaatacctgccccagatatgtctataatctcattccttcagttactaaaaggtgcgtcagagatcatctgagtatttccttcatacttcctcttgcagatgaaaaagggcagaacttaaggattttatgtttgttgccaaactgccttgtagaaaagttaaactgattcacattcccaccaacagtacctaagtgtgtacaactggggaaatgtaacttaaaaaatcttcattttaaatattgattgattgattgatttactcattcactaacccaccaatgagggaaaaaaaatctcattaatatattgagagaaagagttcacactatgttgtgatgtgattatagtaccacactttggggttttcattcctttgcttttatatcttgagaagagttttaggtttgtcaaatactgacacatggtcactttggaatcaaaactagaattgtgtttgcctttttagttgctgaagaggattaaatattagctgtctcgattttctttcagggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggtgaatatgtgttcataagaagttaatttcaaataatctctcatgtatttgagttgttaactgaaacaaaacagcttacttggtctctgtgtaatgagacttttaatgatacctaaaattatttactctttattcttgttttgaatatatttactgtaaagcttcataaatagtcctaagtttaatgagaacaggcatcttgtctcctacatttttatctttaaaaatgctagtacagtgctaaacataaaatgtttacctgtttctattcttttaactgccaatgtctctaacaagtagtatattcctaatatatttattaaatatttattgtctccttatcttttgaagtttgatttatgtcttcaagagtgttctaccagaacaatagttcaaactgctctgccagaaatcacaaaaaattgctatttattatgcaaaatcccttagcctctttttttttcattcttcaccttgtttacattgacaacttagattgaggtttctaaaaccgctgatacctgataaatagttaaacatttgctgccattactttccgtcatccacacccaatttgtaaaaattcttaatactaacagagccacagtagacaattcccttatctgttctcagtaccttatcccccagaaagattatgttgttagcacttgcacatgtgagcattatcttaaggctactttaaaaggaaggaaaggaaaggtagtggagtgaggaaaggaagagggaaactggaaggaaaagaaataaaatggttgggatttcacgtccatggtcttcccaatacctggcctgctcttttctgttttttgtttttttttttctatacctcaactacttttatttttcctgcctcttaacttgatattcaccaagagtcagtctctctagtatggcaattagaaagacttagcagatattggctgggcgcggtggctcatgcctgtaatcccagcactttgggaggccgaggcgggcggatcacgaggtcaggagatcgagaccatcctggctaacaccgtgaaaccccgtctctactaaaaatacagaaaaattagccaggcgtggtggtgggtgcctgtagtcccagctactcgggaggctgaggcaggagaatggcgtgaacccgggaggcagagcttgcagtgagctgagatcgcaccactgcactccagcctgggcgacagagcaagactccgtctcaaaaaaaaaaaaagaaagacttagcagatatttaatcctgcttcttaaccgaatcaaatcaataaatatttatgtgttactacatggtctaggaacagttagtgaaccagttactaacaatttagtaactagttactaactcaaattcgaggcacctttgtctatcagtcataagagatacccatgcctaccttatattactttgagttttatgcatatatgtcttgccagttacattttccatttcttaacagtagcaattgtctattgttaaccttagcatatcatgtcaaaccatgcctagaatggtgccttatgtgtagtatgttttccataaatatttataaaattgaaaggtcatctagcatggtgcttcttaaaactagctgtgtattcgaattcagtgaggaattttaagatgaacaaatcctcacccaaacacattgattagcatctccagcaatggggcccatgaaatgtgttttttaatgtggcatttgagacccactaataggcttggcttaattgtgttcaatggtatagagttttcaataggtatggccacccaagctgttctactagggcagctttaattgttaaaattctgtctcttattttgagtttaaaatatttatttctgtactctatagtcagcccagatcttctctgtggagcaaatgtgtacccttttctgcttaataacccttcagacatttgaggataatgatcacggtttctttcagccttctcatattcaggataattagtcctagttttccaccattctttatatagcttcattttcagatttattactatcctatttactgtcatctctgtttcctatttgtcattattctgcttaagatttacaacccagtgctaaacacagtcttccaaaataatgatgtgaccagccagacccaaaacacatttttagtgaagcataatattggggtagatttttagcagcagcatcttgcccttgacttatattgaccttgtgatcagttaaaggactcctgtcttttccacataaagttctgccttgttaagagtttttcaccatactttagcacaactgttacttttaattcagaattttacttttttaggttttatttatttcaacctagatttcaaaatgtcaaggttagtttaaatctatcattctgtcttccaccttaactatttctcattgcttagtgtcacctgcagatttgatcagcatgcctttttcttcaaaataaaaatgtttactagaacaaggtcctttgctgcattataattttttcatcctagaggcgtagaactattgatcaaaactttgggtacaattcttcaacttgctaagttgttcttacctaccttgattcaggctacgttgtgatatctatttgttacacaaatgggaaggtctctaaatactttggtaaaatcaaatactttttgtcaaagaactcttcttagcttactttataatcatccttcatgaaaagaaaaaaggatatgattgccaaattgttctttgtgcagttctgttgcattttgtgatcatcatagtcttttttcattaaatgttctttcccatagataatttatctcttctagtttcaattattatcttcatttggatagctttcaaaaatctatgtttcttgttctgtccactcacaacaaaaataatattttaaaattacattcaacattttcccacatctgaccttttcttcactttctttcccttttctttttctctcttttgctcaacttcttcataaatttctttgtatttctcaattgcatcatcattttctatcacaaagcattgaaattttggacttgctttagataattctgacatccagataatctccaagttaatttcatgattgcttttacatggtggtactcttcatacatgtacatagcccttcatacatacagcgctcttattattatacgtctgtcacataattttgtagtagtcatggattgcagcaacatttgctaagtttctttgattttagattcttctgcatcaaatatgccttgaatactaagtactaccacatttatcctgctaaaatattattctcaatactacactttcttgtttaaaacaagggccattttccttcagttcattcattcacccagtcagtatttcaacaaatggccaatgtatctgctaggtgtcaggcttcacacttgattcagagagtaagttgtgaacaaggcaggaatgatttccacctctaggactttcaaaattttctgtctggctgggtgtggtggctcacgcctgtaatcccagcactttgggaggccgaggcaggcggatcacgaggtcaggagatcgagaccgtcctggctaacacagtgaaaccccgtctctactaaaaatacaaaaaattagccgggcgtggtggcgggcgcctgtagtcccagctactcaggaagctgaggctggagaatgtcgtgaacccgggaggcggagcttgcagcgagctgagattgcaccactgcactccagcctgggcgacagagcgagactccgtctcaaaaaaaaaaaaaatattctatctaagctaatcatttccattatttaaggtccagtagaaactatgtcttccacataactttcttttacttctttgaagtatctttctgttctctctcaaatactatagcactctcagtctattccaaataatctggatgtgtgctgtccagtggggagctattagtaatatgtggctatttacatttaaattaattacagtgaaataaaataaaaaattttgttctttatttgcactagctatatttcaggtgctcgatatccaaactggtctggttatatgttcatttaggaaagaaaccataattggtgtctttcattgtactattgtactatttacagtgctacttatacaaagtacccaataatatattggttgactaatttatacgtatgtgataaatggctacactggctgtaagactccatggatagtgtatagtcttaaatatttctgatttgaaaagtgagatagttatctagactgacactgtccaacagaactttctgctgtaatgagaatgttcttctgtattgctgaatactgtagccagtaggcacatgtggctattgagtccttgatgtgtggctggtgcaactgagggactgaatttttaatttcatttgattaaattaaattttattaaatttaaatagtagccacatgtgtctagtggttgctgtattcgacagtacagaactagcctttgactttaaaaatatttaacttcaacgaggccatcacagtaaaacttattatatgtgaattagggtggattaatatagtaaaattccacttggatgtagaatttaatcgaaaatgctaaaatacatagtatttgtcagggatacgatctgtcaccattaaacatcttgtgagggttggcttagaacttcaaatgtttttgtctctgtgcctgtgccactggaattgggccttaatgtttcattcacttgtggctctactagcaggattttgctcctccttgagagtgttacttgttctcggaaggaaagtattcctttgggtattttgaaatggttggttcagatacatacagattgtatatcttaatttagtcacacttagttctgatagtttctcataaggaatatcttcctaccaaatttattcagctttcttttttggaatgaataaacatatacccctatagagctagaaagttaaattgatttatagctgctgaatgtgctgtttttttataatggcgttcacacaagctagcaactaattcaccttatttttcctacaagatttaagaaataaagccttcaaaaattttgatttattttcctattggttcatattctatcatagttgtagtaatttgatacctgcttagatctcagaaatctaaacacactcttctatttttgtgttaggatttaataactatgtttggatttttggagaatgtttagtcttaagcatatatttacattcacttaatctgtagtaatagttctcaaacttgcataggtggcagagttgctggaaatagggttctttttcggaatactgtgaatttatactatatcaaattataatctatgtaatttattcaaaatcagatcgtatctctgctagaatttaaactaaggtaagtagtagccaaaattttaggcttaagaaaaatttagtgggagagacacttaaaattgagaacattgtattcatttactgcttttcttcccccactggaaaaagatgactgttttatttcagtggcaaaacacatcctgtaaccttgtaaaataccagtttcttgtggtattatgtatattatagtttaagaattgttttgtctaaaagaagtaaataatggaaggaggatcaatattatatttgacaagtatgaaatagaagaaaatgtgtacacgctaatttttttcttatttaatctataaaaattgttgttttattttttaaaattcttagcacatccatataggcttgaactatctgatcagtttattcaaacaactctacaaggtattaatatattcttcagtcctatagattacttattaaatgtttgcataccttttaaatgataatcagggtcaaatgcagagagtatagttatccacagtaatgtagttattttccatgtttaacatggaaagctctaaagtaaaatttttccttgataattataaatatgtttgttcttattgtattagaatcctaaccattgtctcatgtcgctcctttgttccttaagtagcaaactttttgatgtgtttgtacaacttacagaatgaatttttaattaaagcagacatagacatgcacatttgtgtgtgtgcataagaatttaggctttaaaatattaataaatatgaataaacttggaattcttataactcatttgtagtttaggttgttgcatggaataattattattctgtttcattttctacttaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttactatca
